United States Patent 10,981,992 (BISPECIFIC IMMUNOMODULATORY ANTIBODIES THAT BIND COSTIMULATORY AND CHECKPOINT RECEPTORS) - sequence listing, part 2

SEQ ID NO: 11182 - protein, 249 aa, Artificial Sequence
  Description of Artificial Sequence: Synthetic polypeptide
  XENP018513 1G6_H1.17_L1_scFv(GKPGS)4
EVQLVESGGGLVKPGGSLRLSCAASGFTFKNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 11183 - protein, 122 aa, Artificial Sequence
  Description of Artificial Sequence: Synthetic polypeptide
  VH of XENP018513
EVQLVESGGGLVKPGGSLRLSCAASGFTFKNYWMNWVRQAPGKGLEWVGEIRLKSNNYATHYAEPVKGRFTISRDDSKSTVYLQMNSLKTEDTAVYYCTRYYGNYGGYFDVWGAGTLVTVSS

SEQ ID NO: 11184 - protein, 107 aa, Artificial Sequence; identical to SEQ ID NO: 10923
  Description of Artificial Sequence: Synthetic polypeptide
  VL of XENP018513

SEQ ID NO: 11185 - protein, 5 aa, Artificial Sequence
  Description of Artificial Sequence: Synthetic peptide
  XENP018513 vhCDR1
NYWMN

SEQ ID NO: 11186 - protein, 19 aa, Artificial Sequence
  Description of Artificial Sequence: Synthetic peptide
  XENP018513 vhCDR2
EIRLKSNNYATHYAEPVKG

SEQ ID NO: 11187 - protein, 11 aa, Artificial Sequence
  Description of Artificial Sequence: Synthetic peptide
  XENP018513 vhCDR3
YYGNYGGYFDV

SEQ ID NO: 11188 - protein, 11 aa, Artificial Sequence
  Description of Artificial Sequence: Synthetic peptide
  XENP018513 vlCDR1
RASQSVSNDVA

SEQ ID NO: 11189 - protein, 7 aa, Artificial Sequence
  Description of Artificial Sequence: Synthetic peptide
  XENP018513 vlCDR2
YASHRYT

SEQ ID NO: 11190 - protein, 9 aa, Artificial Sequence
  Description of Artificial Sequence: Synthetic peptide
  XENP018513 vlCDR3
QQDYSSPRT

SEQ ID NO: 11191 - protein, 249 aa, Artificial Sequence
  Description of Artificial Sequence: Synthetic polypeptide
  XENP018514 1G6_H1.18_L1_scFv(GKPGS)4
EVQLVESGGGLVKPGGSLRLSCAASGFTFYNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 11192 - protein, 122 aa, Artificial Sequence
  Description of Artificial Sequence: Synthetic polypeptide
  VH of XENP018514
EVQLVESGGGLVKPGGSLRLSCAASGFTFYNYWMNWVRQAPGKGLEWVGEIRLKSNNYATHYAEPVKGRFTISRDDSKSTVYLQMNSLKTEDTAVYYCTRYYGNYGGYFDVWGAGTLVTVSS

SEQ ID NO: 11193 - protein, 107 aa, Artificial Sequence; identical to SEQ ID NO: 10923
  Description of Artificial Sequence: Synthetic polypeptide
  VL of XENP018514

SEQ ID NO: 11194 - protein, 5 aa, Artificial Sequence
  Description of Artificial Sequence: Synthetic peptide
  XENP018514 vhCDR1
NYWMN

SEQ ID NO: 11195 - protein, 19 aa, Artificial Sequence
  Description of Artificial Sequence: Synthetic peptide
  XENP018514 vhCDR2
EIRLKSNNYATHYAEPVKG

SEQ ID NO: 11196 - protein, 11 aa, Artificial Sequence
  Description of Artificial Sequence: Synthetic peptide
  XENP018514 vhCDR3
YYGNYGGYFDV

SEQ ID NO: 11197 - protein, 11 aa, Artificial Sequence
  Description of Artificial Sequence: Synthetic peptide
  XENP018514 vlCDR1
RASQSVSNDVA

SEQ ID NO: 11198 - protein, 7 aa, Artificial Sequence
  Description of Artificial Sequence: Synthetic peptide
  XENP018514 vlCDR2
YASHRYT

SEQ ID NO: 11199 - protein, 9 aa, Artificial Sequence
  Description of Artificial Sequence: Synthetic peptide
  XENP018514 vlCDR3
QQDYSSPRT

SEQ ID NO: 11200 - protein, 249 aa, Artificial Sequence
  Description of Artificial Sequence: Synthetic polypeptide
  XENP018515 1G6_H1.19_L1_scFv(GKPGS)4
EVQLVESGGGLVKPGGSLRLSCAASGFTFSDYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 11201 - protein, 122 aa, Artificial Sequence
  Description of Artificial Sequence: Synthetic polypeptide
  VH of XENP018515
EVQLVESGGGLVKPGGSLRLSCAASGFTFSDYWMNWVRQAPGKGLEWVGEIRLKSNNYATHYAEPVKGRFTISRDDSKSTVYLQMNSLKTEDTAVYYCTRYYGNYGGYFDVWGAGTLVTVSS

SEQ ID NO: 11202 - protein, 107 aa, Artificial Sequence; identical to SEQ ID NO: 10923
  Description of Artificial Sequence: Synthetic polypeptide
  VL of XENP018515

SEQ ID NO: 11203 - protein, 5 aa, Artificial Sequence
  Description of Artificial Sequence: Synthetic peptide
  XENP018515 vhCDR1
DYWMN

SEQ ID NO: 11204 - protein, 19 aa, Artificial Sequence
  Description of Artificial Sequence: Synthetic peptide
  XENP018515 vhCDR2
EIRLKSNNYATHYAEPVKG

SEQ ID NO: 11205 - protein, 11 aa, Artificial Sequence
  Description of Artificial Sequence: Synthetic peptide
  XENP018515 vhCDR3
YYGNYGGYFDV

SEQ ID NO: 11206 - protein, 11 aa, Artificial Sequence
  Description of Artificial Sequence: Synthetic peptide
  XENP018515 vlCDR1
RASQSVSNDVA

SEQ ID NO: 11207 - protein, 7 aa, Artificial Sequence
  Description of Artificial Sequence: Synthetic peptide
  XENP018515 vlCDR2
YASHRYT

SEQ ID NO: 11208 - protein, 9 aa, Artificial Sequence
  Description of Artificial Sequence: Synthetic peptide
  XENP018515 vlCDR3
QQDYSSPRT

SEQ ID NO: 11209 - protein, 249 aa, Artificial Sequence
  Description of Artificial Sequence: Synthetic polypeptide
  XENP018516 1G6_H1.20_L1_scFv(GKPGS)4
EVQLVESGGGLVKPGGSLRLSCAASGFTFSHYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 11210 - protein, 122 aa, Artificial Sequence
  Description of Artificial Sequence: Synthetic polypeptide
  VH of XENP018516
EVQLVESGGGLVKPGGSLRLSCAASGFTFSHYWMNWVRQAPGKGLEWVGEIRLKSNNYATHYAEPVKGRFTISRDDSKSTVYLQMNSLKTEDTAVYYCTRYYGNYGGYFDVWGAGTLVTVSS

SEQ ID NO: 11211 - protein, 107 aa, Artificial Sequence; identical to SEQ ID NO: 10923
  Description of Artificial Sequence: Synthetic polypeptide
  VL of XENP018516

SEQ ID NO: 11212 - protein, 5 aa, Artificial Sequence
  Description of Artificial Sequence: Synthetic peptide
  XENP018516 vhCDR1
HYWMN

SEQ ID NO: 11213 - protein, 19 aa, Artificial Sequence
  Description of Artificial Sequence: Synthetic peptide
  XENP018516 vhCDR2
EIRLKSNNYATHYAEPVKG

SEQ ID NO: 11214 - protein, 11 aa, Artificial Sequence
  Description of Artificial Sequence: Synthetic peptide
  XENP018516 vhCDR3
YYGNYGGYFDV

SEQ ID NO: 11215 - protein, 11 aa, Artificial Sequence
  Description of Artificial Sequence: Synthetic peptide
  XENP018516 vlCDR1
RASQSVSNDVA

SEQ ID NO: 11216 - protein, 7 aa, Artificial Sequence
  Description of Artificial Sequence: Synthetic peptide
  XENP018516 vlCDR2
YASHRYT

SEQ ID NO: 11217 - protein, 9 aa, Artificial Sequence
  Description of Artificial Sequence: Synthetic peptide
  XENP018516 vlCDR3
QQDYSSPRT

SEQ ID NO: 11218 - protein, 249 aa, Artificial Sequence
  Description of Artificial Sequence: Synthetic polypeptide
  XENP018517 1G6_H1.21_L1_scFv(GKPGS)4
EVQLVESGGGLVKPGGSLRLSCAASGFTFSEYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 11219 - protein, 122 aa, Artificial Sequence
  Description of Artificial Sequence: Synthetic polypeptide
  VH of XENP018517
EVQLVESGGGLVKPGGSLRLSCAASGFTFSEYWMNWVRQAPGKGLEWVGEIRLKSNNYATHYAEPVKGRFTISRDDSKSTVYLQMNSLKTEDTAVYYCTRYYGNYGGYFDVWGAGTLVTVSS

SEQ ID NO: 11220 - protein, 107 aa, Artificial Sequence; identical to SEQ ID NO: 10923
  Description of Artificial Sequence: Synthetic polypeptide
  VL of XENP018517

SEQ ID NO: 11221 - protein, 5 aa, Artificial Sequence
  Description of Artificial Sequence: Synthetic peptide
  XENP018517 vhCDR1
EYWMN

SEQ ID NO: 11222 - protein, 19 aa, Artificial Sequence
  Description of Artificial Sequence: Synthetic peptide
  XENP018517 vhCDR2
EIRLKSNNYATHYAEPVKG

SEQ ID NO: 11223 - protein, 11 aa, Artificial Sequence
  Description of Artificial Sequence: Synthetic peptide
  XENP018517 vhCDR3
YYGNYGGYFDV

SEQ ID NO: 11224 - protein, 11 aa, Artificial Sequence
  Description of Artificial Sequence: Synthetic peptide
  XENP018517 vlCDR1
RASQSVSNDVA

SEQ ID NO: 11225 - protein, 7 aa, Artificial Sequence
  Description of Artificial Sequence: Synthetic peptide
  XENP018517 vlCDR2
YASHRYT

SEQ ID NO: 11226 - protein, 9 aa, Artificial Sequence
  Description of Artificial Sequence: Synthetic peptide
  XENP018517 vlCDR3
QQDYSSPRT

SEQ ID NO: 11227 - protein, 249 aa, Artificial Sequence
  Description of Artificial Sequence: Synthetic polypeptide
  XENP018518 1G6_H1.22_L1_scFv(GKPGS)4
EVQLVESGGGLVKPGGSLRLSCAASGFTFSSYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 11228 - protein, 122 aa, Artificial Sequence
  Description of Artificial Sequence: Synthetic polypeptide
  VH of XENP018518
EVQLVESGGGLVKPGGSLRLSCAASGFTFSSYWMNWVRQAPGKGLEWVGEIRLKSNNYATHYAEPVKGRFTISRDDSKSTVYLQMNSLKTEDTAVYYCTRYYGNYGGYFDVWGAGTLVTVSS

SEQ ID NO: 11229 - protein, 107 aa, Artificial Sequence; identical to SEQ ID NO: 10923
  Description of Artificial Sequence: Synthetic polypeptide
  VL of XENP018518

SEQ ID NO: 11230 - protein, 5 aa, Artificial Sequence
  Description of Artificial Sequence: Synthetic peptide
  XENP018518 vhCDR1
SYWMN

SEQ ID NO: 11231 - protein, 19 aa, Artificial Sequence
  Description of Artificial Sequence: Synthetic peptide
  XENP018518 vhCDR2
EIRLKSNNYATHYAEPVKG

SEQ ID NO: 11232 - protein, 11 aa, Artificial Sequence
  Description of Artificial Sequence: Synthetic peptide
  XENP018518 vhCDR3
YYGNYGGYFDV

SEQ ID NO: 11233 - protein, 11 aa, Artificial Sequence
  Description of Artificial Sequence: Synthetic peptide
  XENP018518 vlCDR1
RASQSVSNDVA

SEQ ID NO: 11234 - protein, 7 aa, Artificial Sequence
  Description of Artificial Sequence: Synthetic peptide
  XENP018518 vlCDR2
YASHRYT

SEQ ID NO: 11235 - protein, 9 aa, Artificial Sequence
  Description of Artificial Sequence: Synthetic peptide
  XENP018518 vlCDR3
QQDYSSPRT

SEQ ID NO: 11236 - protein, 249 aa, Artificial Sequence
  Description of Artificial Sequence: Synthetic polypeptide
  XENP018519 1G6_H1.23_L1_scFv(GKPGS)4
EVQLVESGGGLVKPGGSLRLSCAASGFTFSRYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 11237 - protein, 122 aa, Artificial Sequence
  Description of Artificial Sequence: Synthetic polypeptide
  VH of XENP018519
EVQLVESGGGLVKPGGSLRLSCAASGFTFSRYWMNWVRQAPGKGLEWVGEIRLKSNNYATHYAEPVKGRFTISRDDSKSTVYLQMNSLKTEDTAVYYCTRYYGNYGGYFDVWGAGTLVTVSS

SEQ ID NO: 11238 - protein, 107 aa, Artificial Sequence; identical to SEQ ID NO: 10923
  Description of Artificial Sequence: Synthetic polypeptide
  VL of XENP018519

SEQ ID NO: 11239 - protein, 5 aa, Artificial Sequence
  Description of Artificial Sequence: Synthetic peptide
  XENP018519 vhCDR1
RYWMN

SEQ ID NO: 11240 - protein, 19 aa, Artificial Sequence
  Description of Artificial Sequence: Synthetic peptide
  XENP018519 vhCDR2
EIRLKSNNYATHYAEPVKG

SEQ ID NO: 11241 - protein, 11 aa, Artificial Sequence
  Description of Artificial Sequence: Synthetic peptide
  XENP018519 vhCDR3
YYGNYGGYFDV

SEQ ID NO: 11242 - protein, 11 aa, Artificial Sequence
  Description of Artificial Sequence: Synthetic peptide
  XENP018519 vlCDR1
RASQSVSNDVA

SEQ ID NO: 11243 - protein, 7 aa, Artificial Sequence
  Description of Artificial Sequence: Synthetic peptide
  XENP018519 vlCDR2
YASHRYT

SEQ ID NO: 11244 - protein, 9 aa, Artificial Sequence
  Description of Artificial Sequence: Synthetic peptide
  XENP018519 vlCDR3
QQDYSSPRT

SEQ ID NO: 11245 - protein, 249 aa, Artificial Sequence
  Description of Artificial Sequence: Synthetic polypeptide
  XENP018520 1G6_H1.24_L1_scFv(GKPGS)4
EVQLVESGGGLVKPGGSLRLSCAASGFTFSLYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 11246 - protein, 122 aa, Artificial Sequence
  Description of Artificial Sequence: Synthetic polypeptide
  VH of XENP018520
EVQLVESGGGLVKPGGSLRLSCAASGFTFSLYWMNWVRQAPGKGLEWVGEIRLKSNNYATHYAEPVKGRFTISRDDSKSTVYLQMNSLKTEDTAVYYCTRYYGNYGGYFDVWGAGTLVTVSS

SEQ ID NO: 11247 - protein, 107 aa, Artificial Sequence; identical to SEQ ID NO: 10923
  Description of Artificial Sequence: Synthetic polypeptide
  VL of XENP018520

SEQ ID NO: 11248 - protein, 5 aa, Artificial Sequence
  Description of Artificial Sequence: Synthetic peptide
  XENP018520 vhCDR1
LYWMN

SEQ ID NO: 11249 - protein, 19 aa, Artificial Sequence
  Description of Artificial Sequence: Synthetic peptide
  XENP018520 vhCDR2
EIRLKSNNYATHYAEPVKG

SEQ ID NO: 11250 - protein, 11 aa, Artificial Sequence
  Description of Artificial Sequence: Synthetic peptide
  XENP018520 vhCDR3
YYGNYGGYFDV

SEQ ID NO: 11251 - protein, 11 aa, Artificial Sequence
  Description of Artificial Sequence: Synthetic peptide
  XENP018520 vlCDR1
RASQSVSNDVA

SEQ ID NO: 11252 - protein, 7 aa, Artificial Sequence
  Description of Artificial Sequence: Synthetic peptide
  XENP018520 vlCDR2
YASHRYT

SEQ ID NO: 11253 - protein, 9 aa, Artificial Sequence
  Description of Artificial Sequence: Synthetic peptide
  XENP018520 vlCDR3
QQDYSSPRT

SEQ ID NO: 11254 - protein, 249 aa, Artificial Sequence
  Description of Artificial Sequence: Synthetic polypeptide
  XENP018521 1G6_H1.25_L1_scFv(GKPGS)4
EVQLVESGGGLVKPGGSLRLSCAASGFTFSTYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 11255 - protein, 122 aa, Artificial Sequence
  Description of Artificial Sequence: Synthetic polypeptide
  VH of XENP018521
EVQLVESGGGLVKPGGSLRLSCAASGFTFSTYWMNWVRQAPGKGLEWVGEIRLKSNNYATHYAEPVKGRFTISRDDSKSTVYLQMNSLKTEDTAVYYCTRYYGNYGGYFDVWGAGTLVTVSS

SEQ ID NO: 11256 - protein, 107 aa, Artificial Sequence; identical to SEQ ID NO: 10923
  Description of Artificial Sequence: Synthetic polypeptide
  VL of XENP018521

SEQ ID NO: 11257 - protein, 5 aa, Artificial Sequence
  Description of Artificial Sequence: Synthetic peptide
  XENP018521 vhCDR1
TYWMN

SEQ ID NO: 11258 - protein, 19 aa, Artificial Sequence
  Description of Artificial Sequence: Synthetic peptide
  XENP018521 vhCDR2
EIRLKSNNYATHYAEPVKG

SEQ ID NO: 11259 - protein, 11 aa, Artificial Sequence
  Description of Artificial Sequence: Synthetic peptide
  XENP018521 vhCDR3
YYGNYGGYFDV

SEQ ID NO: 11260 - protein, 11 aa, Artificial Sequence
  Description of Artificial Sequence: Synthetic peptide
  XENP018521 vlCDR1
RASQSVSNDVA

SEQ ID NO: 11261 - protein, 7 aa, Artificial Sequence
  Description of Artificial Sequence: Synthetic peptide
  XENP018521 vlCDR2
YASHRYT

SEQ ID NO: 11262 - protein, 9 aa, Artificial Sequence
  Description of Artificial Sequence: Synthetic peptide
  XENP018521 vlCDR3
QQDYSSPRT

SEQ ID NO: 11263 - protein, 249 aa, Artificial Sequence
  Description of Artificial Sequence: Synthetic polypeptide
  XENP018522 1G6_H1.26_L1_scFv(GKPGS)4
EVQLVESGGGLVKPGGSLRLSCAASGFTFSGYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 11264 - protein, 122 aa, Artificial Sequence
  Description of Artificial Sequence: Synthetic polypeptide
  VH of XENP018522
EVQLVESGGGLVKPGGSLRLSCAASGFTFSGYWMNWVRQAPGKGLEWVGEIRLKSNNYATHYAEPVKGRFTISRDDSKSTVYLQMNSLKTEDTAVYYCTRYYGNYGGYFDVWGAGTLVTVSS

SEQ ID NO: 11265 - protein, 107 aa, Artificial Sequence; identical to SEQ ID NO: 10923
  Description of Artificial Sequence: Synthetic polypeptide
  VL of XENP018522

SEQ ID NO: 11266 - protein, 5 aa, Artificial Sequence
  Description of Artificial Sequence: Synthetic peptide
  XENP018522 vhCDR1
GYWMN

SEQ ID NO: 11267 - protein, 19 aa, Artificial Sequence
  Description of Artificial Sequence: Synthetic peptide
  XENP018522 vhCDR2
EIRLKSNNYATHYAEPVKG

SEQ ID NO: 11268 - protein, 11 aa, Artificial Sequence
  Description of Artificial Sequence: Synthetic peptide
  XENP018522 vhCDR3
YYGNYGGYFDV

SEQ ID NO: 11269 - protein, 11 aa, Artificial Sequence
  Description of Artificial Sequence: Synthetic peptide
  XENP018522 vlCDR1
RASQSVSNDVA

SEQ ID NO: 11270 - protein, 7 aa, Artificial Sequence
  Description of Artificial Sequence: Synthetic peptide
  XENP018522 vlCDR2
YASHRYT

SEQ ID NO: 11271 - protein, 9 aa, Artificial Sequence
  Description of Artificial Sequence: Synthetic peptide
  XENP018522 vlCDR3
QQDYSSPRT

SEQ ID NO: 11272 - protein, 249 aa, Artificial Sequence
  Description of Artificial Sequence: Synthetic polypeptide
  XENP018523 1G6_H1.27_L1_scFv(GKPGS)4
EVQLVESGGGLVKPGGSLRLSCAASGFTFSYYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 11273 - protein, 122 aa, Artificial Sequence
  Description of Artificial Sequence: Synthetic polypeptide
  VH of XENP018523
EVQLVESGGGLVKPGGSLRLSCAASGFTFSYYWMNWVRQAPGKGLEWVGEIRLKSNNYATHYAEPVKGRFTISRDDSKSTVYLQMNSLKTEDTAVYYCTRYYGNYGGYFDVWGAGTLVTVSS

SEQ ID NO: 11274 - protein, 107 aa, Artificial Sequence; identical to SEQ ID NO: 10923
  Description of Artificial Sequence: Synthetic polypeptide
  VL of XENP018523

SEQ ID NO: 11275 - protein, 5 aa, Artificial Sequence
  Description of Artificial Sequence: Synthetic peptide
  XENP018523 vhCDR1
YYWMN

SEQ ID NO: 11276 - protein, 19 aa, Artificial Sequence
  Description of Artificial Sequence: Synthetic peptide
  XENP018523 vhCDR2
EIRLKSNNYATHYAEPVKG

SEQ ID NO: 11277 - protein, 11 aa, Artificial Sequence
  Description of Artificial Sequence: Synthetic peptide
  XENP018523 vhCDR3
YYGNYGGYFDV

SEQ ID NO: 11278 - protein, 11 aa, Artificial Sequence
  Description of Artificial Sequence: Synthetic peptide
  XENP018523 vlCDR1
RASQSVSNDVA

SEQ ID NO: 11279 - protein, 7 aa, Artificial Sequence
  Description of Artificial Sequence: Synthetic peptide
  XENP018523 vlCDR2
YASHRYT

SEQ ID NO: 11280 - protein, 9 aa, Artificial Sequence
  Description of Artificial Sequence: Synthetic peptide
  XENP018523 vlCDR3
QQDYSSPRT

SEQ ID NO: 11281 - protein, 249 aa, Artificial Sequence
  Description of Artificial Sequence: Synthetic polypeptide
  XENP018524 1G6_H1.28_L1_scFv(GKPGS)4
EVQLVESGGGLVKPGGSLRLSCAASGFTFSNFWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 11282 - protein, 122 aa, Artificial Sequence
  Description of Artificial Sequence: Synthetic polypeptide
  VH of XENP018524
EVQLVESGGGLVKPGGSLRLSCAASGFTFSNFWMNWVRQAPGKGLEWVGEIRLKSNNYATHYAEPVKGRFTISRDDSKSTVYLQMNSLKTEDTAVYYCTRYYGNYGGYFDVWGAGTLVTVSS

SEQ ID NO: 11283 - protein, 107 aa, Artificial Sequence; identical to SEQ ID NO: 10923
  Description of Artificial Sequence: Synthetic polypeptide
  VL of XENP018524

SEQ ID NO: 11284 - protein, 5 aa, Artificial Sequence
  Description of Artificial Sequence: Synthetic peptide
  XENP018524 vhCDR1
NFWMN

SEQ ID NO: 11285 - protein, 19 aa, Artificial Sequence
  Description of Artificial Sequence: Synthetic peptide
  XENP018524 vhCDR2
EIRLKSNNYATHYAEPVKG

SEQ ID NO: 11286 - protein, 11 aa, Artificial Sequence
  Description of Artificial Sequence: Synthetic peptide
  XENP018524 vhCDR3
YYGNYGGYFDV

SEQ ID NO: 11287 - protein, 11 aa, Artificial Sequence
  Description of Artificial Sequence: Synthetic peptide
  XENP018524 vlCDR1
RASQSVSNDVA

SEQ ID NO: 11288 - protein, 7 aa, Artificial Sequence
  Description of Artificial Sequence: Synthetic peptide
  XENP018524 vlCDR2
YASHRYT

SEQ ID NO: 11289 - protein, 9 aa, Artificial Sequence
  Description of Artificial Sequence: Synthetic peptide
  XENP018524 vlCDR3
QQDYSSPRT

SEQ ID NO: 11290 - protein, 249 aa, Artificial Sequence
  Description of Artificial Sequence: Synthetic polypeptide
  XENP018525 1G6_H1.29_L1_scFv(GKPGS)4
EVQLVESGGGLVKPGGSLRLSCAASGFTFSNHWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 11291 - protein, 122 aa, Artificial Sequence
  Description of Artificial Sequence: Synthetic polypeptide
  VH of XENP018525
EVQLVESGGGLVKPGGSLRLSCAASGFTFSNHWMNWVRQAPGKGLEWVGEIRLKSNNYATHYAEPVKGRFTISRDDSKSTVYLQMNSLKTEDTAVYYCTRYYGNYGGYFDVWGAGTLVTVSS

SEQ ID NO: 11292 - protein, 107 aa, Artificial Sequence; identical to SEQ ID NO: 10923
  Description of Artificial Sequence: Synthetic polypeptide
  VL of XENP018525

SEQ ID NO: 11293 - protein, 5 aa, Artificial Sequence
  Description of Artificial Sequence: Synthetic peptide
  XENP018525 vhCDR1
NHWMN

SEQ ID NO: 11294 - protein, 19 aa, Artificial Sequence
  Description of Artificial Sequence: Synthetic peptide
  XENP018525 vhCDR2
EIRLKSNNYATHYAEPVKG

SEQ ID NO: 11295 - protein, 11 aa, Artificial Sequence
  Description of Artificial Sequence: Synthetic peptide
  XENP018525 vhCDR3
YYGNYGGYFDV

SEQ ID NO: 11296 - protein, 11 aa, Artificial Sequence
  Description of Artificial Sequence: Synthetic peptide
  XENP018525 vlCDR1
RASQSVSNDVA

SEQ ID NO: 11297 - protein, 7 aa, Artificial Sequence
  Description of Artificial Sequence: Synthetic peptide
  XENP018525 vlCDR2
YASHRYT

SEQ ID NO: 11298 - protein, 9 aa, Artificial Sequence
  Description of Artificial Sequence: Synthetic peptide
  XENP018525 vlCDR3
QQDYSSPRT

SEQ ID NO: 11299 - protein, 249 aa, Artificial Sequence
  Description of Artificial Sequence: Synthetic polypeptide
  XENP018526 1G6_H1.30_L1_scFv(GKPGS)4
EVQLVESGGGLVKPGGSLRLSCAASGFTFSNLWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 11300 - protein, 122 aa, Artificial Sequence
  Description of Artificial Sequence: Synthetic polypeptide
  VH of XENP018526
EVQLVESGGGLVKPGGSLRLSCAASGFTFSNLWMNWVRQAPGKGLEWVGEIRLKSNNYATHYAEPVKGRFTISRDDSKSTVYLQMNSLKTEDTAVYYCTRYYGNYGGYFDVWGAGTLVTVSS

SEQ ID NO: 11301 - protein, 107 aa, Artificial Sequence; identical to SEQ ID NO: 10923
  Description of Artificial Sequence: Synthetic polypeptide
  VL of XENP018526

SEQ ID NO: 11302 - protein, 5 aa, Artificial Sequence
  Description of Artificial Sequence: Synthetic peptide
  XENP018526 vhCDR1
NLWMN

SEQ ID NO: 11303 - protein, 19 aa, Artificial Sequence
  Description of Artificial Sequence: Synthetic peptide
  XENP018526 vhCDR2
EIRLKSNNYATHYAEPVKG

SEQ ID NO: 11304 - protein, 11 aa, Artificial Sequence
  Description of Artificial Sequence: Synthetic peptide
  XENP018526 vhCDR3
YYGNYGGYFDV

SEQ ID NO: 11305 - protein, 11 aa, Artificial Sequence
  Description of Artificial Sequence: Synthetic peptide
  XENP018526 vlCDR1
RASQSVSNDVA

SEQ ID NO: 11306 - protein, 7 aa, Artificial Sequence
  Description of Artificial Sequence: Synthetic peptide
  XENP018526 vlCDR2
YASHRYT

SEQ ID NO: 11307 - protein, 9 aa, Artificial Sequence
  Description of Artificial Sequence: Synthetic peptide
  XENP018526 vlCDR3
QQDYSSPRT

SEQ ID NO: 11308 - protein, 249 aa, Artificial Sequence
  Description of Artificial Sequence: Synthetic polypeptide
  XENP018527 1G6_H1.31_L1_scFv(GKPGS)4
EVQLVESGGGLVKPGGSLRLSCAASGFTFSNWWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 11309 - protein, 122 aa, Artificial Sequence
  Description of Artificial Sequence: Synthetic polypeptide
  VH of XENP018527
EVQLVESGGGLVKPGGSLRLSCAASGFTFSNWWMNWVRQAPGKGLEWVGEIRLKSNNYATHYAEPVKGRFTISRDDSKSTVYLQMNSLKTEDTAVYYCTRYYGNYGGYFDVWGAGTLVTVSS

SEQ ID NO: 11310 - protein, 107 aa, Artificial Sequence; identical to SEQ ID NO: 10923
  Description of Artificial Sequence: Synthetic polypeptide
  VL of XENP018527

SEQ ID NO: 11311 - protein, 5 aa, Artificial Sequence
  Description of Artificial Sequence: Synthetic peptide
  XENP018527 vhCDR1
NWWMN

SEQ ID NO: 11312 - protein, 19 aa, Artificial Sequence
  Description of Artificial Sequence: Synthetic peptide
  XENP018527 vhCDR2
EIRLKSNNYATHYAEPVKG

SEQ ID NO: 11313 - protein, 11 aa, Artificial Sequence
  Description of Artificial Sequence: Synthetic peptide
  XENP018527 vhCDR3
YYGNYGGYFDV

SEQ ID NO: 11314 - protein, 11 aa, Artificial Sequence
  Description of Artificial Sequence: Synthetic peptide
  XENP018527 vlCDR1
RASQSVSNDVA

SEQ ID NO: 11315 - protein, 7 aa, Artificial Sequence
  Description of Artificial Sequence: Synthetic peptide
  XENP018527 vlCDR2
YASHRYT

SEQ ID NO: 11316 - protein, 9 aa, Artificial Sequence
  Description of Artificial Sequence: Synthetic peptide
  XENP018527 vlCDR3
QQDYSSPRT

SEQ ID NO: 11317 - protein, 249 aa, Artificial Sequence
  Description of Artificial Sequence: Synthetic polypeptide
  XENP018528 1G6_H1.32_L1_scFv(GKPGS)4
EVQLVESGGGLVKPGGSLRLSCAASGFTFSNVWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 11318 - protein, 122 aa, Artificial Sequence
  Description of Artificial Sequence: Synthetic polypeptide
  VH of XENP018528
EVQLVESGGGLVKPGGSLRLSCAASGFTFSNVWMNWVRQAPGKGLEWVGEIRLKSNNYATHYAEPVKGRFTISRDDSKSTVYLQMNSLKTEDTAVYYCTRYYGNYGGYFDVWGAGTLVTVSS

SEQ ID NO: 11319 - protein, 107 aa, Artificial Sequence; identical to SEQ ID NO: 10923
  Description of Artificial Sequence: Synthetic polypeptide
  VL of XENP018528

SEQ ID NO: 11320 - protein, 5 aa, Artificial Sequence
  Description of Artificial Sequence: Synthetic peptide
  XENP018528 vhCDR1
NVWMN

SEQ ID NO: 11321 - protein, 19 aa, Artificial Sequence
  Description of Artificial Sequence: Synthetic peptide
  XENP018528 vhCDR2
EIRLKSNNYATHYAEPVKG

SEQ ID NO: 11322 - protein, 11 aa, Artificial Sequence
  Description of Artificial Sequence: Synthetic peptide
  XENP018528 vhCDR3
YYGNYGGYFDV

SEQ ID NO: 11323 - protein, 11 aa, Artificial Sequence
  Description of Artificial Sequence: Synthetic peptide
  XENP018528 vlCDR1
RASQSVSNDVA

SEQ ID NO: 11324 - protein, 7 aa, Artificial Sequence
  Description of Artificial Sequence: Synthetic peptide
  XENP018528 vlCDR2
YASHRYT

SEQ ID NO: 11325 - protein, 9 aa, Artificial Sequence
  Description of Artificial Sequence: Synthetic peptide
  XENP018528 vlCDR3
QQDYSSPRT

SEQ ID NO: 11326 - protein, 249 aa, Artificial Sequence
  Description of Artificial Sequence: Synthetic polypeptide
  XENP018529 1G6_H1.33_L1_scFv(GKPGS)4
EVQLVESGGGLVKPGGSLRLSCAASGFTFSNAWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 11327 - protein, 122 aa, Artificial Sequence
  Description of Artificial Sequence: Synthetic polypeptide
  VH of XENP018529
EVQLVESGGGLVKPGGSLRLSCAASGFTFSNAWMNWVRQAPGKGLEWVGEIRLKSNNYATHYAEPVKGRFTISRDDSKSTVYLQMNSLKTEDTAVYYCTRYYGNYGGYFDVWGAGTLVTVSS

SEQ ID NO: 11328 - protein, 107 aa, Artificial Sequence; identical to SEQ ID NO: 10923
  Description of Artificial Sequence: Synthetic polypeptide
  VL of XENP018529

SEQ ID NO: 11329 - protein, 5 aa, Artificial Sequence
  Description of Artificial Sequence: Synthetic peptide
  XENP018529 vhCDR1
NAWMN

SEQ ID NO: 11330 - protein, 19 aa, Artificial Sequence
  Description of Artificial Sequence: Synthetic peptide
  XENP018529 vhCDR2
EIRLKSNNYATHYAEPVKG

SEQ ID NO: 11331 - protein, 11 aa, Artificial Sequence
  Description of Artificial Sequence: Synthetic peptide
  XENP018529 vhCDR3
YYGNYGGYFDV

SEQ ID NO: 11332 - protein, 11 aa, Artificial Sequence
  Description of Artificial Sequence: Synthetic peptide
  XENP018529 vlCDR1
RASQSVSNDVA

SEQ ID NO: 11333 - protein, 7 aa, Artificial Sequence
  Description of Artificial Sequence: Synthetic peptide
  XENP018529 vlCDR2
YASHRYT

SEQ ID NO: 11334 - protein, 9 aa, Artificial Sequence
  Description of Artificial Sequence: Synthetic peptide
  XENP018529 vlCDR3
QQDYSSPRT

SEQ ID NO: 11335 - protein, 249 aa, Artificial Sequence
  Description of Artificial Sequence: Synthetic polypeptide
  XENP018530 1G6_H1.34_L1_scFv(GKPGS)4
EVQLVESGGGLVKPGGSLRLSCAASGFTFSNQWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 11336 - protein, 122 aa, Artificial Sequence
  Description of Artificial Sequence: Synthetic polypeptide
  VH of XENP018530
EVQLVESGGGLVKPGGSLRLSCAASGFTFSNQWMNWVRQAPGKGLEWVGEIRLKSNNYATHYAEPVKGRFTISRDDSKSTVYLQMNSLKTEDTAVYYCTRYYGNYGGYFDVWGAGTLVTVSS

SEQ ID NO: 11337 - protein, 107 aa, Artificial Sequence; identical to SEQ ID NO: 10923
  Description of Artificial Sequence: Synthetic polypeptide
  VL of XENP018530

SEQ ID NO: 11338 - protein, 5 aa, Artificial Sequence
  Description of Artificial Sequence: Synthetic peptide
  XENP018530 vhCDR1
NQWMN

SEQ ID NO: 11339 - protein, 19 aa, Artificial Sequence
  Description of Artificial Sequence: Synthetic peptide
  XENP018530 vhCDR2
EIRLKSNNYATHYAEPVKG

SEQ ID NO: 11340 - protein, 11 aa, Artificial Sequence
  Description of Artificial Sequence: Synthetic peptide
  XENP018530 vhCDR3
YYGNYGGYFDV

SEQ ID NO: 11341 - protein, 11 aa, Artificial Sequence
  Description of Artificial Sequence: Synthetic peptide
  XENP018530 vlCDR1
RASQSVSNDVA

SEQ ID NO: 11342 - protein, 7 aa, Artificial Sequence
  Description of Artificial Sequence: Synthetic peptide
  XENP018530 vlCDR2
YASHRYT

SEQ ID NO: 11343 - protein, 9 aa, Artificial Sequence
  Description of Artificial Sequence: Synthetic peptide
  XENP018530 vlCDR3
QQDYSSPRT

SEQ ID NO: 11344 - protein, 249 aa, Artificial Sequence
  Description of Artificial Sequence: Synthetic polypeptide
  XENP018531 1G6_H1.35_L1_scFv(GKPGS)4
EVQLVESGGGLVKPGGSLRLSCAASGFTFSNDWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 11345 - protein, 122 aa, Artificial Sequence
  Description of Artificial Sequence: Synthetic polypeptide
  VH of XENP018531
EVQLVESGGGLVKPGGSLRLSCAASGFTFSNDWMNWVRQAPGKGLEWVGEIRLKSNNYATHYAEPVKGRFTISRDDSKSTVYLQMNSLKTEDTAVYYCTRYYGNYGGYFDVWGAGTLVTVSS

SEQ ID NO: 11346 - protein, 107 aa, Artificial Sequence; identical to SEQ ID NO: 10923
  Description of Artificial Sequence: Synthetic polypeptide
  VL of XENP018531

SEQ ID NO: 11347 - protein, 5 aa, Artificial Sequence
  Description of Artificial Sequence: Synthetic peptide
  XENP018531 vhCDR1
NDWMN

SEQ ID NO: 11348 - protein, 19 aa, Artificial Sequence
  Description of Artificial Sequence: Synthetic peptide
  XENP018531 vhCDR2
EIRLKSNNYATHYAEPVKG

SEQ ID NO: 11349 - protein, 11 aa, Artificial Sequence
  Description of Artificial Sequence: Synthetic peptide
  XENP018531 vhCDR3
YYGNYGGYFDV

SEQ ID NO: 11350 - protein, 11 aa, Artificial Sequence
  Description of Artificial Sequence: Synthetic peptide
  XENP018531 vlCDR1
RASQSVSNDVA

SEQ ID NO: 11351 - protein, 7 aa, Artificial Sequence
  Description of Artificial Sequence: Synthetic peptide
  XENP018531 vlCDR2
YASHRYT

SEQ ID NO: 11352 - protein, 9 aa, Artificial Sequence
  Description of Artificial Sequence: Synthetic peptide
  XENP018531 vlCDR3
QQDYSSPRT

SEQ ID NO: 11353 - protein, 249 aa, Artificial Sequence
  Description of Artificial Sequence: Synthetic polypeptide
  XENP018532 1G6_H1.36_L1_scFv(GKPGS)4
EVQLVESGGGLVKPGGSLRLSCAASGFTFSNKWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 11354 - protein, 122 aa, Artificial Sequence
  Description of Artificial Sequence: Synthetic polypeptide
  VH of XENP018532
EVQLVESGGGLVKPGGSLRLSCAASGFTFSNKWMNWVRQAPGKGLEWVGEIRLKSNNYATHYAEPVKGRFTISRDDSKSTVYLQMNSLKTEDTAVYYCTRYYGNYGGYFDVWGAGTLVTVSS

SEQ ID NO: 11355 - protein, 107 aa, Artificial Sequence; identical to SEQ ID NO: 10923
  Description of Artificial Sequence: Synthetic polypeptide
  VL of XENP018532

SEQ ID NO: 11356 - protein, 5 aa, Artificial Sequence
  Description of Artificial Sequence: Synthetic peptide
  XENP018532 vhCDR1
NKWMN

SEQ ID NO: 11357 - protein, 19 aa, Artificial Sequence
  Description of Artificial Sequence: Synthetic peptide
  XENP018532 vhCDR2
EIRLKSNNYATHYAEPVKG

SEQ ID NO: 11358 - protein, 11 aa, Artificial Sequence
  Description of Artificial Sequence: Synthetic peptide
  XENP018532 vhCDR3
YYGNYGGYFDV

SEQ ID NO: 11359 - protein, 11 aa, Artificial Sequence
  Description of Artificial Sequence: Synthetic peptide
  XENP018532 vlCDR1
RASQSVSNDVA

SEQ ID NO: 11360 - protein, 7 aa, Artificial Sequence
  Description of Artificial Sequence: Synthetic peptide
  XENP018532 vlCDR2
YASHRYT

SEQ ID NO: 11361 - protein, 9 aa, Artificial Sequence
  Description of Artificial Sequence: Synthetic peptide
  XENP018532 vlCDR3
QQDYSSPRT

SEQ ID NO: 11362 - protein, 249 aa, Artificial Sequence
  Description of Artificial Sequence: Synthetic polypeptide
  XENP018533 1G6_H1.37_L1_scFv(GKPGS)4
EVQLVESGGGLVKPGGSLRLSCAASGFTFSNYGMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 11363 - protein, 122 aa, Artificial Sequence
  Description of Artificial Sequence: Synthetic polypeptide
  VH of XENP018533
EVQLVESGGGLVKPGGSLRLSCAASGFTFSNYGMNWVRQAPGKGLEWVGEIRLKSNNYATHYAEPVKGRFTISRDDSKSTVYLQMNSLKTEDTAVYYCTRYYGNYGGYFDVWGAGTLVTVSS

SEQ ID NO: 11364 - protein, 107 aa, Artificial Sequence; identical to SEQ ID NO: 10923
  Description of Artificial Sequence: Synthetic polypeptide
  VL of XENP018533

SEQ ID NO: 11365 - protein, 5 aa, Artificial Sequence
  Description of Artificial Sequence: Synthetic peptide
  XENP018533 vhCDR1
NYGMN

SEQ ID NO: 11366 - protein, 19 aa, Artificial Sequence
  Description of Artificial Sequence: Synthetic peptide
  XENP018533 vhCDR2
EIRLKSNNYATHYAEPVKG

SEQ ID NO: 11367 - protein, 11 aa, Artificial Sequence
  Description of Artificial Sequence: Synthetic peptide
  XENP018533 vhCDR3
YYGNYGGYFDV

SEQ ID NO: 11368 - protein, 11 aa, Artificial Sequence
  Description of Artificial Sequence: Synthetic peptide
  XENP018533 vlCDR1
RASQSVSNDVA

SEQ ID NO: 11369 - protein, 7 aa, Artificial Sequence
  Description of Artificial Sequence: Synthetic peptide
  XENP018533 vlCDR2
YASHRYT

SEQ ID NO: 11370 - protein, 9 aa, Artificial Sequence
  Description of Artificial Sequence: Synthetic peptide
  XENP018533 vlCDR3
QQDYSSPRT

SEQ ID NO: 11371 - protein, 249 aa, Artificial Sequence
  Description of Artificial Sequence: Synthetic polypeptide
  XENP018534 1G6_H1.38_L1_scFv(GKPGS)4
EVQLVESGGGLVKPGGSLRLSCAASGFTFSNYAMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 11372 - protein, 122 aa, Artificial Sequence
  Description of Artificial Sequence: Synthetic polypeptide
  VH of XENP018534
EVQLVESGGGLVKPGGSLRLSCAASGFTFSNYAMNWVRQAPGKGLEWVGEIRLKSNNYATHYAEPVKGRFTISRDDSKSTVYLQMNSLKTEDTAVYYCTRYYGNYGGYFDVWGAGTLVTVSS

SEQ ID NO: 11373 - protein, 107 aa, Artificial Sequence; identical to SEQ ID NO: 10923
  Description of Artificial Sequence: Synthetic polypeptide
  VL of XENP018534

SEQ ID NO: 11374 - protein, 5 aa, Artificial Sequence
  Description of Artificial Sequence: Synthetic peptide
  XENP018534 vhCDR1
NYAMN

SEQ ID NO: 11375 - protein, 19 aa, Artificial Sequence
  Description of Artificial Sequence: Synthetic peptide
  XENP018534 vhCDR2
EIRLKSNNYATHYAEPVKG

SEQ ID NO: 11376 - protein, 11 aa, Artificial Sequence
  Description of Artificial Sequence: Synthetic peptide
  XENP018534 vhCDR3
YYGNYGGYFDV

SEQ ID NO: 11377 - protein, 11 aa, Artificial Sequence
  Description of Artificial Sequence: Synthetic peptide
  XENP018534 vlCDR1
RASQSVSNDVA

SEQ ID NO: 11378 - protein, 7 aa, Artificial Sequence
  Description of Artificial Sequence: Synthetic peptide
  XENP018534 vlCDR2
YASHRYT

SEQ ID NO: 11379 - protein, 9 aa, Artificial Sequence
  Description of Artificial Sequence: Synthetic peptide
  XENP018534 vlCDR3
QQDYSSPRT

SEQ ID NO: 11380 - protein, 249 aa, Artificial Sequence
  Description of Artificial Sequence: Synthetic polypeptide
  XENP018535 1G6_H1.39_L1_scFv(GKPGS)4
EVQLVESGGGLVKPGGSLRLSCAASGFTFSNYYMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 11381 - protein, 122 aa, Artificial Sequence
  Description of Artificial Sequence: Synthetic polypeptide
  VH of XENP018535
EVQLVESGGGLVKPGGSLRLSCAASGFTFSNYYMNWVRQAPGKGLEWVGEIRLKSNNYATHYAEPVKGRFTISRDDSKSTVYLQMNSLKTEDTAVYYCTRYYGNYGGYFDVWGAGTLVTVSS

SEQ ID NO: 11382 - protein, 107 aa, Artificial Sequence; identical to SEQ ID NO: 10923
  Description of Artificial Sequence: Synthetic polypeptide
  VL of XENP018535

SEQ ID NO: 11383 - protein, 5 aa, Artificial Sequence
  Description of Artificial Sequence: Synthetic peptide
  XENP018535 vhCDR1
NYYMN

SEQ ID NO: 11384 - protein, 19 aa, Artificial Sequence
  Description of Artificial Sequence: Synthetic peptide
  XENP018535 vhCDR2
EIRLKSNNYATHYAEPVKG

SEQ ID NO: 11385 - protein, 11 aa, Artificial Sequence
  Description of Artificial Sequence: Synthetic peptide
  XENP018535 vhCDR3
YYGNYGGYFDV

SEQ ID NO: 11386 - protein, 11 aa, Artificial Sequence
  Description of Artificial Sequence: Synthetic peptide
  XENP018535 vlCDR1
RASQSVSNDVA

SEQ ID NO: 11387 - protein, 7 aa, Artificial Sequence
  Description of Artificial Sequence: Synthetic peptide
  XENP018535 vlCDR2
YASHRYT

SEQ ID NO: 11388 - protein, 9 aa, Artificial Sequence
  Description of Artificial Sequence: Synthetic peptide
  XENP018535 vlCDR3
QQDYSSPRT

SEQ ID NO: 11389 - protein, 249 aa, Artificial Sequence
  Description of Artificial Sequence: Synthetic polypeptide
  XENP018536 1G6_H1.40_L1_scFv(GKPGS)4
EVQLVESGGGLVKPGGSLRLSCAASGFTFSNYDMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 11390 - protein, 122 aa, Artificial Sequence
  Description of Artificial Sequence: Synthetic polypeptide
  VH of XENP018536
EVQLVESGGGLVKPGGSLRLSCAASGFTFSNYDMNWVRQAPGKGLEWVGEIRLKSNNYATHYAEPVKGRFTISRDDSKSTVYLQMNSLKTEDTAVYYCTRYYGNYGGYFDVWGAGTLVTVSS

SEQ ID NO: 11391 - protein, 107 aa, Artificial Sequence; identical to SEQ ID NO: 10923
  Description of Artificial Sequence: Synthetic polypeptide
  VL of XENP018536

SEQ ID NO: 11392 - protein, 5 aa, Artificial Sequence
  Description of Artificial Sequence: Synthetic peptide
  XENP018536 vhCDR1
NYDMN

SEQ ID NO: 11393 - protein, 19 aa, Artificial Sequence
  Description of Artificial Sequence: Synthetic peptide
  XENP018536 vhCDR2
EIRLKSNNYATHYAEPVKG

SEQ ID NO: 11394 - protein, 11 aa, Artificial Sequence
  Description of Artificial Sequence: Synthetic peptide
  XENP018536 vhCDR3
YYGNYGGYFDV

SEQ ID NO: 11395 - protein, 11 aa, Artificial Sequence
  Description of Artificial Sequence: Synthetic peptide
  XENP018536 vlCDR1
RASQSVSNDVA

SEQ ID NO: 11396 - protein, 7 aa, Artificial Sequence
  Description of Artificial Sequence: Synthetic peptide
  XENP018536 vlCDR2
YASHRYT

SEQ ID NO: 11397 - protein, 9 aa, Artificial Sequence
  Description of Artificial Sequence: Synthetic peptide
  XENP018536 vlCDR3
QQDYSSPRT

SEQ ID NO: 11398 - protein, 249 aa, Artificial Sequence
  Description of Artificial Sequence: Synthetic polypeptide
  XENP018537 1G6_H1.41_L1_scFv(GKPGS)4
EVQLVESGGGLVKPGGSLRLSCAASGFTFSNYWMSWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 11399 - protein, 122 aa, Artificial Sequence
  Description of Artificial Sequence: Synthetic polypeptide
  VH of XENP018537
EVQLVESGGGLVKPGGSLRLSCAASGFTFSNYWMSWVRQAPGKGLEWVGEIRLKSNNYATHYAEPVKGRFTISRDDSKSTVYLQMNSLKTEDTAVYYCTRYYGNYGGYFDVWGAGTLVTVSS

SEQ ID NO: 11400 - protein, 107 aa, Artificial Sequence; identical to SEQ ID NO: 10923
  Description of Artificial Sequence: Synthetic polypeptide
  VL of XENP018537

SEQ ID NO: 11401 - protein, 5 aa, Artificial Sequence
  Description of Artificial Sequence: Synthetic peptide
  XENP018537 vhCDR1
NYWMS

SEQ ID NO: 11402 - protein, 19 aa, Artificial Sequence
  Description of Artificial Sequence: Synthetic peptide
  XENP018537 vhCDR2
EIRLKSNNYATHYAEPVKG

SEQ ID NO: 11403 - protein, 11 aa, Artificial Sequence
  Description of Artificial Sequence: Synthetic peptide
  XENP018537 vhCDR3
YYGNYGGYFDV

SEQ ID NO: 11404 - protein, 11 aa, Artificial Sequence
  Description of Artificial Sequence: Synthetic peptide
  XENP018537 vlCDR1
RASQSVSNDVA

SEQ ID NO: 11405 - protein, 7 aa, Artificial Sequence
  Description of Artificial Sequence: Synthetic peptide
  XENP018537 vlCDR2
YASHRYT

SEQ ID NO: 11406 - protein, 9 aa, Artificial Sequence
  Description of Artificial Sequence: Synthetic peptide
  XENP018537 vlCDR3
QQDYSSPRT

SEQ ID NO: 11407 - protein, 249 aa, Artificial Sequence
  Description of Artificial Sequence: Synthetic polypeptide
  XENP018538 1G6_H1.42_L1_scFv(GKPGS)4
EVQLVESGGGLVKPGGSLRLSCAASGFTFSNYWMHWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 11408 - protein, 122 aa, Artificial Sequence
  Description of Artificial Sequence: Synthetic polypeptide
  VH of XENP018538
EVQLVESGGGLVKPGGSLRLSCAASGFTFSNYWMHWVRQAPGKGLEWVGEIRLKSNNYATHYAEPVKGRFTISRDDSKSTVYLQMNSLKTEDTAVYYCTRYYGNYGGYFDVWGAGTLVTVSS

SEQ ID NO: 11409 - protein, 107 aa, Artificial Sequence; identical to SEQ ID NO: 10923
  Description of Artificial Sequence: Synthetic polypeptide
  VL of XENP018538

SEQ ID NO: 11410 - protein, 5 aa, Artificial Sequence
  Description of Artificial Sequence: Synthetic peptide
  XENP018538 vhCDR1
NYWMH

SEQ ID NO: 11411 - protein, 19 aa, Artificial Sequence
  Description of Artificial Sequence: Synthetic peptide
  XENP018538 vhCDR2
EIRLKSNNYATHYAEPVKG

SEQ ID NO: 11412 - protein, 11 aa, Artificial Sequence
  Description of Artificial Sequence: Synthetic peptide
  XENP018538 vhCDR3
YYGNYGGYFDV

SEQ ID NO: 11413 - protein, 11 aa, Artificial Sequence
  Description of Artificial Sequence: Synthetic peptide
  XENP018538 vlCDR1
RASQSVSNDVA

SEQ ID NO: 11414 - protein, 7 aa, Artificial Sequence
  Description of Artificial Sequence: Synthetic peptide
  XENP018538 vlCDR2
YASHRYT

SEQ ID NO: 11415 - protein, 9 aa, Artificial Sequence
  Description of Artificial Sequence: Synthetic peptide
  XENP018538 vlCDR3
QQDYSSPRT

SEQ ID NO: 11416 - protein, 249 aa, Artificial Sequence
  Description of Artificial Sequence: Synthetic polypeptide
  XENP018539 1G6_H1.43_L1_scFv(GKPGS)4
EVQLVESGGGLVKPGGSLRLSCAASGFTFSNYWMDWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 11417 - protein, 122 aa, Artificial Sequence
  Description of Artificial Sequence: Synthetic polypeptide
  VH of XENP018539
EVQLVESGGGLVKPGGSLRLSCAASGFTFSNYWMDWVRQAPGKGLEWVGEIRLKSNNYATHYAEPVKGRFTISRDDSKSTVYLQMNSLKTEDTAVYYCTRYYGNYGGYFDVWGAGTLVTVSS

SEQ ID NO: 11418 - protein, 107 aa, Artificial Sequence; identical to SEQ ID NO: 10923
  Description of Artificial Sequence: Synthetic polypeptide
  VL of XENP018539

SEQ ID NO: 11419 - protein, 5 aa, Artificial Sequence
  Description of Artificial Sequence: Synthetic peptide
  XENP018539 vhCDR1
NYWMD

SEQ ID NO: 11420 - protein, 19 aa, Artificial Sequence
  Description of Artificial Sequence: Synthetic peptide
  XENP018539 vhCDR2
EIRLKSNNYATHYAEPVKG

SEQ ID NO: 11421 - protein, 11 aa, Artificial Sequence
  Description of Artificial Sequence: Synthetic peptide
  XENP018539 vhCDR3
YYGNYGGYFDV

SEQ ID NO: 11422 - protein, 11 aa, Artificial Sequence
  Description of Artificial Sequence: Synthetic peptide
  XENP018539 vlCDR1
RASQSVSNDVA

SEQ ID NO: 11423 - protein, 7 aa, Artificial Sequence
  Description of Artificial Sequence: Synthetic peptide
  XENP018539 vlCDR2
YASHRYT

SEQ ID NO: 11424 - protein, 9 aa, Artificial Sequence
  Description of Artificial Sequence: Synthetic peptide
  XENP018539 vlCDR3
QQDYSSPRT

SEQ ID NO: 11425 - protein, 249 aa, Artificial Sequence
  Description of Artificial Sequence: Synthetic polypeptide
  XENP018540 1G6_H1.44_L1_scFv(GKPGS)4
EVQLVESGGGLVKPGGSLRLSCAASGFTFSNYWMGWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 11426 - protein, 122 aa, Artificial Sequence
  Description of Artificial Sequence: Synthetic polypeptide
  VH of XENP018540
EVQLVESGGGLVKPGGSLRLSCAASGFTFSNYWMGWVRQAPGKGLEWVGEIRLKSNNYATHYAEPVKGRFTISRDDSKSTVYLQMNSLKTEDTAVYYCTRYYGNYGGYFDVWGAGTLVTVSS

SEQ ID NO: 11427 - protein, 107 aa, Artificial Sequence; identical to SEQ ID NO: 10923
  Description of Artificial Sequence: Synthetic polypeptide
  VL of XENP018540

SEQ ID NO: 11428 - protein, 5 aa, Artificial Sequence
  Description of Artificial Sequence: Synthetic peptide
  XENP018540 vhCDR1
NYWMG

SEQ ID NO: 11429 - protein, 19 aa, Artificial Sequence
  Description of Artificial Sequence: Synthetic peptide
  XENP018540 vhCDR2
EIRLKSNNYATHYAEPVKG

SEQ ID NO: 11430 - protein, 11 aa, Artificial Sequence
  Description of Artificial Sequence: Synthetic peptide
  XENP018540 vhCDR3
YYGNYGGYFDV

SEQ ID NO: 11431 - protein, 11 aa, Artificial Sequence
  Description of Artificial Sequence: Synthetic peptide
  XENP018540 vlCDR1
RASQSVSNDVA

SEQ ID NO: 11432 - protein, 7 aa, Artificial Sequence
  Description of Artificial Sequence: Synthetic peptide
  XENP018540 vlCDR2
YASHRYT

SEQ ID NO: 11433 - protein, 9 aa, Artificial Sequence
  Description of Artificial Sequence: Synthetic peptide
  XENP018540 vlCDR3
QQDYSSPRT

SEQ ID NO: 11434 - protein, 249 aa, Artificial Sequence
  Description of Artificial Sequence: Synthetic polypeptide
  XENP018541 1G6_H1.45_L1_scFv(GKPGS)4
EVQLVESGGGLVKPGGSLRLSCAASGFTFSNYWMNWARQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 11435 - protein, 122 aa, Artificial Sequence
  Description of Artificial Sequence: Synthetic polypeptide
  VH of XENP018541
EVQLVESGGGLVKPGGSLRLSCAASGFTFSNYWMNWARQAPGKGLEWVGEIRLKSNNYATHYAEPVKGRFTISRDDSKSTVYLQMNSLKTEDTAVYYCTRYYGNYGGYFDVWGAGTLVTVSS

SEQ ID NO: 11436 - protein, 107 aa, Artificial Sequence; identical to SEQ ID NO: 10923
  Description of Artificial Sequence: Synthetic polypeptide
  VL of XENP018541

SEQ ID NO: 11437 - protein, 5 aa, Artificial Sequence
  Description of Artificial Sequence: Synthetic peptide
  XENP018541 vhCDR1
NYWMN

SEQ ID NO: 11438 - protein, 19 aa, Artificial Sequence
  Description of Artificial Sequence: Synthetic peptide
  XENP018541 vhCDR2
EIRLKSNNYATHYAEPVKG

SEQ ID NO: 11439 - protein, 11 aa, Artificial Sequence
  Description of Artificial Sequence: Synthetic peptide
  XENP018541 vhCDR3
YYGNYGGYFDV

SEQ ID NO: 11440 - protein, 11 aa, Artificial Sequence
  Description of Artificial Sequence: Synthetic peptide
  XENP018541 vlCDR1
RASQSVSNDVA

SEQ ID NO: 11441 - protein, 7 aa, Artificial Sequence
  Description of Artificial Sequence: Synthetic peptide
  XENP018541 vlCDR2
YASHRYT

SEQ ID NO: 11442 - protein, 9 aa, Artificial Sequence
  Description of Artificial Sequence: Synthetic peptide
  XENP018541 vlCDR3
QQDYSSPRT

SEQ ID NO: 11443 - protein, 249 aa, Artificial Sequence
  Description of Artificial Sequence: Synthetic polypeptide
  XENP018542 1G6_H1.46_L1_scFv(GKPGS)4
EVQLVESGGGLVKPGGSLRLSCAASGFTFSNYWMNWIRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 11444 - protein, 122 aa, Artificial Sequence
  Description of Artificial Sequence: Synthetic polypeptide
  VH of XENP018542
EVQLVESGGGLVKPGGSLRLSCAASGFTFSNYWMNWIRQAPGKGLEWVGEIRLKSNNYATHYAEPVKGRFTISRDDSKSTVYLQMNSLKTEDTAVYYCTRYYGNYGGYFDVWGAGTLVTVSS

SEQ ID NO: 11445 - protein, 107 aa, Artificial Sequence; identical to SEQ ID NO: 10923
  Description of Artificial Sequence: Synthetic polypeptide
  VL of XENP018542

SEQ ID NO: 11446 - protein, 5 aa, Artificial Sequence
  Description of Artificial Sequence: Synthetic peptide
  XENP018542 vhCDR1
NYWMN

SEQ ID NO: 11447 - protein, 19 aa, Artificial Sequence
  Description of Artificial Sequence: Synthetic peptide
  XENP018542 vhCDR2
EIRLKSNNYATHYAEPVKG

SEQ ID NO: 11448 - protein, 11 aa, Artificial Sequence
  Description of Artificial Sequence: Synthetic peptide
  XENP018542 vhCDR3
YYGNYGGYFDV

SEQ ID NO: 11449 - protein, 11 aa, Artificial Sequence
  Description of Artificial Sequence: Synthetic peptide
  XENP018542 vlCDR1
RASQSVSNDVA

SEQ ID NO: 11450 - protein, 7 aa, Artificial Sequence
  Description of Artificial Sequence: Synthetic peptide
  XENP018542 vlCDR2
YASHRYT

SEQ ID NO: 11451 - protein, 9 aa, Artificial Sequence
  Description of Artificial Sequence: Synthetic peptide
  XENP018542 vlCDR3
QQDYSSPRT

SEQ ID NO: 11452 - protein, 249 aa, Artificial Sequence
  Description of Artificial Sequence: Synthetic polypeptide
  XENP018543 1G6_H1.47_L1_scFv(GKPGS)4
EVQLVESGGGLVKPGGSLRLSCAASGFTFSNYWMNWFRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 11453 - protein, 122 aa, Artificial Sequence
  Description of Artificial Sequence: Synthetic polypeptide
  VH of XENP018543
EVQLVESGGGLVKPGGSLRLSCAASGFTFSNYWMNWFRQAPGKGLEWVGEIRLKSNNYATHYAEPVKGRFTISRDDSKSTVYLQMNSLKTEDTAVYYCTRYYGNYGGYFDVWGAGTLVTVSS

SEQ ID NO: 11454 - protein, 107 aa, Artificial Sequence; identical to SEQ ID NO: 10923
  Description of Artificial Sequence: Synthetic polypeptide
  VL of XENP018543

SEQ ID NO: 11455 - protein, 5 aa, Artificial Sequence
  Description of Artificial Sequence: Synthetic peptide
  XENP018543 vhCDR1
NYWMN

SEQ ID NO: 11456 - protein, 19 aa, Artificial Sequence
  Description of Artificial Sequence: Synthetic peptide
  XENP018543 vhCDR2
EIRLKSNNYATHYAEPVKG

SEQ ID NO: 11457 - protein, 11 aa, Artificial Sequence
  Description of Artificial Sequence: Synthetic peptide
  XENP018543 vhCDR3
YYGNYGGYFDV

SEQ ID NO: 11458 - protein, 11 aa, Artificial Sequence
  Description of Artificial Sequence: Synthetic peptide
  XENP018543 vlCDR1
RASQSVSNDVA

SEQ ID NO: 11459 - protein, 7 aa, Artificial Sequence
  Description of Artificial Sequence: Synthetic peptide
  XENP018543 vlCDR2
YASHRYT

SEQ ID NO: 11460 - protein, 9 aa, Artificial Sequence
  Description of Artificial Sequence: Synthetic peptide
  XENP018543 vlCDR3
QQDYSSPRT

SEQ ID NO: 11461 - protein, 249 aa, Artificial Sequence
  Description of Artificial Sequence: Synthetic polypeptide
  XENP018544 1G6_H1.48_L1_scFv(GKPGS)4
EVQLVESGGGLVKPGGSLRLSCAASGFTFSNYWMNWVRKAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 11462 - protein, 122 aa, Artificial Sequence
  Description of Artificial Sequence: Synthetic polypeptide
  VH of XENP018544
EVQLVESGGGLVKPGGSLRLSCAASGFTFSNYWMNWVRKAPGKGLEWVGEIRLKSNNYATHYAEPVKGRFTISRDDSKSTVYLQMNSLKTEDTAVYYCTRYYGNYGGYFDVWGAGTLVTVSS

SEQ ID NO: 11463 - protein, 107 aa, Artificial Sequence; identical to SEQ ID NO: 10923
  Description of Artificial Sequence: Synthetic polypeptide
  VL of XENP018544

SEQ ID NO: 11464 - protein, 11 aa, Artificial Sequence
  Description of Artificial Sequence: Synthetic peptide
  XENP018544 vlCDR1
RASQSVSNDVA

SEQ ID NO: 11465 - protein, 7 aa, Artificial Sequence
  Description of Artificial Sequence: Synthetic peptide
  XENP018544 vlCDR2
YASHRYT

SEQ ID NO: 11466 - protein, 9 aa, Artificial Sequence
  Description of Artificial Sequence: Synthetic peptide
  XENP018544 vlCDR3
QQDYSSPRT

SEQ ID NO: 11467 - protein, 249 aa, Artificial Sequence
  Description of Artificial Sequence: Synthetic polypeptide
  XENP018545 1G6_H1.49_L1_scFv(GKPGS)4
EVQLVESGGGLVKPGGSLRLSCAASGFTFSNYWMNWVRQSPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 11468 - protein, 122 aa, Artificial Sequence
  Description of Artificial Sequence: Synthetic polypeptide
  VH of XENP018545
EVQLVESGGGLVKPGGSLRLSCAASGFTFSNYWMNWVRQSPGKGLEWVGEIRLKSNNYATHYAEPVKGRFTISRDDSKSTVYLQMNSLKTEDTAVYYCTRYYGNYGGYFDVWGAGTLVTVSS

SEQ ID NO: 11469 - protein, 107 aa, Artificial Sequence; identical to SEQ ID NO: 10923
  Description of Artificial Sequence: Synthetic polypeptide
  VL of XENP018545

SEQ ID NO: 11470 - protein, 5 aa, Artificial Sequence
  Description of Artificial Sequence: Synthetic peptide
  XENP018545 vhCDR1
NYWMN

SEQ ID NO: 11471 - protein, 19 aa, Artificial Sequence
  Description of Artificial Sequence: Synthetic peptide
  XENP018545 vhCDR2
EIRLKSNNYATHYAEPVKG

SEQ ID NO: 11472 - protein, 11 aa, Artificial Sequence
  Description of Artificial Sequence: Synthetic peptide
  XENP018545 vhCDR3
YYGNYGGYFDV

SEQ ID NO: 11473 - protein, 11 aa, Artificial Sequence
  Description of Artificial Sequence: Synthetic peptide
  XENP018545 vlCDR1
RASQSVSNDVA

SEQ ID NO: 11474 - protein, 7 aa, Artificial Sequence
  Description of Artificial Sequence: Synthetic peptide
  XENP018545 vlCDR2
YASHRYT

SEQ ID NO: 11475 - protein, 9 aa, Artificial Sequence
  Description of Artificial Sequence: Synthetic peptide
  XENP018545 vlCDR3
QQDYSSPRT

SEQ ID NO: 11476 - protein, 249 aa, Artificial Sequence
  Description of Artificial Sequence: Synthetic polypeptide
  XENP018546 1G6_H1.50_L1_scFv(GKPGS)4
EVQLVESGGGLVKPGGSLRLSCAASGFTFSNYWMNWVRQAPEKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 11477 - protein, 122 aa, Artificial Sequence
  Description of Artificial Sequence: Synthetic polypeptide
  VH of XENP018546
EVQLVESGGGLVKPGGSLRLSCAASGFTFSNYWMNWVRQAPEKGLEWVGEIRLKSNNYATHYAEPVKGRFTISRDDSKSTVYLQMNSLKTEDTAVYYCTRYYGNYGGYFDVWGAGTLVTVSS

SEQ ID NO: 11478 - protein, 107 aa, Artificial Sequence; identical to SEQ ID NO: 10923
  Description of Artificial Sequence: Synthetic polypeptide
  VL of XENP018546

SEQ ID NO: 11479 - protein, 5 aa, Artificial Sequence
  Description of Artificial Sequence: Synthetic peptide
  XENP018546 vhCDR1
NYWMN

SEQ ID NO: 11480 - protein, 19 aa, Artificial Sequence
  Description of Artificial Sequence: Synthetic peptide
  XENP018546 vhCDR2
EIRLKSNNYATHYAEPVKG

SEQ ID NO: 11481 - protein, 11 aa, Artificial Sequence
  Description of Artificial Sequence: Synthetic peptide
  XENP018546 vhCDR3
YYGNYGGYFDV

SEQ ID NO: 11482 - protein, 11 aa, Artificial Sequence
  Description of Artificial Sequence: Synthetic peptide
  XENP018546 vlCDR1
RASQSVSNDVA

SEQ ID NO: 11483 - protein, 7 aa, Artificial Sequence
  Description of Artificial Sequence: Synthetic peptide
  XENP018546 vlCDR2
YASHRYT

SEQ ID NO: 11484 - protein, 9 aa, Artificial Sequence
  Description of Artificial Sequence: Synthetic peptide
  XENP018546 vlCDR3
QQDYSSPRT

SEQ ID NO: 11485 - protein, 249 aa, Artificial Sequence
  Description of Artificial Sequence: Synthetic polypeptide
  XENP018547 1G6_H1.51_L1_scFv(GKPGS)4
EVQLVESGGGLVKPGGSLRLSCAASGFTFSNYWMNWVRQAPGKGLEYVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 11486 - protein, 122 aa, Artificial Sequence
  Description of Artificial Sequence: Synthetic polypeptide
  VH of XENP018547
EVQLVESGGGLVKPGGSLRLSCAASGFTFSNYWMNWVRQAPGKGLEYVGEIRLKSNNYATHYAEPVKGRFTISRDDSKSTVYLQMNSLKTEDTAVYYCTRYYGNYGGYFDVWGAGTLVTVSS

SEQ ID NO: 11487 - protein, 107 aa, Artificial Sequence; identical to SEQ ID NO: 10923
  Description of Artificial Sequence: Synthetic polypeptide
  VL of XENP018547

SEQ ID NO: 11488 - protein, 5 aa, Artificial Sequence
  Description of Artificial Sequence: Synthetic peptide
  XENP018547 vhCDR1
NYWMN

SEQ ID NO: 11489 - protein, 19 aa, Artificial Sequence
  Description of Artificial Sequence: Synthetic peptide
  XENP018547 vhCDR2
EIRLKSNNYATHYAEPVKG

SEQ ID NO: 11490 - protein, 11 aa, Artificial Sequence
  Description of Artificial Sequence: Synthetic peptide
  XENP018547 vhCDR3
YYGNYGGYFDV

SEQ ID NO: 11491 - protein, 11 aa, Artificial Sequence
  Description of Artificial Sequence: Synthetic peptide
  XENP018547 vlCDR1
RASQSVSNDVA

SEQ ID NO: 11492 - protein, 7 aa, Artificial Sequence
  Description of Artificial Sequence: Synthetic peptide
  XENP018547 vlCDR2
YASHRYT

SEQ ID NO: 11493 - protein, 9 aa, Artificial Sequence
  Description of Artificial Sequence: Synthetic peptide
  XENP018547 vlCDR3
QQDYSSPRT

SEQ ID NO: 11494 - protein, 249 aa, Artificial Sequence
  Description of Artificial Sequence: Synthetic polypeptide
  XENP018548 1G6_H1.52_L1_scFv(GKPGS)4
EVQLVESGGGLVKPGGSLRLSCAASGFTFSNYWMNWVRQAPGKGLEWVAEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 11495 - protein, 122 aa, Artificial Sequence
  Description of Artificial Sequence: Synthetic polypeptide
  VH of XENP018548
EVQLVESGGGLVKPGGSLRLSCAASGFTFSNYWMNWVRQAPGKGLEWVAEIRLKSNNYATHYAEPVKGRFTISRDDSKSTVYLQMNSLKTEDTAVYYCTRYYGNYGGYFDVWGAGTLVTVSS

SEQ ID NO: 11496 - protein, 107 aa, Artificial Sequence; identical to SEQ ID NO: 10923
  Description of Artificial Sequence: Synthetic polypeptide
  VL of XENP018548

SEQ ID NO: 11497 - protein, 5 aa, Artificial Sequence
  Description of Artificial Sequence: Synthetic peptide
  XENP018548 vhCDR1
NYWMN

SEQ ID NO: 11498 - protein, 19 aa, Artificial Sequence
  Description of Artificial Sequence: Synthetic peptide
  XENP018548 vhCDR2
EIRLKSNNYATHYAEPVKG

SEQ ID NO: 11499 - protein, 11 aa, Artificial Sequence
  Description of Artificial Sequence: Synthetic peptide
  XENP018548 vhCDR3
YYGNYGGYFDV

SEQ ID NO: 11500 - protein, 11 aa, Artificial Sequence
  Description of Artificial Sequence: Synthetic peptide
  XENP018548 vlCDR1
RASQSVSNDVA

SEQ ID NO: 11501 - protein, 7 aa, Artificial Sequence
  Description of Artificial Sequence: Synthetic peptide
  XENP018548 vlCDR2
YASHRYT

SEQ ID NO: 11502 - protein, 9 aa, Artificial Sequence
  Description of Artificial Sequence: Synthetic peptide
  XENP018548 vlCDR3
QQDYSSPRT

SEQ ID NO: 11503 - protein, 249 aa, Artificial Sequence
  Description of Artificial Sequence: Synthetic polypeptide
  XENP018549 1G6_H1.53_L1_scFv(GKPGS)4
EVQLVESGGGLVKPGGSLRLSCAASGFTFSNYWMNWVRQAPGKGLEWVSEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 11504 - protein, 122 aa, Artificial Sequence
  Description of Artificial Sequence: Synthetic polypeptide
  VH of XENP018549
EVQLVESGGGLVKPGGSLRLSCAASGFTFSNYWMNWVRQAPGKGLEWVSEIRLKSNNYATHYAEPVKGRFTISRDDSKSTVYLQMNSLKTEDTAVYYCTRYYGNYGGYFDVWGAGTLVTVSS

SEQ ID NO: 11505 - protein, 107 aa, Artificial Sequence; identical to SEQ ID NO: 10923
  Description of Artificial Sequence: Synthetic polypeptide
  VL of XENP018549

SEQ ID NO: 11506 - protein, 5 aa, Artificial Sequence
  Description of Artificial Sequence: Synthetic peptide
  XENP018549 vhCDR1
NYWMN

SEQ ID NO: 11507 - protein, 19 aa, Artificial Sequence
  Description of Artificial Sequence: Synthetic peptide
  XENP018549 vhCDR2
EIRLKSNNYATHYAEPVKG

SEQ ID NO: 11508 - protein, 11 aa, Artificial Sequence
  Description of Artificial Sequence: Synthetic peptide
  XENP018549 vhCDR3
YYGNYGGYFDV

SEQ ID NO: 11509 - protein, 11 aa, Artificial Sequence
  Description of Artificial Sequence: Synthetic peptide
  XENP018549 vlCDR1
RASQSVSNDVA

SEQ ID NO: 11510 - protein, 7 aa, Artificial Sequence
  Description of Artificial Sequence: Synthetic peptide
  XENP018549 vlCDR2
YASHRYT

SEQ ID NO: 11511 - protein, 9 aa, Artificial Sequence
  Description of Artificial Sequence: Synthetic peptide
  XENP018549 vlCDR3
QQDYSSPRT

SEQ ID NO: 11512 - protein, 249 aa, Artificial Sequence
  Description of Artificial Sequence: Synthetic polypeptide
  XENP018550 1G6_H1.54_L1_scFv(GKPGS)4
EVQLVESGGGLVKPGGSLRLSCAASGFTFSNYWMNWVRQAPGKGLEWVGQIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 11513 - protein, 122 aa, Artificial Sequence
  Description of Artificial Sequence: Synthetic polypeptide
  VH of XENP018550
EVQLVESGGGLVKPGGSLRLSCAASGFTFSNYWMNWVRQAPGKGLEWVGQIRLKSNNYATHYAEPVKGRFTISRDDSKSTVYLQMNSLKTEDTAVYYCTRYYGNYGGYFDVWGAGTLVTVSS

SEQ ID NO: 11514 - protein, 107 aa, Artificial Sequence; identical to SEQ ID NO: 10923
  Description of Artificial Sequence: Synthetic polypeptide
  VL of XENP018550

SEQ ID NO: 11515 - protein, 5 aa, Artificial Sequence
  Description of Artificial Sequence: Synthetic peptide
  XENP018550 vhCDR1
NYWMN

SEQ ID NO: 11516 - protein, 19 aa, Artificial Sequence
  Description of Artificial Sequence: Synthetic peptide
  XENP018550 vhCDR2
QIRLKSNNYATHYAEPVKG

SEQ ID NO: 11517 - protein, 11 aa, Artificial Sequence
  Description of Artificial Sequence: Synthetic peptide
  XENP018550 vhCDR3
YYGNYGGYFDV

SEQ ID NO: 11518 - protein, 11 aa, Artificial Sequence
  Description of Artificial Sequence: Synthetic peptide
  XENP018550 vlCDR1
RASQSVSNDVA

SEQ ID NO: 11519 - protein, 7 aa, Artificial Sequence
  Description of Artificial Sequence: Synthetic peptide
  XENP018550 vlCDR2
YASHRYT

SEQ ID NO: 11520 - protein, 9 aa, Artificial Sequence
  Description of Artificial Sequence: Synthetic peptide
  XENP018550 vlCDR3
QQDYSSPRT

SEQ ID NO: 11521 - protein, 249 aa, Artificial Sequence
  Description of Artificial Sequence: Synthetic polypeptide
  XENP018551 1G6_H1.55_L1_scFv(GKPGS)4
EVQLVESGGGLVKPGGSLRLSCAASGFTFSNYWMNWVRQAPGKGLEWVGDIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 11522 - protein, 122 aa, Artificial Sequence
  Description of Artificial Sequence: Synthetic polypeptide
  VH of XENP018551
EVQLVESGGGLVKPGGSLRLSCAASGFTFSNYWMNWVRQAPGKGLEWVGDIRLKSNNYATHYAEPVKGRFTISRDDSKSTVYLQMNSLKTEDTAVYYCTRYYGNYGGYFDVWGAGTLVTVSS

SEQ ID NO: 11523 - protein, 107 aa, Artificial Sequence; identical to SEQ ID NO: 10923
  Description of Artificial Sequence: Synthetic polypeptide
  VL of XENP018551

SEQ ID NO: 11524 - protein, 5 aa, Artificial Sequence
  Description of Artificial Sequence: Synthetic peptide
  XENP018551 vhCDR1
NYWMN

SEQ ID NO: 11525 - protein, 19 aa, Artificial Sequence
  Description of Artificial Sequence: Synthetic peptide
  XENP018551 vhCDR2
DIRLKSNNYATHYAEPVKG

SEQ ID NO: 11526 - protein, 11 aa, Artificial Sequence
  Description of Artificial Sequence: Synthetic peptide
  XENP018551 vhCDR3
YYGNYGGYFDV

SEQ ID NO: 11527 - protein, 11 aa, Artificial Sequence
  Description of Artificial Sequence: Synthetic peptide
  XENP018551 vlCDR1
RASQSVSNDVA

SEQ ID NO: 11528 - protein, 7 aa, Artificial Sequence
  Description of Artificial Sequence: Synthetic peptide
  XENP018551 vlCDR2
YASHRYT

SEQ ID NO: 11529 - protein, 9 aa, Artificial Sequence
  Description of Artificial Sequence: Synthetic peptide
  XENP018551 vlCDR3
QQDYSSPRT

SEQ ID NO: 11530 - protein, 249 aa, Artificial Sequence
  Description of Artificial Sequence: Synthetic polypeptide
  XENP018552 1G6_H1.56_L1_scFv(GKPGS)4
EVQLVESGGGLVKPGGSLRLSCAASGFTFSNYWMNWVRQAPGKGLEWVGKIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 11531 - protein, 122 aa, Artificial Sequence
  Description of Artificial Sequence: Synthetic polypeptide
  VH of XENP018552
EVQLVESGGGLVKPGGSLRLSCAASGFTFSNYWMNWVRQAPGKGLEWVGKIRLKSNNYATHYAEPVKGRFTISRDDSKSTVYLQMNSLKTEDTAVYYCTRYYGNYGGYFDVWGAGTLVTVSS

SEQ ID NO: 11532 - protein, 107 aa, Artificial Sequence; identical to SEQ ID NO: 10923
  Description of Artificial Sequence: Synthetic polypeptide
  VL of XENP018552

SEQ ID NO: 11533 - protein, 5 aa, Artificial Sequence
  Description of Artificial Sequence: Synthetic peptide
  XENP018552 vhCDR1
NYWMN

SEQ ID NO: 11534 - protein, 19 aa, Artificial Sequence
  Description of Artificial Sequence: Synthetic peptide
  XENP018552 vhCDR2
KIRLKSNNYATHYAEPVKG

SEQ ID NO: 11535 - protein, 11 aa, Artificial Sequence
  Description of Artificial Sequence: Synthetic peptide
  XENP018552 vhCDR3
YYGNYGGYFDV

SEQ ID NO: 11536 - protein, 11 aa, Artificial Sequence
  Description of Artificial Sequence: Synthetic peptide
  XENP018552 vlCDR1
RASQSVSNDVA

SEQ ID NO: 11537 - protein, 7 aa, Artificial Sequence
  Description of Artificial Sequence: Synthetic peptide
  XENP018552 vlCDR2
YASHRYT

SEQ ID NO: 11538 - protein, 9 aa, Artificial Sequence
  Description of Artificial Sequence: Synthetic peptide
  XENP018552 vlCDR3
QQDYSSPRT

SEQ ID NO: 11539 - protein, 249 aa, Artificial Sequence
  Description of Artificial Sequence: Synthetic polypeptide
  XENP018553 1G6_H1.57_L1_scFv(GKPGS)4
EVQLVESGGGLVKPGGSLRLSCAASGFTFSNYWMNWVRQAPGKGLEWVGSIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 11540 - protein, 122 aa, Artificial Sequence
  Description of Artificial Sequence: Synthetic polypeptide
  VH of XENP018553
EVQLVESGGGLVKPGGSLRLSCAASGFTFSNYWMNWVRQAPGKGLEWVGSIRLKSNNYATHYAEPVKGRFTISRDDSKSTVYLQMNSLKTEDTAVYYCTRYYGNYGGYFDVWGAGTLVTVSS

SEQ ID NO: 11541 - protein, 107 aa, Artificial Sequence; identical to SEQ ID NO: 10923
  Description of Artificial Sequence: Synthetic polypeptide
  VL of XENP018553

SEQ ID NO: 11542 - protein, 5 aa, Artificial Sequence
  Description of Artificial Sequence: Synthetic peptide
  XENP018553 vhCDR1
NYWMN

SEQ ID NO: 11543 - protein, 19 aa, Artificial Sequence
  Description of Artificial Sequence: Synthetic peptide
  XENP018553 vhCDR2
SIRLKSNNYATHYAEPVKG

SEQ ID NO: 11544 - protein, 11 aa, Artificial Sequence
  Description of Artificial Sequence: Synthetic peptide
  XENP018553 vhCDR3
YYGNYGGYFDV

SEQ ID NO: 11545 - protein, 11 aa, Artificial Sequence
  Description of Artificial Sequence: Synthetic peptide
  XENP018553 vlCDR1
RASQSVSNDVA

SEQ ID NO: 11546 - protein, 7 aa, Artificial Sequence
  Description of Artificial Sequence: Synthetic peptide
  XENP018553 vlCDR2
YASHRYT

SEQ ID NO: 11547 - protein, 9 aa, Artificial Sequence
  Description of Artificial Sequence: Synthetic peptide
  XENP018553 vlCDR3
QQDYSSPRT

SEQ ID NO: 11548 - protein, 249 aa, Artificial Sequence
  Description of Artificial Sequence: Synthetic polypeptide
  XENP018554 1G6_H1.58_L1_scFv(GKPGS)4
EVQLVESGGGLVKPGGSLRLSCAASGFTFSNYWMNWVRQAPGKGLEWVGHIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 11549 - protein, 122 aa, Artificial Sequence
  Description of Artificial Sequence: Synthetic polypeptide
  VH of XENP018554
EVQLVESGGGLVKPGGSLRLSCAASGFTFSNYWMNWVRQAPGKGLEWVGHIRLKSNNYATHYAEPVKGRFTISRDDSKSTVYLQMNSLKTEDTAVYYCTRYYGNYGGYFDVWGAGTLVTVSS

SEQ ID NO: 11550 - protein, 107 aa, Artificial Sequence; identical to SEQ ID NO: 10923
  Description of Artificial Sequence: Synthetic polypeptide
  VL of XENP018554

SEQ ID NO: 11551 - protein, 5 aa, Artificial Sequence
  Description of Artificial Sequence: Synthetic peptide
  XENP018554 vhCDR1
NYWMN

SEQ ID NO: 11552 - protein, 19 aa, Artificial Sequence
  Description of Artificial Sequence: Synthetic peptide
  XENP018554 vhCDR2
HIRLKSNNYATHYAEPVKG

SEQ ID NO: 11553 - protein, 11 aa, Artificial Sequence
  Description of Artificial Sequence: Synthetic peptide
  XENP018554 vhCDR3
YYGNYGGYFDV

SEQ ID NO: 11554 - protein, 11 aa, Artificial Sequence
  Description of Artificial Sequence: Synthetic peptide
  XENP018554 vlCDR1
RASQSVSNDVA

SEQ ID NO: 11555 - protein, 7 aa, Artificial Sequence
  Description of Artificial Sequence: Synthetic peptide
  XENP018554 vlCDR2
YASHRYT

SEQ ID NO: 11556 - protein, 9 aa, Artificial Sequence
  Description of Artificial Sequence: Synthetic peptide
  XENP018554 vlCDR3
QQDYSSPRT

SEQ ID NO: 11557 - protein, 249 aa, Artificial Sequence
  Description of Artificial Sequence: Synthetic polypeptide
  XENP018555 1G6_H1.59_L1_scFv(GKPGS)4
EVQLVESGGGLVKPGGSLRLSCAASGFTFSNYWMNWVRQAPGKGLEWVGAIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 11558 - protein, 122 aa, Artificial Sequence
  Description of Artificial Sequence: Synthetic polypeptide
  VH of XENP018555
EVQLVESGGGLVKPGGSLRLSCAASGFTFSNYWMNWVRQAPGKGLEWVGAIRLKSNNYATHYAEPVKGRFTISRDDSKSTVYLQMNSLKTEDTAVYYCTRYYGNYGGYFDVWGAGTLVTVSS

SEQ ID NO: 11559 - protein, 107 aa, Artificial Sequence; identical to SEQ ID NO: 10923
  Description of Artificial Sequence: Synthetic polypeptide
  VL of XENP018555

SEQ ID NO: 11560 - protein, 5 aa, Artificial Sequence
  Description of Artificial Sequence: Synthetic peptide
  XENP018555 vhCDR1
NYWMN

SEQ ID NO: 11561 - protein, 19 aa, Artificial Sequence
  Description of Artificial Sequence: Synthetic peptide
  XENP018555 vhCDR2
AIRLKSNNYATHYAEPVKG

SEQ ID NO: 11562 - protein, 11 aa, Artificial Sequence
  Description of Artificial Sequence: Synthetic peptide
  XENP018555 vhCDR3
YYGNYGGYFDV

SEQ ID NO: 11563 - protein, 11 aa, Artificial Sequence
  Description of Artificial Sequence: Synthetic peptide
  XENP018555 vlCDR1
RASQSVSNDVA

SEQ ID NO: 11564 - protein, 7 aa, Artificial Sequence
  Description of Artificial Sequence: Synthetic peptide
  XENP018555 vlCDR2
YASHRYT

SEQ ID NO: 11565 - protein, 9 aa, Artificial Sequence
  Description of Artificial Sequence: Synthetic peptide
  XENP018555 vlCDR3
QQDYSSPRT

SEQ ID NO: 11566 - protein, 249 aa, Artificial Sequence
  Description of Artificial Sequence: Synthetic polypeptide
  XENP018556 1G6_H1.60_L1_scFv(GKPGS)4
EVQLVESGGGLVKPGGSLRLSCAASGFTFSNYWMNWVRQAPGKGLEWVGGIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 11567 - protein, 122 aa, Artificial Sequence
  Description of Artificial Sequence: Synthetic polypeptide
  VH of XENP018556
EVQLVESGGGLVKPGGSLRLSCAASGFTFSNYWMNWVRQAPGKGLEWVGGIRLKSNNYATHYAEPVKGRFTISRDDSKSTVYLQMNSLKTEDTAVYYCTRYYGNYGGYFDVWGAGTLVTVSS

SEQ ID NO: 11568 - protein, 107 aa, Artificial Sequence; identical to SEQ ID NO: 10923
  Description of Artificial Sequence: Synthetic polypeptide
  VL of XENP018556

SEQ ID NO: 11569 - protein, 5 aa, Artificial Sequence
  Description of Artificial Sequence: Synthetic peptide
  XENP018556 vhCDR1
NYWMN

SEQ ID NO: 11570 - protein, 19 aa, Artificial Sequence
  Description of Artificial Sequence: Synthetic peptide
  XENP018556 vhCDR2
GIRLKSNNYATHYAEPVKG

SEQ ID NO: 11571 - protein, 11 aa, Artificial Sequence
  Description of Artificial Sequence: Synthetic peptide
  XENP018556 vhCDR3
YYGNYGGYFDV

SEQ ID NO: 11572 - protein, 11 aa, Artificial Sequence
  Description of Artificial Sequence: Synthetic peptide
  XENP018556 vlCDR1
RASQSVSNDVA

SEQ ID NO: 11573 - protein, 7 aa, Artificial Sequence
  Description of Artificial Sequence: Synthetic peptide
  XENP018556 vlCDR2
YASHRYT

SEQ ID NO: 11574 - protein, 9 aa, Artificial Sequence
  Description of Artificial Sequence: Synthetic peptide
  XENP018556 vlCDR3
QQDYSSPRT

SEQ ID NO: 11575 - protein, 249 aa, Artificial Sequence
  Description of Artificial Sequence: Synthetic polypeptide
  XENP018557 1G6_H1.61_L1_scFv(GKPGS)4
EVQLVESGGGLVKPGGSLRLSCAASGFTFSNYWMNWVRQAPGKGLEWVGYIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 11576 - protein, 122 aa, Artificial Sequence
  Description of Artificial Sequence: Synthetic polypeptide
  VH of XENP018557
EVQLVESGGGLVKPGGSLRLSCAASGFTFSNYWMNWVRQAPGKGLEWVGYIRLKSNNYATHYAEPVKGRFTISRDDSKSTVYLQMNSLKTEDTAVYYCTRYYGNYGGYFDVWGAGTLVTVSS

SEQ ID NO: 11577 - protein, 107 aa, Artificial Sequence; identical to SEQ ID NO: 10923
  Description of Artificial Sequence: Synthetic polypeptide
  VL of XENP018557

SEQ ID NO: 11578 - protein, 5 aa, Artificial Sequence
  Description of Artificial Sequence: Synthetic peptide
  XENP018557 vhCDR1
NYWMN

SEQ ID NO: 11579 - protein, 19 aa, Artificial Sequence
  Description of Artificial Sequence: Synthetic peptide
  XENP018557 vhCDR2
YIRLKSNNYATHYAEPVKG

SEQ ID NO: 11580 - protein, 11 aa, Artificial Sequence
  Description of Artificial Sequence: Synthetic peptide
  XENP018557 vhCDR3
YYGNYGGYFDV

SEQ ID NO: 11581 - protein, 11 aa, Artificial Sequence
  Description of Artificial Sequence: Synthetic peptide
  XENP018557 vlCDR1
RASQSVSNDVA

SEQ ID NO: 11582 - protein, 7 aa, Artificial Sequence
  Description of Artificial Sequence: Synthetic peptide
  XENP018557 vlCDR2
YASHRYT

SEQ ID NO: 11583 - protein, 9 aa, Artificial Sequence
  Description of Artificial Sequence: Synthetic peptide
  XENP018557 vlCDR3
QQDYSSPRT

SEQ ID NO: 11584 - protein, 249 aa, Artificial Sequence
  Description of Artificial Sequence: Synthetic polypeptide
  XENP018558 1G6_H1.62_L1_scFv(GKPGS)4
EVQLVESGGGLVKPGGSLRLSCAASGFTFSNYWMNWVRQAPGKGLEWVGIIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 11585 - protein, 122 aa, Artificial Sequence
  Description of Artificial Sequence: Synthetic polypeptide
  VH of XENP018558
EVQLVESGGGLVKPGGSLRLSCAASGFTFSNYWMNWVRQAPGKGLEWVGIIRLKSNNYATHYAEPVKGRFTISRDDSKSTVYLQMNSLKTEDTAVYYCTRYYGNYGGYFDVWGAGTLVTVSS

SEQ ID NO: 11586 - protein, 107 aa, Artificial Sequence; identical to SEQ ID NO: 10923
  Description of Artificial Sequence: Synthetic polypeptide
  VL of XENP018558

SEQ ID NO: 11587 - protein, 5 aa, Artificial Sequence
  Description of Artificial Sequence: Synthetic peptide
  XENP018558 vhCDR1
NYWMN

SEQ ID NO: 11588 - protein, 19 aa, Artificial Sequence
  Description of Artificial Sequence: Synthetic peptide
  XENP018558 vhCDR2
IIRLKSNNYATHYAEPVKG

SEQ ID NO: 11589 - protein, 11 aa, Artificial Sequence
  Description of Artificial Sequence: Synthetic peptide
  XENP018558 vhCDR3
YYGNYGGYFDV

SEQ ID NO: 11590 - protein, 11 aa, Artificial Sequence
  Description of Artificial Sequence: Synthetic peptide
  XENP018558 vlCDR1
RASQSVSNDVA

SEQ ID NO: 11591 - protein, 7 aa, Artificial Sequence
  Description of Artificial Sequence: Synthetic peptide
  XENP018558 vlCDR2
YASHRYT

SEQ ID NO: 11592 - protein, 9 aa, Artificial Sequence
  Description of Artificial Sequence: Synthetic peptide
  XENP018558 vlCDR3
QQDYSSPRT

SEQ ID NO: 11593 - protein, 249 aa, Artificial Sequence
  Description of Artificial Sequence: Synthetic polypeptide
  XENP018559 1G6_H1.63_L1_scFv(GKPGS)4
EVQLVESGGGLVKPGGSLRLSCAASGFTFSNYWMNWVRQAPGKGLEWVGEVRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 11594 - protein, 122 aa, Artificial Sequence
  Description of Artificial Sequence: Synthetic polypeptide
  VH of XENP018559
EVQLVESGGGLVKPGGSLRLSCAASGFTFSNYWMNWVRQAPGKGLEWVGEVRLKSNNYATHYAEPVKGRFTISRDDSKSTVYLQMNSLKTEDTAVYYCTRYYGNYGGYFDVWGAGTLVTVSS

SEQ ID NO: 11595 - protein, 107 aa, Artificial Sequence; identical to SEQ ID NO: 10923
  Description of Artificial Sequence: Synthetic polypeptide
  VL of XENP018559

SEQ ID NO: 11596 - protein, 5 aa, Artificial Sequence
  Description of Artificial Sequence: Synthetic peptide
  XENP018559 vhCDR1
NYWMN

SEQ ID NO: 11597 - protein, 19 aa, Artificial Sequence
  Description of Artificial Sequence: Synthetic peptide
  XENP018559 vhCDR2
EVRLKSNNYATHYAEPVKG

SEQ ID NO: 11598 - protein, 11 aa, Artificial Sequence
  Description of Artificial Sequence: Synthetic peptide
  XENP018559 vhCDR3
YYGNYGGYFDV

SEQ ID NO: 11599 - protein, 11 aa, Artificial Sequence
  Description of Artificial Sequence: Synthetic peptide
  XENP018559 vlCDR1
RASQSVSNDVA

SEQ ID NO: 11600 - protein, 7 aa, Artificial Sequence
  Description of Artificial Sequence: Synthetic peptide
  XENP018559 vlCDR2
YASHRYT

SEQ ID NO: 11601 - protein, 9 aa, Artificial Sequence
  Description of Artificial Sequence: Synthetic peptide
  XENP018559 vlCDR3
QQDYSSPRT

SEQ ID NO: 11602 - protein, 249 aa, Artificial Sequence
  Description of Artificial Sequence: Synthetic polypeptide
  XENP018560 1G6_H1.64_L1_scFv(GKPGS)4
EVQLVESGGGLVKPGGSLRLSCAASGFTFSNYWMNWVRQAPGKGLEWVGEITLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 11603 - protein, 122 aa, Artificial Sequence
  Description of Artificial Sequence: Synthetic polypeptide
  VH of XENP018560
EVQLVESGGGLVKPGGSLRLSCAASGFTFSNYWMNWVRQAPGKGLEWVGEITLKSNNYATHYAEPVKGRFTISRDDSKSTVYLQMNSLKTEDTAVYYCTRYYGNYGGYFDVWGAGTLVTVSS

SEQ ID NO: 11604 - protein, 107 aa, Artificial Sequence; identical to SEQ ID NO: 10923
  Description of Artificial Sequence: Synthetic polypeptide
  VL of XENP018560

SEQ ID NO: 11605 - protein, 5 aa, Artificial Sequence
  Description of Artificial Sequence: Synthetic peptide
  XENP018560 vhCDR1
NYWMN

SEQ ID NO: 11606 - protein, 19 aa, Artificial Sequence
  Description of Artificial Sequence: Synthetic peptide
  XENP018560 vhCDR2
EITLKSNNYATHYAEPVKG

SEQ ID NO: 11607 - protein, 11 aa, Artificial Sequence
  Description of Artificial Sequence: Synthetic peptide
  XENP018560 vhCDR3
YYGNYGGYFDV

SEQ ID NO: 11608 - protein, 11 aa, Artificial Sequence
  Description of Artificial Sequence: Synthetic peptide
  XENP018560 vlCDR1
RASQSVSNDVA

SEQ ID NO: 11609 - protein, 7 aa, Artificial Sequence
  Description of Artificial Sequence: Synthetic peptide
  XENP018560 vlCDR2
YASHRYT

SEQ ID NO: 11610 - protein, 9 aa, Artificial Sequence
  Description of Artificial Sequence: Synthetic peptide
  XENP018560 vlCDR3
QQDYSSPRT

SEQ ID NO: 11611 - protein, 249 aa, Artificial Sequence
  Description of Artificial Sequence: Synthetic polypeptide
  XENP018561 1G6_H1.65_L1_scFv(GKPGS)4
EVQLVESGGGLVKPGGSLRLSCAASGFTFSNYWMNWVRQAPGKGLEWVGEIKLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 11612 - protein, 122 aa, Artificial Sequence
  Description of Artificial Sequence: Synthetic polypeptide
  VH of XENP018561
EVQLVESGGGLVKPGGSLRLSCAASGFTFSNYWMNWVRQAPGKGLEWVGEIKLKSNNYATHYAEPVKGRFTISRDDSKSTVYLQMNSLKTEDTAVYYCTRYYGNYGGYFDVWGAGTLVTVSS

SEQ ID NO: 11613 - protein, 107 aa, Artificial Sequence; identical to SEQ ID NO: 10923
  Description of Artificial Sequence: Synthetic polypeptide
  VL of XENP018561

SEQ ID NO: 11614 - protein, 5 aa, Artificial Sequence
  Description of Artificial Sequence: Synthetic peptide
  XENP018561 vhCDR1
NYWMN

SEQ ID NO: 11615 - protein, 19 aa, Artificial Sequence
  Description of Artificial Sequence: Synthetic peptide
  XENP018561 vhCDR2
EIKLKSNNYATHYAEPVKG

SEQ ID NO: 11616 - protein, 11 aa, Artificial Sequence
  Description of Artificial Sequence: Synthetic peptide
  XENP018561 vhCDR3
YYGNYGGYFDV

SEQ ID NO: 11617 - protein, 11 aa, Artificial Sequence
  Description of Artificial Sequence: Synthetic peptide
  XENP018561 vlCDR1
RASQSVSNDVA

SEQ ID NO: 11618 - protein, 7 aa, Artificial Sequence
  Description of Artificial Sequence: Synthetic peptide
  XENP018561 vlCDR2
YASHRYT

SEQ ID NO: 11619 - protein, 9 aa, Artificial Sequence
  Description of Artificial Sequence: Synthetic peptide
  XENP018561 vlCDR3
QQDYSSPRT

SEQ ID NO: 11620 - protein, 249 aa, Artificial Sequence
  Description of Artificial Sequence: Synthetic polypeptide
  XENP018562 1G6_H1.66_L1_scFv(GKPGS)4
EVQLVESGGGLVKPGGSLRLSCAASGFTFSNYWMNWVRQAPGKGLEWVGEIELKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 11621 - protein, 122 aa, Artificial Sequence
  Description of Artificial Sequence: Synthetic polypeptide
  VH of XENP018562
EVQLVESGGGLVKPGGSLRLSCAASGFTFSNYWMNWVRQAPGKGLEWVGEIELKSNNYATHYAEPVKGRFTISRDDSKSTVYLQMNSLKTEDTAVYYCTRYYGNYGGYFDVWGAGTLVTVSS

SEQ ID NO: 11622 - protein, 107 aa, Artificial Sequence; identical to SEQ ID NO: 10923
  Description of Artificial Sequence: Synthetic polypeptide
  VL of XENP018562

SEQ ID NO: 11623 - protein, 5 aa, Artificial Sequence
  Description of Artificial Sequence: Synthetic peptide
  XENP018562 vhCDR1
NYWMN

SEQ ID NO: 11624 - protein, 19 aa, Artificial Sequence
  Description of Artificial Sequence: Synthetic peptide
  XENP018562 vhCDR2
EIELKSNNYATHYAEPVKG

SEQ ID NO: 11625 - protein, 11 aa, Artificial Sequence
  Description of Artificial Sequence: Synthetic peptide
  XENP018562 vhCDR3
YYGNYGGYFDV

SEQ ID NO: 11626 - protein, 11 aa, Artificial Sequence
  Description of Artificial Sequence: Synthetic peptide
  XENP018562 vlCDR1
RASQSVSNDVA

SEQ ID NO: 11627 - protein, 7 aa, Artificial Sequence
  Description of Artificial Sequence: Synthetic peptide
  XENP018562 vlCDR2
YASHRYT

SEQ ID NO: 11628 - protein, 9 aa, Artificial Sequence
  Description of Artificial Sequence: Synthetic peptide
  XENP018562 vlCDR3
QQDYSSPRT

SEQ ID NO: 11629 - protein, 249 aa, Artificial Sequence
  Description of Artificial Sequence: Synthetic polypeptide
  XENP018563 1G6_H1.67_L1_scFv(GKPGS)4
EVQLVESGGGLVKPGGSLRLSCAASGFTFSNYWMNWVRQAPGKGLEWVGEIDLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 11630 - protein, 122 aa, Artificial Sequence
  Description of Artificial Sequence: Synthetic polypeptide
  VH of XENP018563
EVQLVESGGGLVKPGGSLRLSCAASGFTFSNYWMNWVRQAPGKGLEWVGEIDLKSNNYATHYAEPVKGRFTISRDDSKSTVYLQMNSLKTEDTAVYYCTRYYGNYGGYFDVWGAGTLVTVSS

SEQ ID NO: 11631 - protein, 107 aa, Artificial Sequence; identical to SEQ ID NO: 10923
  Description of Artificial Sequence: Synthetic polypeptide
  VL of XENP018563

SEQ ID NO: 11632 - protein, 5 aa, Artificial Sequence
  Description of Artificial Sequence: Synthetic peptide
  XENP018563 vhCDR1
NYWMN

SEQ ID NO: 11633 - protein, 19 aa, Artificial Sequence
  Description of Artificial Sequence: Synthetic peptide
  XENP018563 vhCDR2
EIDLKSNNYATHYAEPVKG

SEQ ID NO: 11634 - protein, 11 aa, Artificial Sequence
  Description of Artificial Sequence: Synthetic peptide
  XENP018563 vhCDR3
YYGNYGGYFDV

SEQ ID NO: 11635 - protein, 11 aa, Artificial Sequence
  Description of Artificial Sequence: Synthetic peptide
  XENP018563 vlCDR1
RASQSVSNDVA

SEQ ID NO: 11636 - protein, 7 aa, Artificial Sequence
  Description of Artificial Sequence: Synthetic peptide
  XENP018563 vlCDR2
YASHRYT

SEQ ID NO: 11637 - protein, 9 aa, Artificial Sequence
  Description of Artificial Sequence: Synthetic peptide
  XENP018563 vlCDR3
QQDYSSPRT

SEQ ID NO: 11638 - protein, 249 aa, Artificial Sequence
  Description of Artificial Sequence: Synthetic polypeptide
  XENP018564 1G6_H1.68_L1_scFv(GKPGS)4
EVQLVESGGGLVKPGGSLRLSCAASGFTFSNYWMNWVRQAPGKGLEWVGEIHLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 11639 - protein, 122 aa, Artificial Sequence
  Description of Artificial Sequence: Synthetic polypeptide
  VH of XENP018564
EVQLVESGGGLVKPGGSLRLSCAASGFTFSNYWMNWVRQAPGKGLEWVGEIHLKSNNYATHYAEPVKGRFTISRDDSKSTVYLQMNSLKTEDTAVYYCTRYYGNYGGYFDVWGAGTLVTVSS

SEQ ID NO: 11640 - protein, 107 aa, Artificial Sequence; identical to SEQ ID NO: 10923
  Description of Artificial Sequence: Synthetic polypeptide
  VL of XENP018564

SEQ ID NO: 11641 - protein, 5 aa, Artificial Sequence
  Description of Artificial Sequence: Synthetic peptide
  XENP018564 vhCDR1
NYWMN

SEQ ID NO: 11642 - protein, 19 aa, Artificial Sequence
  Description of Artificial Sequence: Synthetic peptide
  XENP018564 vhCDR2
EIHLKSNNYATHYAEPVKG

SEQ ID NO: 11643 - protein, 11 aa, Artificial Sequence
  Description of Artificial Sequence: Synthetic peptide
  XENP018564 vhCDR3
YYGNYGGYFDV

SEQ ID NO: 11644 - protein, 11 aa, Artificial Sequence
  Description of Artificial Sequence: Synthetic peptide
  XENP018564 vlCDR1
RASQSVSNDVA

SEQ ID NO: 11645 - protein, 7 aa, Artificial Sequence
  Description of Artificial Sequence: Synthetic peptide
  XENP018564 vlCDR2
YASHRYT

SEQ ID NO: 11646 - protein, 9 aa, Artificial Sequence
  Description of Artificial Sequence: Synthetic peptide
  XENP018564 vlCDR3
QQDYSSPRT

SEQ ID NO: 11647 - protein, 249 aa, Artificial Sequence
  Description of Artificial Sequence: Synthetic polypeptide
  XENP018565 1G6_H1.69_L1_scFv(GKPGS)4
EVQLVESGGGLVKPGGSLRLSCAASGFTFSNYWMNWVRQAPGKGLEWVGEISLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 11648 - protein, 122 aa, Artificial Sequence
  Description of Artificial Sequence: Synthetic polypeptide
  VH of XENP018565
EVQLVESGGGLVKPGGSLRLSCAASGFTFSNYWMNWVRQAPGKGLEWVGEISLKSNNYATHYAEPVKGRFTISRDDSKSTVYLQMNSLKTEDTAVYYCTRYYGNYGGYFDVWGAGTLVTVSS

SEQ ID NO: 11649 - protein, 107 aa, Artificial Sequence; identical to SEQ ID NO: 10923
  Description of Artificial Sequence: Synthetic polypeptide
  VL of XENP018565

SEQ ID NO: 11650 - protein, 5 aa, Artificial Sequence
  Description of Artificial Sequence: Synthetic peptide
  XENP018565 vhCDR1
NYWMN

SEQ ID NO: 11651 - protein, 19 aa, Artificial Sequence
  Description of Artificial Sequence: Synthetic peptide
  XENP018565 vhCDR2
EISLKSNNYATHYAEPVKG

SEQ ID NO: 11652 - protein, 11 aa, Artificial Sequence
  Description of Artificial Sequence: Synthetic peptide
  XENP018565 vhCDR3
YYGNYGGYFDV

SEQ ID NO: 11653 - protein, 11 aa, Artificial Sequence
  Description of Artificial Sequence: Synthetic peptide
  XENP018565 vlCDR1
RASQSVSNDVA

SEQ ID NO: 11654 - protein, 7 aa, Artificial Sequence
  Description of Artificial Sequence: Synthetic peptide
  XENP018565 vlCDR2
YASHRYT

SEQ ID NO: 11655 - protein, 9 aa, Artificial Sequence
  Description of Artificial Sequence: Synthetic peptide
  XENP018565 vlCDR3
QQDYSSPRT

SEQ ID NO: 11656 - protein, 249 aa, Artificial Sequence
  Description of Artificial Sequence: Synthetic polypeptide
  XENP018566 1G6_H1.70_L1_scFv(GKPGS)4
EVQLVESGGGLVKPGGSLRLSCAASGFTFSNYWMNWVRQAPGKGLEWVGEIGLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 11657 - protein, 122 aa, Artificial Sequence
  Description of Artificial Sequence: Synthetic polypeptide
  VH of XENP018566
EVQLVESGGGLVKPGGSLRLSCAASGFTFSNYWMNWVRQAPGKGLEWVGEIGLKSNNYATHYAEPVKGRFTISRDDSKSTVYLQMNSLKTEDTAVYYCTRYYGNYGGYFDVWGAGTLVTVSS

SEQ ID NO: 11658 - protein, 107 aa, Artificial Sequence; identical to SEQ ID NO: 10923
  Description of Artificial Sequence: Synthetic polypeptide
  VL of XENP018566

SEQ ID NO: 11659 - protein, 5 aa, Artificial Sequence
  Description of Artificial Sequence: Synthetic peptide
  XENP018566 vhCDR1
NYWMN

SEQ ID NO: 11660 - protein, 19 aa, Artificial Sequence
  Description of Artificial Sequence: Synthetic peptide
  XENP018566 vhCDR2
EIGLKSNNYATHYAEPVKG

SEQ ID NO: 11661 - protein, 11 aa, Artificial Sequence
  Description of Artificial Sequence: Synthetic peptide
  XENP018566 vhCDR3
YYGNYGGYFDV

SEQ ID NO: 11662 - protein, 11 aa, Artificial Sequence
  Description of Artificial Sequence: Synthetic peptide
  XENP018566 vlCDR1
RASQSVSNDVA

SEQ ID NO: 11663 - protein, 7 aa, Artificial Sequence
  Description of Artificial Sequence: Synthetic peptide
  XENP018566 vlCDR2
YASHRYT

SEQ ID NO: 11664 - protein, 9 aa, Artificial Sequence
  Description of Artificial Sequence: Synthetic peptide
  XENP018566 vlCDR3
QQDYSSPRT

SEQ ID NO: 11665 - protein, 249 aa, Artificial Sequence
  Description of Artificial Sequence: Synthetic polypeptide
  XENP018567 1G6_H1.71_L1_scFv(GKPGS)4
EVQLVESGGGLVKPGGSLRLSCAASGFTFSNYWMNWVRQAPGKGLEWVGEIYLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 11666 - protein, 122 aa, Artificial Sequence
  Description of Artificial Sequence: Synthetic polypeptide
  VH of XENP018567
EVQLVESGGGLVKPGGSLRLSCAASGFTFSNYWMNWVRQAPGKGLEWVGEIYLKSNNYATHYAEPVKGRFTISRDDSKSTVYLQMNSLKTEDTAVYYCTRYYGNYGGYFDVWGAGTLVTVSS

SEQ ID NO: 11667 - protein, 107 aa, Artificial Sequence; identical to SEQ ID NO: 10923
  Description of Artificial Sequence: Synthetic polypeptide
  VL of XENP018567

SEQ ID NO: 11668 - protein, 5 aa, Artificial Sequence
  Description of Artificial Sequence: Synthetic peptide
  XENP018567 vhCDR1
NYWMN

SEQ ID NO: 11669 - protein, 19 aa, Artificial Sequence
  Description of Artificial Sequence: Synthetic peptide
  XENP018567 vhCDR2
EIYLKSNNYATHYAEPVKG

SEQ ID NO: 11670 - protein, 11 aa, Artificial Sequence
  Description of Artificial Sequence: Synthetic peptide
  XENP018567 vhCDR3
YYGNYGGYFDV

SEQ ID NO: 11671 - protein, 11 aa, Artificial Sequence
  Description of Artificial Sequence: Synthetic peptide
  XENP018567 vlCDR1
RASQSVSNDVA

SEQ ID NO: 11672 - protein, 7 aa, Artificial Sequence
  Description of Artificial Sequence: Synthetic peptide
  XENP018567 vlCDR2
YASHRYT

SEQ ID NO: 11673 - protein, 9 aa, Artificial Sequence
  Description of Artificial Sequence: Synthetic peptide
  XENP018567 vlCDR3
QQDYSSPRT

SEQ ID NO: 11674 - protein, 249 aa, Artificial Sequence
  Description of Artificial Sequence: Synthetic polypeptide
  XENP018568 1G6_H1.72_L1_scFv(GKPGS)4
EVQLVESGGGLVKPGGSLRLSCAASGFTFSNYWMNWVRQAPGKGLEWVGEIILKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 11675 - protein, 122 aa, Artificial Sequence
  Description of Artificial Sequence: Synthetic polypeptide
  VH of XENP018568
EVQLVESGGGLVKPGGSLRLSCAASGFTFSNYWMNWVRQAPGKGLEWVGEIILKSNNYATHYAEPVKGRFTISRDDSKSTVYLQMNSLKTEDTAVYYCTRYYGNYGGYFDVWGAGTLVTVSS

SEQ ID NO: 11676 - protein, 107 aa, Artificial Sequence; identical to SEQ ID NO: 10923
  Description of Artificial Sequence: Synthetic polypeptide
  VL of XENP018568

SEQ ID NO: 11677 - protein, 5 aa, Artificial Sequence
  Description of Artificial Sequence: Synthetic peptide
  XENP018568 vhCDR1
NYWMN

SEQ ID NO: 11678 - protein, 19 aa, Artificial Sequence
  Description of Artificial Sequence: Synthetic peptide
  XENP018568 vhCDR2
EIILKSNNYATHYAEPVKG

SEQ ID NO: 11679 - protein, 11 aa, Artificial Sequence
  Description of Artificial Sequence: Synthetic peptide
  XENP018568 vhCDR3
YYGNYGGYFDV

SEQ ID NO: 11680 - protein, 11 aa, Artificial Sequence
  Description of Artificial Sequence: Synthetic peptide
  XENP018568 vlCDR1
RASQSVSNDVA

SEQ ID NO: 11681 - protein, 7 aa, Artificial Sequence
  Description of Artificial Sequence: Synthetic peptide
  XENP018568 vlCDR2
YASHRYT

SEQ ID NO: 11682 - protein, 9 aa, Artificial Sequence
  Description of Artificial Sequence: Synthetic peptide
  XENP018568 vlCDR3
QQDYSSPRT

SEQ ID NO: 11683 - protein, 249 aa, Artificial Sequence
  Description of Artificial Sequence: Synthetic polypeptide
  XENP018569 1G6_H1.73_L1_scFv(GKPGS)4
EVQLVESGGGLVKPGGSLRLSCAASGFTFSNYWMNWVRQAPGKGLEWVGEIWLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 11684 - protein, 122 aa, Artificial Sequence
  Description of Artificial Sequence: Synthetic polypeptide
  VH of XENP018569
EVQLVESGGGLVKPGGSLRLSCAASGFTFSNYWMNWVRQAPGKGLEWVGEIWLKSNNYATHYAEPVKGRFTISRDDSKSTVYLQMNSLKTEDTAVYYCTRYYGNYGGYFDVWGAGTLVTVSS

SEQ ID NO: 11685 - protein, 107 aa, Artificial Sequence; identical to SEQ ID NO: 10923
  Description of Artificial Sequence: Synthetic polypeptide
  VL of XENP018569

SEQ ID NO: 11686 - protein, 5 aa, Artificial Sequence
  Description of Artificial Sequence: Synthetic peptide
  XENP018569 vhCDR1
NYWMN

SEQ ID NO: 11687 - protein, 19 aa, Artificial Sequence
  Description of Artificial Sequence: Synthetic peptide
  XENP018569 vhCDR2
EIWLKSNNYATHYAEPVKG

SEQ ID NO: 11688 - protein, 11 aa, Artificial Sequence
  Description of Artificial Sequence: Synthetic peptide
  XENP018569 vhCDR3
YYGNYGGYFDV

SEQ ID NO: 11689 - protein, 11 aa, Artificial Sequence
  Description of Artificial Sequence: Synthetic peptide
  XENP018569 vlCDR1
RASQSVSNDVA

SEQ ID NO: 11690 - protein, 7 aa, Artificial Sequence
  Description of Artificial Sequence: Synthetic peptide
  XENP018569 vlCDR2
YASHRYT

SEQ ID NO: 11691 - protein, 9 aa, Artificial Sequence
  Description of Artificial Sequence: Synthetic peptide
  XENP018569 vlCDR3
QQDYSSPRT

SEQ ID NO: 11692 - protein, 249 aa, Artificial Sequence
  Description of Artificial Sequence: Synthetic polypeptide
  XENP018570 1G6_H1.74_L1_scFv(GKPGS)4
EVQLVESGGGLVKPGGSLRLSCAASGFTFSNYWMNWVRQAPGKGLEWVGEIRIKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 11693 - protein, 122 aa, Artificial Sequence
  Description of Artificial Sequence: Synthetic polypeptide
  VH of XENP018570
EVQLVESGGGLVKPGGSLRLSCAASGFTFSNYWMNWVRQAPGKGLEWVGEIRIKSNNYATHYAEPVKGRFTISRDDSKSTVYLQMNSLKTEDTAVYYCTRYYGNYGGYFDVWGAGTLVTVSS

SEQ ID NO: 11694 - protein, 107 aa, Artificial Sequence; identical to SEQ ID NO: 10923
  Description of Artificial Sequence: Synthetic polypeptide
  VL of XENP018570

SEQ ID NO: 11695 - protein, 5 aa, Artificial Sequence
  Description of Artificial Sequence: Synthetic peptide
  XENP018570 vhCDR1
NYWMN

SEQ ID NO: 11696 - protein, 19 aa, Artificial Sequence
  Description of Artificial Sequence: Synthetic peptide
  XENP018570 vhCDR2
EIRIKSNNYATHYAEPVKG

SEQ ID NO: 11697 - protein, 11 aa, Artificial Sequence
  Description of Artificial Sequence: Synthetic peptide
  XENP018570 vhCDR3
YYGNYGGYFDV

SEQ ID NO: 11698 - protein, 11 aa, Artificial Sequence
  Description of Artificial Sequence: Synthetic peptide
  XENP018570 vlCDR1
RASQSVSNDVA

SEQ ID NO: 11699 - protein, 7 aa, Artificial Sequence
  Description of Artificial Sequence: Synthetic peptide
  XENP018570 vlCDR2
YASHRYT

SEQ ID NO: 11700 - protein, 9 aa, Artificial Sequence
  Description of Artificial Sequence: Synthetic peptide
  XENP018570 vlCDR3
QQDYSSPRT

SEQ ID NO: 11701 - protein, 249 aa, Artificial Sequence
  Description of Artificial Sequence: Synthetic polypeptide
  XENP018571 1G6_H1.75_L1_scFv(GKPGS)4
EVQLVESGGGLVKPGGSLRLSCAASGFTFSNYWMNWVRQAPGKGLEWVGEIRFKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 11702 - protein, 122 aa, Artificial Sequence
  Description of Artificial Sequence: Synthetic polypeptide
  VH of XENP018571
EVQLVESGGGLVKPGGSLRLSCAASGFTFSNYWMNWVRQAPGKGLEWVGEIRFKSNNYATHYAEPVKGRFTISRDDSKSTVYLQMNSLKTEDTAVYYCTRYYGNYGGYFDVWGAGTLVTVSS

SEQ ID NO: 11703 - protein, 107 aa, Artificial Sequence; identical to SEQ ID NO: 10923
  Description of Artificial Sequence: Synthetic polypeptide
  VL of XENP018571

SEQ ID NO: 11704 - protein, 5 aa, Artificial Sequence
  Description of Artificial Sequence: Synthetic peptide
  XENP018571 vhCDR1
NYWMN

SEQ ID NO: 11705 - protein, 19 aa, Artificial Sequence
  Description of Artificial Sequence: Synthetic peptide
  XENP018571 vhCDR2
EIRFKSNNYATHYAEPVKG

SEQ ID NO: 11706 - protein, 11 aa, Artificial Sequence
  Description of Artificial Sequence: Synthetic peptide
  XENP018571 vhCDR3
YYGNYGGYFDV

SEQ ID NO: 11707 - protein, 11 aa, Artificial Sequence
  Description of Artificial Sequence: Synthetic peptide
  XENP018571 vlCDR1
RASQSVSNDVA

SEQ ID NO: 11708 - protein, 7 aa, Artificial Sequence
  Description of Artificial Sequence: Synthetic peptide
  XENP018571 vlCDR2
YASHRYT

SEQ ID NO: 11709 - protein, 9 aa, Artificial Sequence
  Description of Artificial Sequence: Synthetic peptide
  XENP018571 vlCDR3
QQDYSSPRT

SEQ ID NO: 11710 - protein, 249 aa, Artificial Sequence
  Description of Artificial Sequence: Synthetic polypeptide
  XENP018572 1G6_H1.76_L1_scFv(GKPGS)4
EVQLVESGGGLVKPGGSLRLSCAASGFTFSNYWMNWVRQAPGKGLEWVGEIRVKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 11711 - protein, 122 aa, Artificial Sequence
  Description of Artificial Sequence: Synthetic polypeptide
  VH of XENP018572
EVQLVESGGGLVKPGGSLRLSCAASGFTFSNYWMNWVRQAPGKGLEWVGEIRVKSNNYATHYAEPVKGRFTISRDDSKSTVYLQMNSLKTEDTAVYYCTRYYGNYGGYFDVWGAGTLVTVSS

SEQ ID NO: 11712 - protein, 107 aa, Artificial Sequence; identical to SEQ ID NO: 10923
  Description of Artificial Sequence: Synthetic polypeptide
  VL of XENP018572

SEQ ID NO: 11713 - protein, 5 aa, Artificial Sequence
  Description of Artificial Sequence: Synthetic peptide
  XENP018572 vhCDR1
NYWMN

SEQ ID NO: 11714 - protein, 19 aa, Artificial Sequence
  Description of Artificial Sequence: Synthetic peptide
  XENP018572 vhCDR2
EIRVKSNNYATHYAEPVKG

SEQ ID NO: 11715 - protein, 11 aa, Artificial Sequence
  Description of Artificial Sequence: Synthetic peptide
  XENP018572 vhCDR3
YYGNYGGYFDV

SEQ ID NO: 11716 - protein, 11 aa, Artificial Sequence
  Description of Artificial Sequence: Synthetic peptide
  XENP018572 vlCDR1
RASQSVSNDVA

SEQ ID NO: 11717 - protein, 7 aa, Artificial Sequence
  Description of Artificial Sequence: Synthetic peptide
  XENP018572 vlCDR2
YASHRYT

SEQ ID NO: 11718 - protein, 9 aa, Artificial Sequence
  Description of Artificial Sequence: Synthetic peptide
  XENP018572 vlCDR3
QQDYSSPRT

SEQ ID NO: 11719 - protein, 249 aa, Artificial Sequence
  Description of Artificial Sequence: Synthetic polypeptide
  XENP018573 1G6_H1.77_L1_scFv(GKPGS)4
EVQLVESGGGLVKPGGSLRLSCAASGFTFSNYWMNWVRQAPGKGLEWVGEIRYKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 11720 - protein, 122 aa, Artificial Sequence
  Description of Artificial Sequence: Synthetic polypeptide
  VH of XENP018573
EVQLVESGGGLVKPGGSLRLSCAASGFTFSNYWMNWVRQAPGKGLEWVGEIRYKSNNYATHYAEPVKGRFTISRDDSKSTVYLQMNSLKTEDTAVYYCTRYYGNYGGYFDVWGAGTLVTVSS

SEQ ID NO: 11721 - protein, 107 aa, Artificial Sequence; identical to SEQ ID NO: 10923
  Description of Artificial Sequence: Synthetic polypeptide
  VL of XENP018573

SEQ ID NO: 11722 - protein, 5 aa, Artificial Sequence
  Description of Artificial Sequence: Synthetic peptide
  XENP018573 vhCDR1
NYWMN

SEQ ID NO: 11723 - protein, 19 aa, Artificial Sequence
  Description of Artificial Sequence: Synthetic peptide
  XENP018573 vhCDR2
EIRYKSNNYATHYAEPVKG

SEQ ID NO: 11724 - protein, 11 aa, Artificial Sequence
  Description of Artificial Sequence: Synthetic peptide
  XENP018573 vhCDR3
YYGNYGGYFDV

SEQ ID NO: 11725 - protein, 11 aa, Artificial Sequence
  Description of Artificial Sequence: Synthetic peptide
  XENP018573 vlCDR1
RASQSVSNDVA

SEQ ID NO: 11726 - protein, 7 aa, Artificial Sequence
  Description of Artificial Sequence: Synthetic peptide
  XENP018573 vlCDR2
YASHRYT

SEQ ID NO: 11727 - protein, 9 aa, Artificial Sequence
  Description of Artificial Sequence: Synthetic peptide
  XENP018573 vlCDR3
QQDYSSPRT

SEQ ID NO: 11728 - protein, 249 aa, Artificial Sequence
  Description of Artificial Sequence: Synthetic polypeptide
  XENP018574 1G6_H1.78_L1_scFv(GKPGS)4
EVQLVESGGGLVKPGGSLRLSCAASGFTFSNYWMNWVRQAPGKGLEWVGEIRWKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 11729 - protein, 122 aa, Artificial Sequence
  Description of Artificial Sequence: Synthetic polypeptide
  VH of XENP018574
EVQLVESGGGLVKPGGSLRLSCAASGFTFSNYWMNWVRQAPGKGLEWVGEIRWKSNNYATHYAEPVKGRFTISRDDSKSTVYLQMNSLKTEDTAVYYCTRYYGNYGGYFDVWGAGTLVTVSS

SEQ ID NO: 11730 - protein, 107 aa, Artificial Sequence; identical to SEQ ID NO: 10923
  Description of Artificial Sequence: Synthetic polypeptide
  VL of XENP018574

SEQ ID NO: 11731 - protein, 5 aa, Artificial Sequence
  Description of Artificial Sequence: Synthetic peptide
  XENP018574 vhCDR1
NYWMN

SEQ ID NO: 11732 - protein, 19 aa, Artificial Sequence
  Description of Artificial Sequence: Synthetic peptide
  XENP018574 vhCDR2
EIRWKSNNYATHYAEPVKG

SEQ ID NO: 11733 - protein, 11 aa, Artificial Sequence
  Description of Artificial Sequence: Synthetic peptide
  XENP018574 vhCDR3
YYGNYGGYFDV

SEQ ID NO: 11734 - protein, 11 aa, Artificial Sequence
  Description of Artificial Sequence: Synthetic peptide
  XENP018574 vlCDR1
RASQSVSNDVA

SEQ ID NO: 11735 - protein, 7 aa, Artificial Sequence
  Description of Artificial Sequence: Synthetic peptide
  XENP018574 vlCDR2
YASHRYT

SEQ ID NO: 11736 - protein, 9 aa, Artificial Sequence
  Description of Artificial Sequence: Synthetic peptide
  XENP018574 vlCDR3
QQDYSSPRT

SEQ ID NO: 11737 - protein, 249 aa, Artificial Sequence
  Description of Artificial Sequence: Synthetic polypeptide
  XENP018575 1G6_H1.79_L1_scFv(GKPGS)4
EVQLVESGGGLVKPGGSLRLSCAASGFTFSNYWMNWVRQAPGKGLEWVGEIRDKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 11738 - protein, 122 aa, Artificial Sequence
  Description of Artificial Sequence: Synthetic polypeptide
  VH of XENP018575
EVQLVESGGGLVKPGGSLRLSCAASGFTFSNYWMNWVRQAPGKGLEWVGEIRDKSNNYATHYAEPVKGRFTISRDDSKSTVYLQMNSLKTEDTAVYYCTRYYGNYGGYFDVWGAGTLVTVSS

SEQ ID NO: 11739 - protein, 107 aa, Artificial Sequence; identical to SEQ ID NO: 10923
  Description of Artificial Sequence: Synthetic polypeptide
  VL of XENP018575

SEQ ID NO: 11740 - protein, 5 aa, Artificial Sequence
  Description of Artificial Sequence: Synthetic peptide
  XENP018575 vhCDR1
NYWMN

SEQ ID NO: 11741 - protein, 19 aa, Artificial Sequence
  Description of Artificial Sequence: Synthetic peptide
  XENP018575 vhCDR2
EIRDKSNNYATHYAEPVKG

SEQ ID NO: 11742 - protein, 11 aa, Artificial Sequence
  Description of Artificial Sequence: Synthetic peptide
  XENP018575 vhCDR3
YYGNYGGYFDV

SEQ ID NO: 11743 - protein, 11 aa, Artificial Sequence
  Description of Artificial Sequence: Synthetic peptide
  XENP018575 vlCDR1
RASQSVSNDVA

SEQ ID NO: 11744 - protein, 7 aa, Artificial Sequence
  Description of Artificial Sequence: Synthetic peptide
  XENP018575 vlCDR2
YASHRYT

SEQ ID NO: 11745 - protein, 9 aa, Artificial Sequence
  Description of Artificial Sequence: Synthetic peptide
  XENP018575 vlCDR3
QQDYSSPRT

SEQ ID NO: 11746 - protein, 249 aa, Artificial Sequence
  Description of Artificial Sequence: Synthetic polypeptide
  XENP018576 1G6_H1.80_L1_scFv(GKPGS)4
EVQLVESGGGLVKPGGSLRLSCAASGFTFSNYWMNWVRQAPGKGLEWVGEIRAKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 11747 - protein, 122 aa, Artificial Sequence
  Description of Artificial Sequence: Synthetic polypeptide
  VH of XENP018576
EVQLVESGGGLVKPGGSLRLSCAASGFTFSNYWMNWVRQAPGKGLEWVGEIRAKSNNYATHYAEPVKGRFTISRDDSKSTVYLQMNSLKTEDTAVYYCTRYYGNYGGYFDVWGAGTLVTVSS

SEQ ID NO: 11748 - protein, 107 aa, Artificial Sequence; identical to SEQ ID NO: 10923
  Description of Artificial Sequence: Synthetic polypeptide
  VL of XENP018576

SEQ ID NO: 11749 - protein, 5 aa, Artificial Sequence
  Description of Artificial Sequence: Synthetic peptide
  XENP018576 vhCDR1
NYWMN

SEQ ID NO: 11750 - protein, 19 aa, Artificial Sequence
  Description of Artificial Sequence: Synthetic peptide
  XENP018576 vhCDR2
EIRAKSNNYATHYAEPVKG

SEQ ID NO: 11751 - protein, 11 aa, Artificial Sequence
  Description of Artificial Sequence: Synthetic peptide
  XENP018576 vhCDR3
YYGNYGGYFDV

SEQ ID NO: 11752 - protein, 11 aa, Artificial Sequence
  Description of Artificial Sequence: Synthetic peptide
  XENP018576 vlCDR1
RASQSVSNDVA

SEQ ID NO: 11753 - protein, 7 aa, Artificial Sequence
  Description of Artificial Sequence: Synthetic peptide
  XENP018576 vlCDR2
YASHRYT

SEQ ID NO: 11754 - protein, 9 aa, Artificial Sequence
  Description of Artificial Sequence: Synthetic peptide
  XENP018576 vlCDR3
QQDYSSPRT

SEQ ID NO: 11755 - protein, 249 aa, Artificial Sequence
  Description of Artificial Sequence: Synthetic polypeptide
  XENP018577 1G6_H1.81_L1_scFv(GKPGS)4
EVQLVESGGGLVKPGGSLRLSCAASGFTFSNYWMNWVRQAPGKGLEWVGEIRQKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 11756 - protein, 122 aa, Artificial Sequence
  Description of Artificial Sequence: Synthetic polypeptide
  VH of XENP018577
EVQLVESGGGLVKPGGSLRLSCAASGFTFSNYWMNWVRQAPGKGLEWVGEIRQKSNNYATHYAEPVKGRFTISRDDSKSTVYLQMNSLKTEDTAVYYCTRYYGNYGGYFDVWGAGTLVTVSS

SEQ ID NO: 11757 - protein, 107 aa, Artificial Sequence; identical to SEQ ID NO: 10923
  Description of Artificial Sequence: Synthetic polypeptide
  VL of XENP018577

SEQ ID NO: 11758 - protein, 5 aa, Artificial Sequence
  Description of Artificial Sequence: Synthetic peptide
  XENP018577 vhCDR1
NYWMN

SEQ ID NO: 11759 - protein, 19 aa, Artificial Sequence
  Description of Artificial Sequence: Synthetic peptide
  XENP018577 vhCDR2
EIRQKSNNYATHYAEPVKG

SEQ ID NO: 11760 - protein, 11 aa, Artificial Sequence
  Description of Artificial Sequence: Synthetic peptide
  XENP018577 vhCDR3
YYGNYGGYFDV

SEQ ID NO: 11761 - protein, 11 aa, Artificial Sequence
  Description of Artificial Sequence: Synthetic peptide
  XENP018577 vlCDR1
RASQSVSNDVA

SEQ ID NO: 11762 - protein, 7 aa, Artificial Sequence
  Description of Artificial Sequence: Synthetic peptide
  XENP018577 vlCDR2
YASHRYT

SEQ ID NO: 11763 - protein, 9 aa, Artificial Sequence
  Description of Artificial Sequence: Synthetic peptide
  XENP018577 vlCDR3
QQDYSSPRT

SEQ ID NO: 11764 - protein, 249 aa, Artificial Sequence
  Description of Artificial Sequence: Synthetic polypeptide
  XENP018578 1G6_H1.82_L1_scFv(GKPGS)4
EVQLVESGGGLVKPGGSLRLSCAASGFTFSNYWMNWVRQAPGKGLEWVGEIRKKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 11765 - protein, 122 aa, Artificial Sequence
  Description of Artificial Sequence: Synthetic polypeptide
  VH of XENP018578
EVQLVESGGGLVKPGGSLRLSCAASGFTFSNYWMNWVRQAPGKGLEWVGEIRKKSNNYATHYAEPVKGRFTISRDDSKSTVYLQMNSLKTEDTAVYYCTRYYGNYGGYFDVWGAGTLVTVSS

SEQ ID NO: 11766 - protein, 107 aa, Artificial Sequence; identical to SEQ ID NO: 10923
  Description of Artificial Sequence: Synthetic polypeptide
  VL of XENP018578

SEQ ID NO: 11767 - protein, 5 aa, Artificial Sequence
  Description of Artificial Sequence: Synthetic peptide
  XENP018578 vhCDR1
NYWMN

SEQ ID NO: 11768 - protein, 19 aa, Artificial Sequence
  Description of Artificial Sequence: Synthetic peptide
  XENP018578 vhCDR2
EIRKKSNNYATHYAEPVKG

SEQ ID NO: 11769 - protein, 11 aa, Artificial Sequence
  Description of Artificial Sequence: Synthetic peptide
  XENP018578 vhCDR3
YYGNYGGYFDV

SEQ ID NO: 11770 - protein, 11 aa, Artificial Sequence
  Description of Artificial Sequence: Synthetic peptide
  XENP018578 vlCDR1
RASQSVSNDVA

SEQ ID NO: 11771 - protein, 7 aa, Artificial Sequence
  Description of Artificial Sequence: Synthetic peptide
  XENP018578 vlCDR2
YASHRYT

SEQ ID NO: 11772 - protein, 9 aa, Artificial Sequence
  Description of Artificial Sequence: Synthetic peptide
  XENP018578 vlCDR3
QQDYSSPRT

SEQ ID NO: 11773 - protein, 249 aa, Artificial Sequence
  Description of Artificial Sequence: Synthetic polypeptide
  XENP018579 1G6_H1.83_L1_scFv(GKPGS)4
EVQLVESGGGLVKPGGSLRLSCAASGFTFSNYWMNWVRQAPGKGLEWVGEIRLRSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 11774 - protein, 122 aa, Artificial Sequence
  Description of Artificial Sequence: Synthetic polypeptide
  VH of XENP018579
EVQLVESGGGLVKPGGSLRLSCAASGFTFSNYWMNWVRQAPGKGLEWVGEIRLRSNNYATHYAEPVKGRFTISRDDSKSTVYLQMNSLKTEDTAVYYCTRYYGNYGGYFDVWGAGTLVTVSS

SEQ ID NO: 11775 - protein, 107 aa, Artificial Sequence; identical to SEQ ID NO: 10923
  Description of Artificial Sequence: Synthetic polypeptide
  VL of XENP018579

SEQ ID NO: 11776 - protein, 5 aa, Artificial Sequence
  Description of Artificial Sequence: Synthetic peptide
  XENP018579 vhCDR1
NYWMN

SEQ ID NO: 11777 - protein, 19 aa, Artificial Sequence
  Description of Artificial Sequence: Synthetic peptide
  XENP018579 vhCDR2
EIRLRSNNYATHYAEPVKG

SEQ ID NO: 11778 - protein, 11 aa, Artificial Sequence
  Description of Artificial Sequence: Synthetic peptide
  XENP018579 vhCDR3
YYGNYGGYFDV

SEQ ID NO: 11779 - protein, 11 aa, Artificial Sequence
  Description of Artificial Sequence: Synthetic peptide
  XENP018579 vlCDR1
RASQSVSNDVA

SEQ ID NO: 11780 - protein, 7 aa, Artificial Sequence
  Description of Artificial Sequence: Synthetic peptide
  XENP018579 vlCDR2
YASHRYT

SEQ ID NO: 11781 - protein, 9 aa, Artificial Sequence
  Description of Artificial Sequence: Synthetic peptide
  XENP018579 vlCDR3
QQDYSSPRT

SEQ ID NO: 11782 - protein, 249 aa, Artificial Sequence
  Description of Artificial Sequence: Synthetic polypeptide
  XENP018580 1G6_H1.84_L1_scFv(GKPGS)4
EVQLVESGGGLVKPGGSLRLSCAASGFTFSNYWMNWVRQAPGKGLEWVGEIRLESNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 11783 - protein, 122 aa, Artificial Sequence
  Description of Artificial Sequence: Synthetic polypeptide
  VH of XENP018580
EVQLVESGGGLVKPGGSLRLSCAASGFTFSNYWMNWVRQAPGKGLEWVGEIRLESNNYATHYAEPVKGRFTISRDDSKSTVYLQMNSLKTEDTAVYYCTRYYGNYGGYFDVWGAGTLVTVSS

SEQ ID NO: 11784 - protein, 107 aa, Artificial Sequence; identical to SEQ ID NO: 10923
  Description of Artificial Sequence: Synthetic polypeptide
  VL of XENP018580

SEQ ID NO: 11785 - protein, 5 aa, Artificial Sequence
  Description of Artificial Sequence: Synthetic peptide
  XENP018580 vhCDR1
NYWMN

SEQ ID NO: 11786 - protein, 19 aa, Artificial Sequence
  Description of Artificial Sequence: Synthetic peptide
  XENP018580 vhCDR2
EIRLESNNYATHYAEPVKG

SEQ ID NO: 11787 - protein, 11 aa, Artificial Sequence
  Description of Artificial Sequence: Synthetic peptide
  XENP018580 vhCDR3
YYGNYGGYFDV

SEQ ID NO: 11788 - protein, 11 aa, Artificial Sequence
  Description of Artificial Sequence: Synthetic peptide
  XENP018580 vlCDR1
RASQSVSNDVA

SEQ ID NO: 11789 - protein, 7 aa, Artificial Sequence
  Description of Artificial Sequence: Synthetic peptide
  XENP018580 vlCDR2
YASHRYT

SEQ ID NO: 11790 - protein, 9 aa, Artificial Sequence
  Description of Artificial Sequence: Synthetic peptide
  XENP018580 vlCDR3
QQDYSSPRT

SEQ ID NO: 11791 - protein, 249 aa, Artificial Sequence
  Description of Artificial Sequence: Synthetic polypeptide
  XENP018581 1G6_H1.85_L1_scFv(GKPGS)4
EVQLVESGGGLVKPGGSLRLSCAASGFTFSNYWMNWVRQAPGKGLEWVGEIRLHSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 11792 - protein, 122 aa, Artificial Sequence
  Description of Artificial Sequence: Synthetic polypeptide
  VH of XENP018581
EVQLVESGGGLVKPGGSLRLSCAASGFTFSNYWMNWVRQAPGKGLEWVGEIRLHSNNYATHYAEPVKGRFTISRDDSKSTVYLQMNSLKTEDTAVYYCTRYYGNYGGYFDVWGAGTLVTVSS

SEQ ID NO: 11793 - protein, 107 aa, Artificial Sequence; identical to SEQ ID NO: 10923
  Description of Artificial Sequence: Synthetic polypeptide
  VL of XENP018581

SEQ ID NO: 11794 - protein, 5 aa, Artificial Sequence
  Description of Artificial Sequence: Synthetic peptide
  XENP018581 vhCDR1
NYWMN

SEQ ID NO: 11795 - protein, 19 aa, Artificial Sequence
  Description of Artificial Sequence: Synthetic peptide
  XENP018581 vhCDR2
EIRLHSNNYATHYAEPVKG

SEQ ID NO: 11796 - protein, 11 aa, Artificial Sequence
  Description of Artificial Sequence: Synthetic peptide
  XENP018581 vhCDR3
YYGNYGGYFDV

SEQ ID NO: 11797 - protein, 11 aa, Artificial Sequence
  Description of Artificial Sequence: Synthetic peptide
  XENP018581 vlCDR1
RASQSVSNDVA

SEQ ID NO: 11798 - protein, 7 aa, Artificial Sequence
  Description of Artificial Sequence: Synthetic peptide
  XENP018581 vlCDR2
YASHRYT

SEQ ID NO: 11799 - protein, 9 aa, Artificial Sequence
  Description of Artificial Sequence: Synthetic peptide
  XENP018581 vlCDR3
QQDYSSPRT

SEQ ID NO: 11800 - protein, 249 aa, Artificial Sequence
  Description of Artificial Sequence: Synthetic polypeptide
  XENP018582 1G6_H1.86_L1_scFv(GKPGS)4
EVQLVESGGGLVKPGGSLRLSCAASGFTFSNYWMNWVRQAPGKGLEWVGEIRLSSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 11801 - protein, 122 aa, Artificial Sequence
  Description of Artificial Sequence: Synthetic polypeptide
  VH of XENP018582
EVQLVESGGGLVKPGGSLRLSCAASGFTFSNYWMNWVRQAPGKGLEWVGEIRLSSNNYATHYAEPVKGRFTISRDDSKSTVYLQMNSLKTEDTAVYYCTRYYGNYGGYFDVWGAGTLVTVSS

SEQ ID NO: 11802 - protein, 107 aa, Artificial Sequence; identical to SEQ ID NO: 10923
  Description of Artificial Sequence: Synthetic polypeptide
  VL of XENP018582

SEQ ID NO: 11803 - protein, 5 aa, Artificial Sequence
  Description of Artificial Sequence: Synthetic peptide
  XENP018582 vhCDR1
NYWMN

SEQ ID NO: 11804 - protein, 19 aa, Artificial Sequence
  Description of Artificial Sequence: Synthetic peptide
  XENP018582 vhCDR2
EIRLSSNNYATHYAEPVKG

SEQ ID NO: 11805 - protein, 11 aa, Artificial Sequence
  Description of Artificial Sequence: Synthetic peptide
  XENP018582 vhCDR3
YYGNYGGYFDV

SEQ ID NO: 11806 - protein, 11 aa, Artificial Sequence
  Description of Artificial Sequence: Synthetic peptide
  XENP018582 vlCDR1
RASQSVSNDVA

SEQ ID NO: 11807 - protein, 7 aa, Artificial Sequence
  Description of Artificial Sequence: Synthetic peptide
  XENP018582 vlCDR2
YASHRYT

SEQ ID NO: 11808 - protein, 9 aa, Artificial Sequence
  Description of Artificial Sequence: Synthetic peptide
  XENP018582 vlCDR3
QQDYSSPRT

SEQ ID NO: 11809 - protein, 249 aa, Artificial Sequence
  Description of Artificial Sequence: Synthetic polypeptide
  XENP018583 1G6_H1.87_L1_scFv(GKPGS)4
EVQLVESGGGLVKPGGSLRLSCAASGFTFSNYWMNWVRQAPGKGLEWVGEIRLDSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 11810 - protein, 122 aa, Artificial Sequence
  Description of Artificial Sequence: Synthetic polypeptide
  VH of XENP018583
EVQLVESGGGLVKPGGSLRLSCAASGFTFSNYWMNWVRQAPGKGLEWVGEIRLDSNNYATHYAEPVKGRFTISRDDSKSTVYLQMNSLKTEDTAVYYCTRYYGNYGGYFDVWGAGTLVTVSS

SEQ ID NO: 11811 - protein, 107 aa, Artificial Sequence; identical to SEQ ID NO: 10923
  Description of Artificial Sequence: Synthetic polypeptide
  VL of XENP018583

SEQ ID NO: 11812 - protein, 5 aa, Artificial Sequence
  Description of Artificial Sequence: Synthetic peptide
  XENP018583 vhCDR1
NYWMN

SEQ ID NO: 11813 - protein, 19 aa, Artificial Sequence
  Description of Artificial Sequence: Synthetic peptide
  XENP018583 vhCDR2
EIRLDSNNYATHYAEPVKG

SEQ ID NO: 11814 - protein, 11 aa, Artificial Sequence
  Description of Artificial Sequence: Synthetic peptide
  XENP018583 vhCDR3
YYGNYGGYFDV

SEQ ID NO: 11815 - protein, 11 aa, Artificial Sequence
  Description of Artificial Sequence: Synthetic peptide
  XENP018583 vlCDR1
RASQSVSNDVA

SEQ ID NO: 11816 - protein, 7 aa, Artificial Sequence
  Description of Artificial Sequence: Synthetic peptide
  XENP018583 vlCDR2
YASHRYT

SEQ ID NO: 11817 - protein, 9 aa, Artificial Sequence
  Description of Artificial Sequence: Synthetic peptide
  XENP018583 vlCDR3
QQDYSSPRT

SEQ ID NO: 11818 - protein, 249 aa, Artificial Sequence
  Description of Artificial Sequence: Synthetic polypeptide
  XENP018584 1G6_H1.88_L1_scFv(GKPGS)4
EVQLVESGGGLVKPGGSLRLSCAASGFTFSNYWMNWVRQAPGKGLEWVGEIRLASNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 11819 - protein, 122 aa, Artificial Sequence
  Description of Artificial Sequence: Synthetic polypeptide
  VH of XENP018584
EVQLVESGGGLVKPGGSLRLSCAASGFTFSNYWMNWVRQAPGKGLEWVGEIRLASNNYATHYAEPVKGRFTISRDDSKSTVYLQMNSLKTEDTAVYYCTRYYGNYGGYFDVWGAGTLVTVSS

SEQ ID NO: 11820 - protein, 107 aa, Artificial Sequence; identical to SEQ ID NO: 10923
  Description of Artificial Sequence: Synthetic polypeptide
  VL of XENP018584

SEQ ID NO: 11821 - protein, 5 aa, Artificial Sequence
  Description of Artificial Sequence: Synthetic peptide
  XENP018584 vhCDR1
NYWMN

SEQ ID NO: 11822 - protein, 19 aa, Artificial Sequence
  Description of Artificial Sequence: Synthetic peptide
  XENP018584 vhCDR2
EIRLASNNYATHYAEPVKG

SEQ ID NO: 11823 - protein, 11 aa, Artificial Sequence
  Description of Artificial Sequence: Synthetic peptide
  XENP018584 vhCDR3
YYGNYGGYFDV

SEQ ID NO: 11824 - protein, 11 aa, Artificial Sequence
  Description of Artificial Sequence: Synthetic peptide
  XENP018584 vlCDR1
RASQSVSNDVA

SEQ ID NO: 11825 - protein, 7 aa, Artificial Sequence
  Description of Artificial Sequence: Synthetic peptide
  XENP018584 vlCDR2
YASHRYT

SEQ ID NO: 11826 - protein, 9 aa, Artificial Sequence
  Description of Artificial Sequence: Synthetic peptide
  XENP018584 vlCDR3
QQDYSSPRT

SEQ ID NO: 11827 - protein, 249 aa, Artificial Sequence
  Description of Artificial Sequence: Synthetic polypeptide
  XENP018585 1G6_H1.89_L1_scFv(GKPGS)4
EVQLVESGGGLVKPGGSLRLSCAASGFTFSNYWMNWVRQAPGKGLEWVGEIRLGSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 11828 - protein, 122 aa, Artificial Sequence
  Description of Artificial Sequence: Synthetic polypeptide
  VH of XENP018585
EVQLVESGGGLVKPGGSLRLSCAASGFTFSNYWMNWVRQAPGKGLEWVGEIRLGSNNYATHYAEPVKGRFTISRDDSKSTVYLQMNSLKTEDTAVYYCTRYYGNYGGYFDVWGAGTLVTVSS

SEQ ID NO: 11829 - protein, 107 aa, Artificial Sequence; identical to SEQ ID NO: 10923
  Description of Artificial Sequence: Synthetic polypeptide
  VL of XENP018585

SEQ ID NO: 11830 - protein, 5 aa, Artificial Sequence
  Description of Artificial Sequence: Synthetic peptide
  XENP018585 vhCDR1
NYWMN

SEQ ID NO: 11831 - protein, 19 aa, Artificial Sequence
  Description of Artificial Sequence: Synthetic peptide
  XENP018585 vhCDR2
EIRLGSNNYATHYAEPVKG

SEQ ID NO: 11832 - protein, 11 aa, Artificial Sequence
  Description of Artificial Sequence: Synthetic peptide
  XENP018585 vhCDR3
YYGNYGGYFDV

SEQ ID NO: 11833 - protein, 11 aa, Artificial Sequence
  Description of Artificial Sequence: Synthetic peptide
  XENP018585 vlCDR1
RASQSVSNDVA

SEQ ID NO: 11834 - protein, 7 aa, Artificial Sequence
  Description of Artificial Sequence: Synthetic peptide
  XENP018585 vlCDR2
YASHRYT

SEQ ID NO: 11835 - protein, 9 aa, Artificial Sequence
  Description of Artificial Sequence: Synthetic peptide
  XENP018585 vlCDR3
QQDYSSPRT

SEQ ID NO: 11836 - protein, 249 aa, Artificial Sequence
  Description of Artificial Sequence: Synthetic polypeptide
  XENP018586 1G6_H1.90_L1_scFv(GKPGS)4
EVQLVESGGGLVKPGGSLRLSCAASGFTFSNYWMNWVRQAPGKGLEWVGEIRLYSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 11837 - protein, 122 aa, Artificial Sequence
  Description of Artificial Sequence: Synthetic polypeptide
  VH of XENP018586
EVQLVESGGGLVKPGGSLRLSCAASGFTFSNYWMNWVRQAPGKGLEWVGEIRLYSNNYATHYAEPVKGRFTISRDDSKSTVYLQMNSLKTEDTAVYYCTRYYGNYGGYFDVWGAGTLVTVSS

SEQ ID NO: 11838 - protein, 107 aa, Artificial Sequence; identical to SEQ ID NO: 10923
  Description of Artificial Sequence: Synthetic polypeptide
  VL of XENP018586

SEQ ID NO: 11839 - protein, 5 aa, Artificial Sequence
  Description of Artificial Sequence: Synthetic peptide
  XENP018586 vhCDR1
NYWMN

SEQ ID NO: 11840 - protein, 19 aa, Artificial Sequence
  Description of Artificial Sequence: Synthetic peptide
  XENP018586 vhCDR2
EIRLYSNNYATHYAEPVKG

SEQ ID NO: 11841 - protein, 11 aa, Artificial Sequence
  Description of Artificial Sequence: Synthetic peptide
  XENP018586 vhCDR3
YYGNYGGYFDV

SEQ ID NO: 11842 - protein, 11 aa, Artificial Sequence
  Description of Artificial Sequence: Synthetic peptide
  XENP018586 vlCDR1
RASQSVSNDVA

SEQ ID NO: 11843 - protein, 7 aa, Artificial Sequence
  Description of Artificial Sequence: Synthetic peptide
  XENP018586 vlCDR2
YASHRYT

SEQ ID NO: 11844 - protein, 9 aa, Artificial Sequence
  Description of Artificial Sequence: Synthetic peptide
  XENP018586 vlCDR3
QQDYSSPRT

SEQ ID NO: 11845 - protein, 249 aa, Artificial Sequence
  Description of Artificial Sequence: Synthetic polypeptide
  XENP018587 1G6_H1.91_L1_scFv(GKPGS)4
EVQLVESGGGLVKPGGSLRLSCAASGFTFSNYWMNWVRQAPGKGLEWVGEIRLISNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 11846 - protein, 122 aa, Artificial Sequence
  Description of Artificial Sequence: Synthetic polypeptide
  VH of XENP018587
EVQLVESGGGLVKPGGSLRLSCAASGFTFSNYWMNWVRQAPGKGLEWVGEIRLISNNYATHYAEPVKGRFTISRDDSKSTVYLQMNSLKTEDTAVYYCTRYYGNYGGYFDVWGAGTLVTVSS

SEQ ID NO: 11847 - protein, 107 aa, Artificial Sequence; identical to SEQ ID NO: 10923
  Description of Artificial Sequence: Synthetic polypeptide
  VL of XENP018587

SEQ ID NO: 11848 - protein, 5 aa, Artificial Sequence
  Description of Artificial Sequence: Synthetic peptide
  XENP018587 vhCDR1
NYWMN

SEQ ID NO: 11849 - protein, 19 aa, Artificial Sequence
  Description of Artificial Sequence: Synthetic peptide
  XENP018587 vhCDR2
EIRLISNNYATHYAEPVKG

SEQ ID NO: 11850 - protein, 11 aa, Artificial Sequence
  Description of Artificial Sequence: Synthetic peptide
  XENP018587 vhCDR3
YYGNYGGYFDV

SEQ ID NO: 11851 - protein, 11 aa, Artificial Sequence
  Description of Artificial Sequence: Synthetic peptide
  XENP018587 vlCDR1
RASQSVSNDVA

SEQ ID NO: 11852 - protein, 7 aa, Artificial Sequence
  Description of Artificial Sequence: Synthetic peptide
  XENP018587 vlCDR2
YASHRYT

SEQ ID NO: 11853 - protein, 9 aa, Artificial Sequence
  Description of Artificial Sequence: Synthetic peptide
  XENP018587 vlCDR3
QQDYSSPRT

SEQ ID NO: 11854 - protein, 249 aa, Artificial Sequence
  Description of Artificial Sequence: Synthetic polypeptide
  XENP018588 1G6_H1.92_L1_scFv(GKPGS)4
EVQLVESGGGLVKPGGSLRLSCAASGFTFSNYWMNWVRQAPGKGLEWVGEIRLKTNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 11855 - protein, 122 aa, Artificial Sequence
  Description of Artificial Sequence: Synthetic polypeptide
  VH of XENP018588
EVQLVESGGGLVKPGGSLRLSCAASGFTFSNYWMNWVRQAPGKGLEWVGEIRLKTNNYATHYAEPVKGRFTISRDDSKSTVYLQMNSLKTEDTAVYYCTRYYGNYGGYFDVWGAGTLVTVSS

SEQ ID NO: 11856 - protein, 107 aa, Artificial Sequence; identical to SEQ ID NO: 10923
  Description of Artificial Sequence: Synthetic polypeptide
  VL of XENP018588

SEQ ID NO: 11857 - protein, 5 aa, Artificial Sequence
  Description of Artificial Sequence: Synthetic peptide
  XENP018588 vhCDR1
NYWMN

SEQ ID NO: 11858 - protein, 19 aa, Artificial Sequence
  Description of Artificial Sequence: Synthetic peptide
  XENP018588 vhCDR2
EIRLKTNNYATHYAEPVKG

SEQ ID NO: 11859 - protein, 11 aa, Artificial Sequence
  Description of Artificial Sequence: Synthetic peptide
  XENP018588 vhCDR3
YYGNYGGYFDV

SEQ ID NO: 11860 - protein, 11 aa, Artificial Sequence
  Description of Artificial Sequence: Synthetic peptide
  XENP018588 vlCDR1
RASQSVSNDVA

SEQ ID NO: 11861 - protein, 7 aa, Artificial Sequence
  Description of Artificial Sequence: Synthetic peptide
  XENP018588 vlCDR2
YASHRYT

SEQ ID NO: 11862 - protein, 9 aa, Artificial Sequence
  Description of Artificial Sequence: Synthetic peptide
  XENP018588 vlCDR3
QQDYSSPRT

SEQ ID NO: 11863 - protein, 249 aa, Artificial Sequence
  Description of Artificial Sequence: Synthetic polypeptide
  XENP018589 1G6_H1.93_L1_scFv(GKPGS)4
EVQLVESGGGLVKPGGSLRLSCAASGFTFSNYWMNWVRQAPGKGLEWVGEIRLKANNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 11864 - protein, 122 aa, Artificial Sequence
  Description of Artificial Sequence: Synthetic polypeptide
  VH of XENP018589
EVQLVESGGGLVKPGGSLRLSCAASGFTFSNYWMNWVRQAPGKGLEWVGEIRLKANNYATHYAEPVKGRFTISRDDSKSTVYLQMNSLKTEDTAVYYCTRYYGNYGGYFDVWGAGTLVTVSS

SEQ ID NO: 11865 - protein, 107 aa, Artificial Sequence; identical to SEQ ID NO: 10923
  Description of Artificial Sequence: Synthetic polypeptide
  VL of XENP018589

SEQ ID NO: 11866 - protein, 5 aa, Artificial Sequence
  Description of Artificial Sequence: Synthetic peptide
  XENP018589 vhCDR1
NYWMN

SEQ ID NO: 11867 - protein, 19 aa, Artificial Sequence
  Description of Artificial Sequence: Synthetic peptide
  XENP018589 vhCDR2
EIRLKANNYATHYAEPVKG

SEQ ID NO: 11868 - protein, 11 aa, Artificial Sequence
  Description of Artificial Sequence: Synthetic peptide
  XENP018589 vhCDR3
YYGNYGGYFDV

SEQ ID NO: 11869 - protein, 11 aa, Artificial Sequence
  Description of Artificial Sequence: Synthetic peptide
  XENP018589 vlCDR1
RASQSVSNDVA

SEQ ID NO: 11870 - protein, 7 aa, Artificial Sequence
  Description of Artificial Sequence: Synthetic peptide
  XENP018589 vlCDR2
YASHRYT

SEQ ID NO: 11871 - protein, 9 aa, Artificial Sequence
  Description of Artificial Sequence: Synthetic peptide
  XENP018589 vlCDR3
QQDYSSPRT

SEQ ID NO: 11872 - protein, 249 aa, Artificial Sequence
  Description of Artificial Sequence: Synthetic polypeptide
  XENP018590 1G6_H1.94_L1_scFv(GKPGS)4
EVQLVESGGGLVKPGGSLRLSCAASGFTFSNYWMNWVRQAPGKGLEWVGEIRLKQNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 11873 - protein, 122 aa, Artificial Sequence
  Description of Artificial Sequence: Synthetic polypeptide
  VH of XENP018590
EVQLVESGGGLVKPGGSLRLSCAASGFTFSNYWMNWVRQAPGKGLEWVGEIRLKQNNYATHYAEPVKGRFTISRDDSKSTVYLQMNSLKTEDTAVYYCTRYYGNYGGYFDVWGAGTLVTVSS

SEQ ID NO: 11874 - protein, 107 aa, Artificial Sequence; identical to SEQ ID NO: 10923
  Description of Artificial Sequence: Synthetic polypeptide
  VL of XENP018590

SEQ ID NO: 11875 - protein, 5 aa, Artificial Sequence
  Description of Artificial Sequence: Synthetic peptide
  XENP018590 vhCDR1
NYWMN

SEQ ID NO: 11876 - protein, 19 aa, Artificial Sequence
  Description of Artificial Sequence: Synthetic peptide
  XENP018590 vhCDR2
EIRLKQNNYATHYAEPVKG

SEQ ID NO: 11877 - protein, 11 aa, Artificial Sequence
  Description of Artificial Sequence: Synthetic peptide
  XENP018590 vhCDR3
YYGNYGGYFDV

SEQ ID NO: 11878 - protein, 11 aa, Artificial Sequence
  Description of Artificial Sequence: Synthetic peptide
  XENP018590 vlCDR1
RASQSVSNDVA

SEQ ID NO: 11879 - protein, 7 aa, Artificial Sequence
  Description of Artificial Sequence: Synthetic peptide
  XENP018590 vlCDR2
YASHRYT

SEQ ID NO: 11880 - protein, 9 aa, Artificial Sequence
  Description of Artificial Sequence: Synthetic peptide
  XENP018590 vlCDR3
QQDYSSPRT

SEQ ID NO: 11881 - protein, 249 aa, Artificial Sequence
  Description of Artificial Sequence: Synthetic polypeptide
  XENP018591 1G6_H1.95_L1_scFv(GKPGS)4
EVQLVESGGGLVKPGGSLRLSCAASGFTFSNYWMNWVRQAPGKGLEWVGEIRLKGNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 11882 - protein, 122 aa, Artificial Sequence
  Description of Artificial Sequence: Synthetic polypeptide
  VH of XENP018591
EVQLVESGGGLVKPGGSLRLSCAASGFTFSNYWMNWVRQAPGKGLEWVGEIRLKGNNYATHYAEPVKGRFTISRDDSKSTVYLQMNSLKTEDTAVYYCTRYYGNYGGYFDVWGAGTLVTVSS

SEQ ID NO: 11883 - protein, 107 aa, Artificial Sequence; identical to SEQ ID NO: 10923
  Description of Artificial Sequence: Synthetic polypeptide
  VL of XENP018591

SEQ ID NO: 11884 - protein, 5 aa, Artificial Sequence
  Description of Artificial Sequence: Synthetic peptide
  XENP018591 vhCDR1
NYWMN

SEQ ID NO: 11885 - protein, 19 aa, Artificial Sequence
  Description of Artificial Sequence: Synthetic peptide
  XENP018591 vhCDR2
EIRLKGNNYATHYAEPVKG

SEQ ID NO: 11886 - protein, 11 aa, Artificial Sequence
  Description of Artificial Sequence: Synthetic peptide
  XENP018591 vhCDR3
YYGNYGGYFDV

SEQ ID NO: 11887 - protein, 11 aa, Artificial Sequence
  Description of Artificial Sequence: Synthetic peptide
  XENP018591 vlCDR1
RASQSVSNDVA

SEQ ID NO: 11888 - protein, 7 aa, Artificial Sequence
  Description of Artificial Sequence: Synthetic peptide
  XENP018591 vlCDR2
YASHRYT

SEQ ID NO: 11889 - protein, 9 aa, Artificial Sequence
  Description of Artificial Sequence: Synthetic peptide
  XENP018591 vlCDR3
QQDYSSPRT

SEQ ID NO: 11890 - protein, 249 aa, Artificial Sequence
  Description of Artificial Sequence: Synthetic polypeptide
  XENP018592 1G6_H1.96_L1_scFv(GKPGS)4
EVQLVESGGGLVKPGGSLRLSCAASGFTFSNYWMNWVRQAPGKGLEWVGEIRLKVNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 11891 - protein, 122 aa, Artificial Sequence
  Description of Artificial Sequence: Synthetic polypeptide
  VH of XENP018592
EVQLVESGGGLVKPGGSLRLSCAASGFTFSNYWMNWVRQAPGKGLEWVGEIRLKVNNYATHYAEPVKGRFTISRDDSKSTVYLQMNSLKTEDTAVYYCTRYYGNYGGYFDVWGAGTLVTVSS

SEQ ID NO: 11892 - protein, 107 aa, Artificial Sequence; identical to SEQ ID NO: 10923
  Description of Artificial Sequence: Synthetic polypeptide
  VL of XENP018592

SEQ ID NO: 11893 - protein, 5 aa, Artificial Sequence
  Description of Artificial Sequence: Synthetic peptide
  XENP018592 vhCDR1
NYWMN

SEQ ID NO: 11894 - protein, 19 aa, Artificial Sequence
  Description of Artificial Sequence: Synthetic peptide
  XENP018592 vhCDR2
EIRLKVNNYATHYAEPVKG

SEQ ID NO: 11895 - protein, 11 aa, Artificial Sequence
  Description of Artificial Sequence: Synthetic peptide
  XENP018592 vhCDR3
YYGNYGGYFDV

SEQ ID NO: 11896 - protein, 11 aa, Artificial Sequence
  Description of Artificial Sequence: Synthetic peptide
  XENP018592 vlCDR1
RASQSVSNDVA

SEQ ID NO: 11897 - protein, 7 aa, Artificial Sequence
  Description of Artificial Sequence: Synthetic peptide
  XENP018592 vlCDR2
YASHRYT

SEQ ID NO: 11898 - protein, 9 aa, Artificial Sequence
  Description of Artificial Sequence: Synthetic peptide
  XENP018592 vlCDR3
QQDYSSPRT

SEQ ID NO: 11899 - protein, 249 aa, Artificial Sequence
  Description of Artificial Sequence: Synthetic polypeptide
  XENP018593 1G6_H1.97_L1_scFv(GKPGS)4
EVQLVESGGGLVKPGGSLRLSCAASGFTFSNYWMNWVRQAPGKGLEWVGEIRLKHNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 11900 - protein, 122 aa, Artificial Sequence
  Description of Artificial Sequence: Synthetic polypeptide
  VH of XENP018593
EVQLVESGGGLVKPGGSLRLSCAASGFTFSNYWMNWVRQAPGKGLEWVGEIRLKHNNYATHYAEPVKGRFTISRDDSKSTVYLQMNSLKTEDTAVYYCTRYYGNYGGYFDVWGAGTLVTVSS

SEQ ID NO: 11901 - protein, 107 aa, Artificial Sequence; identical to SEQ ID NO: 10923
  Description of Artificial Sequence: Synthetic polypeptide
  VL of XENP018593

SEQ ID NO: 11902 - protein, 5 aa, Artificial Sequence
  Description of Artificial Sequence: Synthetic peptide
  XENP018593 vhCDR1
NYWMN

SEQ ID NO: 11903 - protein, 19 aa, Artificial Sequence
  Description of Artificial Sequence: Synthetic peptide
  XENP018593 vhCDR2
EIRLKHNNYATHYAEPVKG

SEQ ID NO: 11904 - protein, 11 aa, Artificial Sequence
  Description of Artificial Sequence: Synthetic peptide
  XENP018593 vhCDR3
YYGNYGGYFDV

SEQ ID NO: 11905 - protein, 11 aa, Artificial Sequence
  Description of Artificial Sequence: Synthetic peptide
  XENP018593 vlCDR1
RASQSVSNDVA

SEQ ID NO: 11906 - protein, 7 aa, Artificial Sequence
  Description of Artificial Sequence: Synthetic peptide
  XENP018593 vlCDR2
YASHRYT

SEQ ID NO: 11907 - protein, 9 aa, Artificial Sequence
  Description of Artificial Sequence: Synthetic peptide
  XENP018593 vlCDR3
QQDYSSPRT

SEQ ID NO: 11908 - protein, 249 aa, Artificial Sequence
  Description of Artificial Sequence: Synthetic polypeptide
  XENP018594 1G6_H1.98_L1_scFv(GKPGS)4
EVQLVESGGGLVKPGGSLRLSCAASGFTFSNYWMNWVRQAPGKGLEWVGEIRLKDNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 11909 - protein, 122 aa, Artificial Sequence
  Description of Artificial Sequence: Synthetic polypeptide
  VH of XENP018594
EVQLVESGGGLVKPGGSLRLSCAASGFTFSNYWMNWVRQAPGKGLEWVGEIRLKDNNYATHYAEPVKGRFTISRDDSKSTVYLQMNSLKTEDTAVYYCTRYYGNYGGYFDVWGAGTLVTVSS

SEQ ID NO: 11910 - protein, 107 aa, Artificial Sequence; identical to SEQ ID NO: 10923
  Description of Artificial Sequence: Synthetic polypeptide
  VL of XENP018594

SEQ ID NO: 11911 - protein, 5 aa, Artificial Sequence
  Description of Artificial Sequence: Synthetic peptide
  XENP018594 vhCDR1
NYWMN

SEQ ID NO: 11912 - protein, 19 aa, Artificial Sequence
  Description of Artificial Sequence: Synthetic peptide
  XENP018594 vhCDR2
EIRLKDNNYATHYAEPVKG

SEQ ID NO: 11913 - protein, 11 aa, Artificial Sequence
  Description of Artificial Sequence: Synthetic peptide
  XENP018594 vhCDR3
YYGNYGGYFDV

SEQ ID NO: 11914 - protein, 11 aa, Artificial Sequence
  Description of Artificial Sequence: Synthetic peptide
  XENP018594 vlCDR1
RASQSVSNDVA

SEQ ID NO: 11915 - protein, 7 aa, Artificial Sequence
  Description of Artificial Sequence: Synthetic peptide
  XENP018594 vlCDR2
YASHRYT

SEQ ID NO: 11916 - protein, 9 aa, Artificial Sequence
  Description of Artificial Sequence: Synthetic peptide
  XENP018594 vlCDR3
QQDYSSPRT

SEQ ID NO: 11917 - protein, 249 aa, Artificial Sequence
  Description of Artificial Sequence: Synthetic polypeptide
  XENP018595 1G6_H1.99_L1_scFv(GKPGS)4
EVQLVESGGGLVKPGGSLRLSCAASGFTFSNYWMNWVRQAPGKGLEWVGEIRLKKNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 11918 - protein, 122 aa, Artificial Sequence
  Description of Artificial Sequence: Synthetic polypeptide
  VH of XENP018595
EVQLVESGGGLVKPGGSLRLSCAASGFTFSNYWMNWVRQAPGKGLEWVGEIRLKKNNYATHYAEPVKGRFTISRDDSKSTVYLQMNSLKTEDTAVYYCTRYYGNYGGYFDVWGAGTLVTVSS

SEQ ID NO: 11919 - protein, 107 aa, Artificial Sequence; identical to SEQ ID NO: 10923
  Description of Artificial Sequence: Synthetic polypeptide
  VL of XENP018595

SEQ ID NO: 11920 - protein, 5 aa, Artificial Sequence
  Description of Artificial Sequence: Synthetic peptide
  XENP018595 vhCDR1
NYWMN

SEQ ID NO: 11921 - protein, 19 aa, Artificial Sequence
  Description of Artificial Sequence: Synthetic peptide
  XENP018595 vhCDR2
EIRLKKNNYATHYAEPVKG

SEQ ID NO: 11922 - protein, 11 aa, Artificial Sequence
  Description of Artificial Sequence: Synthetic peptide
  XENP018595 vhCDR3
YYGNYGGYFDV

SEQ ID NO: 11923 - protein, 11 aa, Artificial Sequence
  Description of Artificial Sequence: Synthetic peptide
  XENP018595 vlCDR1
RASQSVSNDVA

SEQ ID NO: 11924 - protein, 7 aa, Artificial Sequence
  Description of Artificial Sequence: Synthetic peptide
  XENP018595 vlCDR2
YASHRYT

SEQ ID NO: 11925 - protein, 9 aa, Artificial Sequence
  Description of Artificial Sequence: Synthetic peptide
  XENP018595 vlCDR3
QQDYSSPRT

SEQ ID NO: 11926 - protein, 249 aa, Artificial Sequence
  Description of Artificial Sequence: Synthetic polypeptide
  XENP018596 1G6_H1.100_L1_scFv(GKPGS)4
EVQLVESGGGLVKPGGSLRLSCAASGFTFSNYWMNWVRQAPGKGLEWVGEIRLKYNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 11927 - protein, 122 aa, Artificial Sequence
  Description of Artificial Sequence: Synthetic polypeptide
  VH of XENP018596
EVQLVESGGGLVKPGGSLRLSCAASGFTFSNYWMNWVRQAPGKGLEWVGEIRLKYNNYATHYAEPVKGRFTISRDDSKSTVYLQMNSLKTEDTAVYYCTRYYGNYGGYFDVWGAGTLVTVSS

SEQ ID NO: 11928 - protein, 107 aa, Artificial Sequence; identical to SEQ ID NO: 10923
  Description of Artificial Sequence: Synthetic polypeptide
  VL of XENP018596

SEQ ID NO: 11929 - protein, 5 aa, Artificial Sequence
  Description of Artificial Sequence: Synthetic peptide
  XENP018596 vhCDR1
NYWMN

SEQ ID NO: 11930 - protein, 19 aa, Artificial Sequence
  Description of Artificial Sequence: Synthetic peptide
  XENP018596 vhCDR2
EIRLKYNNYATHYAEPVKG

SEQ ID NO: 11931 - protein, 11 aa, Artificial Sequence
  Description of Artificial Sequence: Synthetic peptide
  XENP018596 vhCDR3
YYGNYGGYFDV

SEQ ID NO: 11932 - protein, 11 aa, Artificial Sequence
  Description of Artificial Sequence: Synthetic peptide
  XENP018596 vlCDR1
RASQSVSNDVA

SEQ ID NO: 11933 - protein, 7 aa, Artificial Sequence
  Description of Artificial Sequence: Synthetic peptide
  XENP018596 vlCDR2
YASHRYT

SEQ ID NO: 11934 - protein, 9 aa, Artificial Sequence
  Description of Artificial Sequence: Synthetic peptide
  XENP018596 vlCDR3
QQDYSSPRT

SEQ ID NO: 11935 - protein, 249 aa, Artificial Sequence
  Description of Artificial Sequence: Synthetic polypeptide
  XENP018601 1G6_H1.101_L1_scFv(GKPGS)4
EVQLVESGGGLVKPGGSLRLSCAASGFTFSNYWMNWVRQAPGKGLEWVGEIRLKSDNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 11936 - protein, 122 aa, Artificial Sequence
  Description of Artificial Sequence: Synthetic polypeptide
  VH of XENP018601
EVQLVESGGGLVKPGGSLRLSCAASGFTFSNYWMNWVRQAPGKGLEWVGEIRLKSDNYATHYAEPVKGRFTISRDDSKSTVYLQMNSLKTEDTAVYYCTRYYGNYGGYFDVWGAGTLVTVSS

SEQ ID NO: 11937 - protein, 107 aa, Artificial Sequence; identical to SEQ ID NO: 10923
  Description of Artificial Sequence: Synthetic polypeptide
  VL of XENP018601

SEQ ID NO: 11938 - protein, 5 aa, Artificial Sequence
  Description of Artificial Sequence: Synthetic peptide
  XENP018601 vhCDR1
NYWMN

SEQ ID NO: 11939 - protein, 19 aa, Artificial Sequence
  Description of Artificial Sequence: Synthetic peptide
  XENP018601 vhCDR2
EIRLKSDNYATHYAEPVKG

SEQ ID NO: 11940 - protein, 11 aa, Artificial Sequence
  Description of Artificial Sequence: Synthetic peptide
  XENP018601 vhCDR3
YYGNYGGYFDV

SEQ ID NO: 11941 - protein, 11 aa, Artificial Sequence
  Description of Artificial Sequence: Synthetic peptide
  XENP018601 vlCDR1
RASQSVSNDVA

SEQ ID NO: 11942 - protein, 7 aa, Artificial Sequence
  Description of Artificial Sequence: Synthetic peptide
  XENP018601 vlCDR2
YASHRYT

SEQ ID NO: 11943 - protein, 9 aa, Artificial Sequence
  Description of Artificial Sequence: Synthetic peptide
  XENP018601 vlCDR3
QQDYSSPRT

SEQ ID NO: 11944 - protein, 249 aa, Artificial Sequence
  Description of Artificial Sequence: Synthetic polypeptide
  XENP018602 1G6_H1.102_L1_scFv(GKPGS)4
EVQLVESGGGLVKPGGSLRLSCAASGFTFSNYWMNWVRQAPGKGLEWVGEIRLKSHNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 11945 - protein, 122 aa, Artificial Sequence
  Description of Artificial Sequence: Synthetic polypeptide
  VH of XENP018602
EVQLVESGGGLVKPGGSLRLSCAASGFTFSNYWMNWVRQAPGKGLEWVGEIRLKSHNYATHYAEPVKGRFTISRDDSKSTVYLQMNSLKTEDTAVYYCTRYYGNYGGYFDVWGAGTLVTVSS

SEQ ID NO: 11946 - protein, 107 aa, Artificial Sequence; identical to SEQ ID NO: 10923
  Description of Artificial Sequence: Synthetic polypeptide
  VL of XENP018602

SEQ ID NO: 11947 - protein, 5 aa, Artificial Sequence
  Description of Artificial Sequence: Synthetic peptide
  XENP018602 vhCDR1
NYWMN

SEQ ID NO: 11948 - protein, 19 aa, Artificial Sequence
  Description of Artificial Sequence: Synthetic peptide
  XENP018602 vhCDR2
EIRLKSHNYATHYAEPVKG

SEQ ID NO: 11949 - protein, 11 aa, Artificial Sequence
  Description of Artificial Sequence: Synthetic peptide
  XENP018602 vhCDR3
YYGNYGGYFDV

SEQ ID NO: 11950 - protein, 11 aa, Artificial Sequence
  Description of Artificial Sequence: Synthetic peptide
  XENP018602 vlCDR1
RASQSVSNDVA

SEQ ID NO: 11951 - protein, 7 aa, Artificial Sequence
  Description of Artificial Sequence: Synthetic peptide
  XENP018602 vlCDR2
YASHRYT

SEQ ID NO: 11952 - protein, 9 aa, Artificial Sequence
  Description of Artificial Sequence: Synthetic peptide
  XENP018602 vlCDR3
QQDYSSPRT

SEQ ID NO: 11953 - protein, 249 aa, Artificial Sequence
  Description of Artificial Sequence: Synthetic polypeptide
  XENP018603 1G6_H1.103_L1_scFv(GKPGS)4
EVQLVESGGGLVKPGGSLRLSCAASGFTFSNYWMNWVRQAPGKGLEWVGEIRLKSENYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 11954 - protein, 122 aa, Artificial Sequence
  Description of Artificial Sequence: Synthetic polypeptide
  VH of XENP018603
EVQLVESGGGLVKPGGSLRLSCAASGFTFSNYWMNWVRQAPGKGLEWVGEIRLKSENYATHYAEPVKGRFTISRDDSKSTVYLQMNSLKTEDTAVYYCTRYYGNYGGYFDVWGAGTLVTVSS

SEQ ID NO: 11955 - protein, 107 aa, Artificial Sequence; identical to SEQ ID NO: 10923
  Description of Artificial Sequence: Synthetic polypeptide
  VL of XENP018603

SEQ ID NO: 11956 - protein, 5 aa, Artificial Sequence
  Description of Artificial Sequence: Synthetic peptide
  XENP018603 vhCDR1
NYWMN

SEQ ID NO: 11957 - protein, 19 aa, Artificial Sequence
  Description of Artificial Sequence: Synthetic peptide
  XENP018603 vhCDR2
EIRLKSENYATHYAEPVKG

SEQ ID NO: 11958 - protein, 11 aa, Artificial Sequence
  Description of Artificial Sequence: Synthetic peptide
  XENP018603 vhCDR3
YYGNYGGYFDV

SEQ ID NO: 11959 - protein, 11 aa, Artificial Sequence
  Description of Artificial Sequence: Synthetic peptide
  XENP018603 vlCDR1
RASQSVSNDVA

SEQ ID NO: 11960 - protein, 7 aa, Artificial Sequence
  Description of Artificial Sequence: Synthetic peptide
  XENP018603 vlCDR2
YASHRYT

SEQ ID NO: 11961 - protein, 9 aa, Artificial Sequence
  Description of Artificial Sequence: Synthetic peptide
  XENP018603 vlCDR3
QQDYSSPRT

SEQ ID NO: 11962 - protein, 249 aa, Artificial Sequence
  Description of Artificial Sequence: Synthetic polypeptide
  XENP018604 1G6_H1.104_L1_scFv(GKPGS)4
EVQLVESGGGLVKPGGSLRLSCAASGFTFSNYWMNWVRQAPGKGLEWVGEIRLKSSNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 11963 - protein, 122 aa, Artificial Sequence
  Description of Artificial Sequence: Synthetic polypeptide
  VH of XENP018604
EVQLVESGGGLVKPGGSLRLSCAASGFTFSNYWMNWVRQAPGKGLEWVGEIRLKSSNYATHYAEPVKGRFTISRDDSKSTVYLQMNSLKTEDTAVYYCTRYYGNYGGYFDVWGAGTLVTVSS

SEQ ID NO: 11964 - protein, 107 aa, Artificial Sequence; identical to SEQ ID NO: 10923
  Description of Artificial Sequence: Synthetic polypeptide
  VL of XENP018604

SEQ ID NO: 11965 - protein, 5 aa, Artificial Sequence
  Description of Artificial Sequence: Synthetic peptide
  XENP018604 vhCDR1
NYWMN

SEQ ID NO: 11966 - protein, 19 aa, Artificial Sequence
  Description of Artificial Sequence: Synthetic peptide
  XENP018604 vhCDR2
EIRLKSSNYATHYAEPVKG

SEQ ID NO: 11967 - protein, 11 aa, Artificial Sequence
  Description of Artificial Sequence: Synthetic peptide
  XENP018604 vhCDR3
YYGNYGGYFDV

SEQ ID NO: 11968 - protein, 11 aa, Artificial Sequence
  Description of Artificial Sequence: Synthetic peptide
  XENP018604 vlCDR1
RASQSVSNDVA

SEQ ID NO: 11969 - protein, 7 aa, Artificial Sequence
  Description of Artificial Sequence: Synthetic peptide
  XENP018604 vlCDR2
YASHRYT

SEQ ID NO: 11970 - protein, 9 aa, Artificial Sequence
  Description of Artificial Sequence: Synthetic peptide
  XENP018604 vlCDR3
QQDYSSPRT

SEQ ID NO: 11971 - protein, 249 aa, Artificial Sequence
  Description of Artificial Sequence: Synthetic polypeptide
  XENP018605 1G6_H1.105_L1_scFv(GKPGS)4
EVQLVESGGGLVKPGGSLRLSCAASGFTFSNYWMNWVRQAPGKGLEWVGEIRLKSRNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 11972 - protein, 122 aa, Artificial Sequence
  Description of Artificial Sequence: Synthetic polypeptide
  VH of XENP018605
EVQLVESGGGLVKPGGSLRLSCAASGFTFSNYWMNWVRQAPGKGLEWVGEIRLKSRNYATHYAEPVKGRFTISRDDSKSTVYLQMNSLKTEDTAVYYCTRYYGNYGGYFDVWGAGTLVTVSS

SEQ ID NO: 11973 - protein, 107 aa, Artificial Sequence; identical to SEQ ID NO: 10923
  Description of Artificial Sequence: Synthetic polypeptide
  VL of XENP018605

SEQ ID NO: 11974 - protein, 5 aa, Artificial Sequence
  Description of Artificial Sequence: Synthetic peptide
  XENP018605 vhCDR1
NYWMN

SEQ ID NO: 11975 - protein, 19 aa, Artificial Sequence
  Description of Artificial Sequence: Synthetic peptide
  XENP018605 vhCDR2
EIRLKSRNYATHYAEPVKG

SEQ ID NO: 11976 - protein, 11 aa, Artificial Sequence
  Description of Artificial Sequence: Synthetic peptide
  XENP018605 vhCDR3
YYGNYGGYFDV

SEQ ID NO: 11977 - protein, 11 aa, Artificial Sequence
  Description of Artificial Sequence: Synthetic peptide
  XENP018605 vlCDR1
RASQSVSNDVA

SEQ ID NO: 11978 - protein, 7 aa, Artificial Sequence
  Description of Artificial Sequence: Synthetic peptide
  XENP018605 vlCDR2
YASHRYT

SEQ ID NO: 11979 - protein, 9 aa, Artificial Sequence
  Description of Artificial Sequence: Synthetic peptide
  XENP018605 vlCDR3
QQDYSSPRT

SEQ ID NO: 11980 - protein, 249 aa, Artificial Sequence
  Description of Artificial Sequence: Synthetic polypeptide
  XENP018606 1G6_H1.106_L1_scFv(GKPGS)4
EVQLVESGGGLVKPGGSLRLSCAASGFTFSNYWMNWVRQAPGKGLEWVGEIRLKSLNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 11981 - protein, 122 aa, Artificial Sequence
  Description of Artificial Sequence: Synthetic polypeptide
  VH of XENP018606
EVQLVESGGGLVKPGGSLRLSCAASGFTFSNYWMNWVRQAPGKGLEWVGEIRLKSLNYATHYAEPVKGRFTISRDDSKSTVYLQMNSLKTEDTAVYYCTRYYGNYGGYFDVWGAGTLVTVSS

SEQ ID NO: 11982 - protein, 107 aa, Artificial Sequence; identical to SEQ ID NO: 10923
  Description of Artificial Sequence: Synthetic polypeptide
  VL of XENP018606

SEQ ID NO: 11983 - protein, 5 aa, Artificial Sequence
  Description of Artificial Sequence: Synthetic peptide
  XENP018606 vhCDR1
NYWMN

SEQ ID NO: 11984 - protein, 19 aa, Artificial Sequence
  Description of Artificial Sequence: Synthetic peptide
  XENP018606 vhCDR2
EIRLKSLNYATHYAEPVKG

SEQ ID NO: 11985 - protein, 11 aa, Artificial Sequence
  Description of Artificial Sequence: Synthetic peptide
  XENP018606 vhCDR3
YYGNYGGYFDV

SEQ ID NO: 11986 - protein, 11 aa, Artificial Sequence
  Description of Artificial Sequence: Synthetic peptide
  XENP018606 vlCDR1
RASQSVSNDVA

SEQ ID NO: 11987 - protein, 7 aa, Artificial Sequence
  Description of Artificial Sequence: Synthetic peptide
  XENP018606 vlCDR2
YASHRYT

SEQ ID NO: 11988 - protein, 9 aa, Artificial Sequence
  Description of Artificial Sequence: Synthetic peptide
  XENP018606 vlCDR3
QQDYSSPRT

SEQ ID NO: 11989 - protein, 249 aa, Artificial Sequence
  Description of Artificial Sequence: Synthetic polypeptide
  XENP018607 1G6_H1.107_L1_scFv(GKPGS)4
EVQLVESGGGLVKPGGSLRLSCAASGFTFSNYWMNWVRQAPGKGLEWVGEIRLKSTNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 11990 - protein, 122 aa, Artificial Sequence
  Description of Artificial Sequence: Synthetic polypeptide
  VH of XENP018607
EVQLVESGGGLVKPGGSLRLSCAASGFTFSNYWMNWVRQAPGKGLEWVGEIRLKSTNYATHYAEPVKGRFTISRDDSKSTVYLQMNSLKTEDTAVYYCTRYYGNYGGYFDVWGAGTLVTVSS

SEQ ID NO: 11991 - protein, 107 aa, Artificial Sequence; identical to SEQ ID NO: 10923
  Description of Artificial Sequence: Synthetic polypeptide
  VL of XENP018607

SEQ ID NO: 11992 - protein, 5 aa, Artificial Sequence
  Description of Artificial Sequence: Synthetic peptide
  XENP018607 vhCDR1
NYWMN

SEQ ID NO: 11993 - protein, 19 aa, Artificial Sequence
  Description of Artificial Sequence: Synthetic peptide
  XENP018607 vhCDR2
EIRLKSTNYATHYAEPVKG

SEQ ID NO: 11994 - protein, 11 aa, Artificial Sequence
  Description of Artificial Sequence: Synthetic peptide
  XENP018607 vhCDR3
YYGNYGGYFDV

SEQ ID NO: 11995 - protein, 11 aa, Artificial Sequence
  Description of Artificial Sequence: Synthetic peptide
  XENP018607 vlCDR1
RASQSVSNDVA

SEQ ID NO: 11996 - protein, 7 aa, Artificial Sequence
  Description of Artificial Sequence: Synthetic peptide
  XENP018607 vlCDR2
YASHRYT

SEQ ID NO: 11997 - protein, 9 aa, Artificial Sequence
  Description of Artificial Sequence: Synthetic peptide
  XENP018607 vlCDR3
QQDYSSPRT

SEQ ID NO: 11998 - protein, 249 aa, Artificial Sequence
  Description of Artificial Sequence: Synthetic polypeptide
  XENP018608 1G6_H1.108_L1_scFv(GKPGS)4
EVQLVESGGGLVKPGGSLRLSCAASGFTFSNYWMNWVRQAPGKGLEWVGEIRLKSGNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 11999 - protein, 122 aa, Artificial Sequence
  Description of Artificial Sequence: Synthetic polypeptide
  VH of XENP018608
EVQLVESGGGLVKPGGSLRLSCAASGFTFSNYWMNWVRQAPGKGLEWVGEIRLKSGNYATHYAEPVKGRFTISRDDSKSTVYLQMNSLKTEDTAVYYCTRYYGNYGGYFDVWGAGTLVTVSS

SEQ ID NO: 12000 - protein, 107 aa, Artificial Sequence; identical to SEQ ID NO: 10923
  Description of Artificial Sequence: Synthetic polypeptide
  VL of XENP018608

SEQ ID NO: 12001 - protein, 5 aa, Artificial Sequence
  Description of Artificial Sequence: Synthetic peptide
  XENP018608 vhCDR1
NYWMN

SEQ ID NO: 12002 - protein, 19 aa, Artificial Sequence
  Description of Artificial Sequence: Synthetic peptide
  XENP018608 vhCDR2
EIRLKSGNYATHYAEPVKG

SEQ ID NO: 12003 - protein, 11 aa, Artificial Sequence
  Description of Artificial Sequence: Synthetic peptide
  XENP018608 vhCDR3
YYGNYGGYFDV

SEQ ID NO: 12004 - protein, 11 aa, Artificial Sequence
  Description of Artificial Sequence: Synthetic peptide
  XENP018608 vlCDR1
RASQSVSNDVA

SEQ ID NO: 12005 - protein, 7 aa, Artificial Sequence
  Description of Artificial Sequence: Synthetic peptide
  XENP018608 vlCDR2
YASHRYT

SEQ ID NO: 12006 - protein, 9 aa, Artificial Sequence
  Description of Artificial Sequence: Synthetic peptide
  XENP018608 vlCDR3
QQDYSSPRT

SEQ ID NO: 12007 - protein, 249 aa, Artificial Sequence
  Description of Artificial Sequence: Synthetic polypeptide
  XENP018609 1G6_H1.109_L1_scFv(GKPGS)4
EVQLVESGGGLVKPGGSLRLSCAASGFTFSNYWMNWVRQAPGKGLEWVGEIRLKSYNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 12008 - protein, 122 aa, Artificial Sequence
  Description of Artificial Sequence: Synthetic polypeptide
  VH of XENP018609
EVQLVESGGGLVKPGGSLRLSCAASGFTFSNYWMNWVRQAPGKGLEWVGEIRLKSYNYATHYAEPVKGRFTISRDDSKSTVYLQMNSLKTEDTAVYYCTRYYGNYGGYFDVWGAGTLVTVSS

SEQ ID NO: 12009 - protein, 107 aa, Artificial Sequence; identical to SEQ ID NO: 10923
  Description of Artificial Sequence: Synthetic polypeptide
  VL of XENP018609

SEQ ID NO: 12010 - protein, 5 aa, Artificial Sequence
  Description of Artificial Sequence: Synthetic peptide
  XENP018609 vhCDR1
NYWMN

SEQ ID NO: 12011 - protein, 19 aa, Artificial Sequence
  Description of Artificial Sequence: Synthetic peptide
  XENP018609 vhCDR2
EIRLKSYNYATHYAEPVKG

SEQ ID NO: 12012 - protein, 11 aa, Artificial Sequence
  Description of Artificial Sequence: Synthetic peptide
  XENP018609 vhCDR3
YYGNYGGYFDV

SEQ ID NO: 12013 - protein, 11 aa, Artificial Sequence
  Description of Artificial Sequence: Synthetic peptide
  XENP018609 vlCDR1
RASQSVSNDVA

SEQ ID NO: 12014 - protein, 7 aa, Artificial Sequence
  Description of Artificial Sequence: Synthetic peptide
  XENP018609 vlCDR2
YASHRYT

SEQ ID NO: 12015 - protein, 9 aa, Artificial Sequence
  Description of Artificial Sequence: Synthetic peptide
  XENP018609 vlCDR3
QQDYSSPRT

SEQ ID NO: 12016 - protein, 249 aa, Artificial Sequence
  Description of Artificial Sequence: Synthetic polypeptide
  XENP018610 1G6_H1.110_L1_scFv(GKPGS)4
EVQLVESGGGLVKPGGSLRLSCAASGFTFSNYWMNWVRQAPGKGLEWVGEIRLKSNDYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 12017 - protein, 122 aa, Artificial Sequence
  Description of Artificial Sequence: Synthetic polypeptide
  VH of XENP018610
EVQLVESGGGLVKPGGSLRLSCAASGFTFSNYWMNWVRQAPGKGLEWVGEIRLKSNDYATHYAEPVKGRFTISRDDSKSTVYLQMNSLKTEDTAVYYCTRYYGNYGGYFDVWGAGTLVTVSS

SEQ ID NO: 12018 - protein, 107 aa, Artificial Sequence; identical to SEQ ID NO: 10923
  Description of Artificial Sequence: Synthetic polypeptide
  VL of XENP018610

SEQ ID NO: 12019 - protein, 5 aa, Artificial Sequence
  Description of Artificial Sequence: Synthetic peptide
  XENP018610 vhCDR1
NYWMN

SEQ ID NO: 12020 - protein, 19 aa, Artificial Sequence
  Description of Artificial Sequence: Synthetic peptide
  XENP018610 vhCDR2
EIRLKSNDYATHYAEPVKG

SEQ ID NO: 12021 - protein, 11 aa, Artificial Sequence
  Description of Artificial Sequence: Synthetic peptide
  XENP018610 vhCDR3
YYGNYGGYFDV

SEQ ID NO: 12022 - protein, 11 aa, Artificial Sequence
  Description of Artificial Sequence: Synthetic peptide
  XENP018610 vlCDR1
RASQSVSNDVA

SEQ ID NO: 12023 - protein, 7 aa, Artificial Sequence
  Description of Artificial Sequence: Synthetic peptide
  XENP018610 vlCDR2
YASHRYT

SEQ ID NO: 12024 - protein, 9 aa, Artificial Sequence
  Description of Artificial Sequence: Synthetic peptide
  XENP018610 vlCDR3
QQDYSSPRT

SEQ ID NO: 12025 - protein, 249 aa, Artificial Sequence
  Description of Artificial Sequence: Synthetic polypeptide
  XENP018611 1G6_H1.111_L1_scFv(GKPGS)4
EVQLVESGGGLVKPGGSLRLSCAASGFTFSNYWMNWVRQAPGKGLEWVGEIRLKSNHYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 12026 - protein, 122 aa, Artificial Sequence
  Description of Artificial Sequence: Synthetic polypeptide
  VH of XENP018611
EVQLVESGGGLVKPGGSLRLSCAASGFTFSNYWMNWVRQAPGKGLEWVGEIRLKSNHYATHYAEPVKGRFTISRDDSKSTVYLQMNSLKTEDTAVYYCTRYYGNYGGYFDVWGAGTLVTVSS

SEQ ID NO: 12027 - protein, 107 aa, Artificial Sequence; identical to SEQ ID NO: 10923
  Description of Artificial Sequence: Synthetic polypeptide
  VL of XENP018611

SEQ ID NO: 12028 - protein, 5 aa, Artificial Sequence
  Description of Artificial Sequence: Synthetic peptide
  XENP018611 vhCDR1
NYWMN

SEQ ID NO: 12029 - protein, 19 aa, Artificial Sequence
  Description of Artificial Sequence: Synthetic peptide
  XENP018611 vhCDR2
EIRLKSNHYATHYAEPVKG

SEQ ID NO: 12030 - protein, 11 aa, Artificial Sequence
  Description of Artificial Sequence: Synthetic peptide
  XENP018611 vhCDR3
YYGNYGGYFDV

SEQ ID NO: 12031 - protein, 11 aa, Artificial Sequence
  Description of Artificial Sequence: Synthetic peptide
  XENP018611 vlCDR1
RASQSVSNDVA

SEQ ID NO: 12032 - protein, 7 aa, Artificial Sequence
  Description of Artificial Sequence: Synthetic peptide
  XENP018611 vlCDR2
YASHRYT

SEQ ID NO: 12033 - protein, 9 aa, Artificial Sequence
  Description of Artificial Sequence: Synthetic peptide
  XENP018611 vlCDR3
QQDYSSPRT

SEQ ID NO: 12034 - protein, 249 aa, Artificial Sequence
  Description of Artificial Sequence: Synthetic polypeptide
  XENP018612 1G6_H1.112_L1_scFv(GKPGS)4
EVQLVESGGGLVKPGGSLRLSCAASGFTFSNYWMNWVRQAPGKGLEWVGEIRLKSNEYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 12035 - protein, 122 aa, Artificial Sequence
  Description of Artificial Sequence: Synthetic polypeptide
  VH of XENP018612
EVQLVESGGGLVKPGGSLRLSCAASGFTFSNYWMNWVRQAPGKGLEWVGEIRLKSNEYATHYAEPVKGRFTISRDDSKSTVYLQMNSLKTEDTAVYYCTRYYGNYGGYFDVWGAGTLVTVSS

SEQ ID NO: 12036 - protein, 107 aa, Artificial Sequence; identical to SEQ ID NO: 10923
  Description of Artificial Sequence: Synthetic polypeptide
  VL of XENP018612

SEQ ID NO: 12037 - protein, 5 aa, Artificial Sequence
  Description of Artificial Sequence: Synthetic peptide
  XENP018612 vhCDR1
NYWMN

SEQ ID NO: 12038 - protein, 19 aa, Artificial Sequence
  Description of Artificial Sequence: Synthetic peptide
  XENP018612 vhCDR2
EIRLKSNEYATHYAEPVKG

SEQ ID NO: 12039 - protein, 11 aa, Artificial Sequence
  Description of Artificial Sequence: Synthetic peptide
  XENP018612 vhCDR3
YYGNYGGYFDV

SEQ ID NO: 12040 - protein, 11 aa, Artificial Sequence
  Description of Artificial Sequence: Synthetic peptide
  XENP018612 vlCDR1
RASQSVSNDVA

SEQ ID NO: 12041 - protein, 7 aa, Artificial Sequence
  Description of Artificial Sequence: Synthetic peptide
  XENP018612 vlCDR2
YASHRYT

SEQ ID NO: 12042 - protein, 9 aa, Artificial Sequence
  Description of Artificial Sequence: Synthetic peptide
  XENP018612 vlCDR3
QQDYSSPRT

SEQ ID NO: 12043 - protein, 249 aa, Artificial Sequence
  Description of Artificial Sequence: Synthetic polypeptide
  XENP018613 1G6_H1.113_L1_scFv(GKPGS)4
EVQLVESGGGLVKPGGSLRLSCAASGFTFSNYWMNWVRQAPGKGLEWVGEIRLKSNSYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 12044 - protein, 122 aa, Artificial Sequence
  Description of Artificial Sequence: Synthetic polypeptide
  VH of XENP018613
EVQLVESGGGLVKPGGSLRLSCAASGFTFSNYWMNWVRQAPGKGLEWVGEIRLKSNSYATHYAEPVKGRFTISRDDSKSTVYLQMNSLKTEDTAVYYCTRYYGNYGGYFDVWGAGTLVTVSS

SEQ ID NO: 12045 - protein, 107 aa, Artificial Sequence; identical to SEQ ID NO: 10923
  Description of Artificial Sequence: Synthetic polypeptide
  VL of XENP018613

SEQ ID NO: 12046 - protein, 5 aa, Artificial Sequence
  Description of Artificial Sequence: Synthetic peptide
  XENP018613 vhCDR1
NYWMN

SEQ ID NO: 12047 - protein, 19 aa, Artificial Sequence
  Description of Artificial Sequence: Synthetic peptide
  XENP018613 vhCDR2
EIRLKSNSYATHYAEPVKG

SEQ ID NO: 12048 - protein, 11 aa, Artificial Sequence
  Description of Artificial Sequence: Synthetic peptide
  XENP018613 vhCDR3
YYGNYGGYFDV

SEQ ID NO: 12049 - protein, 11 aa, Artificial Sequence
  Description of Artificial Sequence: Synthetic peptide
  XENP018613 vlCDR1
RASQSVSNDVA

SEQ ID NO: 12050 - protein, 7 aa, Artificial Sequence
  Description of Artificial Sequence: Synthetic peptide
  XENP018613 vlCDR2
YASHRYT

SEQ ID NO: 12051 - protein, 9 aa, Artificial Sequence
  Description of Artificial Sequence: Synthetic peptide
  XENP018613 vlCDR3
QQDYSSPRT

SEQ ID NO: 12052 - protein, 249 aa, Artificial Sequence
  Description of Artificial Sequence: Synthetic polypeptide
  XENP018614 1G6_H1.114_L1_scFv(GKPGS)4
EVQLVESGGGLVKPGGSLRLSCAASGFTFSNYWMNWVRQAPGKGLEWVGEIRLKSNRYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 12053 - protein, 122 aa, Artificial Sequence
  Description of Artificial Sequence: Synthetic polypeptide
  VH of XENP018614
EVQLVESGGGLVKPGGSLRLSCAASGFTFSNYWMNWVRQAPGKGLEWVGEIRLKSNRYATHYAEPVKGRFTISRDDSKSTVYLQMNSLKTEDTAVYYCTRYYGNYGGYFDVWGAGTLVTVSS

SEQ ID NO: 12054 - protein, 107 aa, Artificial Sequence; identical to SEQ ID NO: 10923
  Description of Artificial Sequence: Synthetic polypeptide
  VL of XENP018614

SEQ ID NO: 12055 - protein, 5 aa, Artificial Sequence
  Description of Artificial Sequence: Synthetic peptide
  XENP018614 vhCDR1
NYWMN

SEQ ID NO: 12056 - protein, 19 aa, Artificial Sequence
  Description of Artificial Sequence: Synthetic peptide
  XENP018614 vhCDR2
EIRLKSNRYATHYAEPVKG

SEQ ID NO: 12057 - protein, 11 aa, Artificial Sequence
  Description of Artificial Sequence: Synthetic peptide
  XENP018614 vhCDR3
YYGNYGGYFDV

SEQ ID NO: 12058 - protein, 11 aa, Artificial Sequence
  Description of Artificial Sequence: Synthetic peptide
  XENP018614 vlCDR1
RASQSVSNDVA

SEQ ID NO: 12059 - protein, 7 aa, Artificial Sequence
  Description of Artificial Sequence: Synthetic peptide
  XENP018614 vlCDR2
YASHRYT

SEQ ID NO: 12060 - protein, 9 aa, Artificial Sequence
  Description of Artificial Sequence: Synthetic peptide
  XENP018614 vlCDR3
QQDYSSPRT

SEQ ID NO: 12061 - protein, 249 aa, Artificial Sequence
  Description of Artificial Sequence: Synthetic polypeptide
  XENP018615 1G6_H1.115_L1_scFv(GKPGS)4
EVQLVESGGGLVKPGGSLRLSCAASGFTFSNYWMNWVRQAPGKGLEWVGEIRLKSNLYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 12062 - protein, 122 aa, Artificial Sequence
  Description of Artificial Sequence: Synthetic polypeptide
  VH of XENP018615
EVQLVESGGGLVKPGGSLRLSCAASGFTFSNYWMNWVRQAPGKGLEWVGEIRLKSNLYATHYAEPVKGRFTISRDDSKSTVYLQMNSLKTEDTAVYYCTRYYGNYGGYFDVWGAGTLVTVSS

SEQ ID NO: 12063 - protein, 107 aa, Artificial Sequence; identical to SEQ ID NO: 10923
  Description of Artificial Sequence: Synthetic polypeptide
  VL of XENP018615

SEQ ID NO: 12064 - protein, 5 aa, Artificial Sequence
  Description of Artificial Sequence: Synthetic peptide
  XENP018615 vhCDR1
NYWMN

SEQ ID NO: 12065 - protein, 19 aa, Artificial Sequence
  Description of Artificial Sequence: Synthetic peptide
  XENP018615 vhCDR2
EIRLKSNLYATHYAEPVKG

SEQ ID NO: 12066 - protein, 11 aa, Artificial Sequence
  Description of Artificial Sequence: Synthetic peptide
  XENP018615 vhCDR3
YYGNYGGYFDV

SEQ ID NO: 12067 - protein, 11 aa, Artificial Sequence
  Description of Artificial Sequence: Synthetic peptide
  XENP018615 vlCDR1
RASQSVSNDVA

SEQ ID NO: 12068 - protein, 7 aa, Artificial Sequence
  Description of Artificial Sequence: Synthetic peptide
  XENP018615 vlCDR2
YASHRYT

SEQ ID NO: 12069 - protein, 9 aa, Artificial Sequence
  Description of Artificial Sequence: Synthetic peptide
  XENP018615 vlCDR3
QQDYSSPRT

SEQ ID NO: 12070 - protein, 249 aa, Artificial Sequence
  Description of Artificial Sequence: Synthetic polypeptide
  XENP018616 1G6_H1.116_L1_scFv(GKPGS)4
EVQLVESGGGLVKPGGSLRLSCAASGFTFSNYWMNWVRQAPGKGLEWVGEIRLKSNTYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 12071 - protein, 122 aa, Artificial Sequence
  Description of Artificial Sequence: Synthetic polypeptide
  VH of XENP018616
EVQLVESGGGLVKPGGSLRLSCAASGFTFSNYWMNWVRQAPGKGLEWVGEIRLKSNTYATHYAEPVKGRFTISRDDSKSTVYLQMNSLKTEDTAVYYCTRYYGNYGGYFDVWGAGTLVTVSS

SEQ ID NO: 12072 - protein, 107 aa, Artificial Sequence; identical to SEQ ID NO: 10923
  Description of Artificial Sequence: Synthetic polypeptide
  VL of XENP018616

SEQ ID NO: 12073 - protein, 5 aa, Artificial Sequence
  Description of Artificial Sequence: Synthetic peptide
  XENP018616 vhCDR1
NYWMN

SEQ ID NO: 12074 - protein, 19 aa, Artificial Sequence
  Description of Artificial Sequence: Synthetic peptide
  XENP018616 vhCDR2
EIRLKSNTYATHYAEPVKG

SEQ ID NO: 12075 - protein, 11 aa, Artificial Sequence
  Description of Artificial Sequence: Synthetic peptide
  XENP018616 vhCDR3
YYGNYGGYFDV

SEQ ID NO: 12076 - protein, 11 aa, Artificial Sequence
  Description of Artificial Sequence: Synthetic peptide
  XENP018616 vlCDR1
RASQSVSNDVA

SEQ ID NO: 12077 - protein, 7 aa, Artificial Sequence
  Description of Artificial Sequence: Synthetic peptide
  XENP018616 vlCDR2
YASHRYT

SEQ ID NO: 12078 - protein, 9 aa, Artificial Sequence
  Description of Artificial Sequence: Synthetic peptide
  XENP018616 vlCDR3
QQDYSSPRT

SEQ ID NO: 12079 - protein, 249 aa, Artificial Sequence
  Description of Artificial Sequence: Synthetic polypeptide
  XENP018617 1G6_H1.117_L1_scFv(GKPGS)4
EVQLVESGGGLVKPGGSLRLSCAASGFTFSNYWMNWVRQAPGKGLEWVGEIRLKSNGYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 12080 - protein, 122 aa, Artificial Sequence
  Description of Artificial Sequence: Synthetic polypeptide
  VH of XENP018617
EVQLVESGGGLVKPGGSLRLSCAASGFTFSNYWMNWVRQAPGKGLEWVGEIRLKSNGYATHYAEPVKGRFTISRDDSKSTVYLQMNSLKTEDTAVYYCTRYYGNYGGYFDVWGAGTLVTVSS

SEQ ID NO: 12081 - protein, 107 aa, Artificial Sequence; identical to SEQ ID NO: 10923
  Description of Artificial Sequence: Synthetic polypeptide
  VL of XENP018617

SEQ ID NO: 12082 - protein, 5 aa, Artificial Sequence
  Description of Artificial Sequence: Synthetic peptide
  XENP018617 vhCDR1
NYWMN

SEQ ID NO: 12083 - protein, 19 aa, Artificial Sequence
  Description of Artificial Sequence: Synthetic peptide
  XENP018617 vhCDR2
EIRLKSNGYATHYAEPVKG

SEQ ID NO: 12084 - protein, 11 aa, Artificial Sequence
  Description of Artificial Sequence: Synthetic peptide
  XENP018617 vhCDR3
YYGNYGGYFDV

SEQ ID NO: 12085 - protein, 11 aa, Artificial Sequence
  Description of Artificial Sequence: Synthetic peptide
  XENP018617 vlCDR1
RASQSVSNDVA

SEQ ID NO: 12086 - protein, 7 aa, Artificial Sequence
  Description of Artificial Sequence: Synthetic peptide
  XENP018617 vlCDR2
YASHRYT

SEQ ID NO: 12087 - protein, 9 aa, Artificial Sequence
  Description of Artificial Sequence: Synthetic peptide
  XENP018617 vlCDR3
QQDYSSPRT

SEQ ID NO: 12088 - protein, 249 aa, Artificial Sequence
  Description of Artificial Sequence: Synthetic polypeptide
  XENP018618 1G6_H1.118_L1_scFv(GKPGS)4
EVQLVESGGGLVKPGGSLRLSCAASGFTFSNYWMNWVRQAPGKGLEWVGEIRLKSNYYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 12089 - protein, 122 aa, Artificial Sequence
  Description of Artificial Sequence: Synthetic polypeptide
  VH of XENP018618
EVQLVESGGGLVKPGGSLRLSCAASGFTFSNYWMNWVRQAPGKGLEWVGEIRLKSNYYATHYAEPVKGRFTISRDDSKSTVYLQMNSLKTEDTAVYYCTRYYGNYGGYFDVWGAGTLVTVSS

SEQ ID NO: 12090 - protein, 107 aa, Artificial Sequence; identical to SEQ ID NO: 10923
  Description of Artificial Sequence: Synthetic polypeptide
  VL of XENP018618

SEQ ID NO: 12091 - protein, 5 aa, Artificial Sequence
  Description of Artificial Sequence: Synthetic peptide
  XENP018618 vhCDR1
NYWMN

SEQ ID NO: 12092 - protein, 19 aa, Artificial Sequence
  Description of Artificial Sequence: Synthetic peptide
  XENP018618 vhCDR2
EIRLKSNYYATHYAEPVKG

SEQ ID NO: 12093 - protein, 11 aa, Artificial Sequence
  Description of Artificial Sequence: Synthetic peptide
  XENP018618 vhCDR3
YYGNYGGYFDV

SEQ ID NO: 12094 - protein, 11 aa, Artificial Sequence
  Description of Artificial Sequence: Synthetic peptide
  XENP018618 vlCDR1
RASQSVSNDVA

SEQ ID NO: 12095 - protein, 7 aa, Artificial Sequence
  Description of Artificial Sequence: Synthetic peptide
  XENP018618 vlCDR2
YASHRYT

SEQ ID NO: 12096 - protein, 9 aa, Artificial Sequence
  Description of Artificial Sequence: Synthetic peptide
  XENP018618 vlCDR3
QQDYSSPRT

SEQ ID NO: 12097 - protein, 249 aa, Artificial Sequence
  Description of Artificial Sequence: Synthetic polypeptide
  XENP018619 1G6_H1.119_L1_scFv(GKPGS)4
EVQLVESGGGLVKPGGSLRLSCAASGFTFSNYWMNWVRQAPGKGLEWVGEIRLKSNNFATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 12098 - protein, 122 aa, Artificial Sequence
  Description of Artificial Sequence: Synthetic polypeptide
  VH of XENP018619
EVQLVESGGGLVKPGGSLRLSCAASGFTFSNYWMNWVRQAPGKGLEWVGEIRLKSNNFATHYAEPVKGRFTISRDDSKSTVYLQMNSLKTEDTAVYYCTRYYGNYGGYFDVWGAGTLVTVSS

SEQ ID NO: 12099 - protein, 107 aa, Artificial Sequence; identical to SEQ ID NO: 10923
  Description of Artificial Sequence: Synthetic polypeptide
  VL of XENP018619

SEQ ID NO: 12100 - protein, 5 aa, Artificial Sequence
  Description of Artificial Sequence: Synthetic peptide
  XENP018619 vhCDR1
NYWMN

SEQ ID NO: 12101 - protein, 19 aa, Artificial Sequence
  Description of Artificial Sequence: Synthetic peptide
  XENP018619 vhCDR2
EIRLKSNNFATHYAEPVKG

SEQ ID NO: 12102 - protein, 11 aa, Artificial Sequence
  Description of Artificial Sequence: Synthetic peptide
  XENP018619 vhCDR3
YYGNYGGYFDV

SEQ ID NO: 12103 - protein, 11 aa, Artificial Sequence
  Description of Artificial Sequence: Synthetic peptide
  XENP018619 vlCDR1
RASQSVSNDVA

SEQ ID NO: 12104 - protein, 7 aa, Artificial Sequence
  Description of Artificial Sequence: Synthetic peptide
  XENP018619 vlCDR2
YASHRYT

SEQ ID NO: 12105 - protein, 9 aa, Artificial Sequence
  Description of Artificial Sequence: Synthetic peptide
  XENP018619 vlCDR3
QQDYSSPRT

SEQ ID NO: 12106 - protein, 249 aa, Artificial Sequence
  Description of Artificial Sequence: Synthetic polypeptide
  XENP018620 1G6_H1.120_L1_scFv(GKPGS)4
EVQLVESGGGLVKPGGSLRLSCAASGFTFSNYWMNWVRQAPGKGLEWVGEIRLKSNNHATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 12107 - protein, 122 aa, Artificial Sequence
  Description of Artificial Sequence: Synthetic polypeptide
  VH of XENP018620
EVQLVESGGGLVKPGGSLRLSCAASGFTFSNYWMNWVRQAPGKGLEWVGEIRLKSNNHATHYAEPVKGRFTISRDDSKSTVYLQMNSLKTEDTAVYYCTRYYGNYGGYFDVWGAGTLVTVSS

SEQ ID NO: 12108 - protein, 107 aa, Artificial Sequence; identical to SEQ ID NO: 10923
  Description of Artificial Sequence: Synthetic polypeptide
  VL of XENP018620

SEQ ID NO: 12109 - protein, 5 aa, Artificial Sequence
  Description of Artificial Sequence: Synthetic peptide
  XENP018620 vhCDR1
NYWMN

SEQ ID NO: 12110 - protein, 19 aa, Artificial Sequence
  Description of Artificial Sequence: Synthetic peptide
  XENP018620 vhCDR2
EIRLKSNNHATHYAEPVKG

SEQ ID NO: 12111 - protein, 11 aa, Artificial Sequence
  Description of Artificial Sequence: Synthetic peptide
  XENP018620 vhCDR3
YYGNYGGYFDV

SEQ ID NO: 12112 - protein, 11 aa, Artificial Sequence
  Description of Artificial Sequence: Synthetic peptide
  XENP018620 vlCDR1
RASQSVSNDVA

SEQ ID NO: 12113 - protein, 7 aa, Artificial Sequence
  Description of Artificial Sequence: Synthetic peptide
  XENP018620 vlCDR2
YASHRYT

SEQ ID NO: 12114 - protein, 9 aa, Artificial Sequence
  Description of Artificial Sequence: Synthetic peptide
  XENP018620 vlCDR3
QQDYSSPRT

SEQ ID NO: 12115 - protein, 249 aa, Artificial Sequence
  Description of Artificial Sequence: Synthetic polypeptide
  XENP018621 1G6_H1.121_L1_scFv(GKPGS)4
EVQLVESGGGLVKPGGSLRLSCAASGFTFSNYWMNWVRQAPGKGLEWVGEIRLKSNNLATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 12116 - protein, 122 aa, Artificial Sequence
  Description of Artificial Sequence: Synthetic polypeptide
  VH of XENP018621
EVQLVESGGGLVKPGGSLRLSCAASGFTFSNYWMNWVRQAPGKGLEWVGEIRLKSNNLATHYAEPVKGRFTISRDDSKSTVYLQMNSLKTEDTAVYYCTRYYGNYGGYFDVWGAGTLVTVSS

SEQ ID NO: 12117 - protein, 107 aa, Artificial Sequence; identical to SEQ ID NO: 10923
  Description of Artificial Sequence: Synthetic polypeptide
  VL of XENP018621

SEQ ID NO: 12118 - protein, 5 aa, Artificial Sequence
  Description of Artificial Sequence: Synthetic peptide
  XENP018621 vhCDR1
NYWMN

SEQ ID NO: 12119 - protein, 19 aa, Artificial Sequence
  Description of Artificial Sequence: Synthetic peptide
  XENP018621 vhCDR2
EIRLKSNNLATHYAEPVKG

SEQ ID NO: 12120 - protein, 11 aa, Artificial Sequence
  Description of Artificial Sequence: Synthetic peptide
  XENP018621 vhCDR3
YYGNYGGYFDV

SEQ ID NO: 12121 - protein, 11 aa, Artificial Sequence
  Description of Artificial Sequence: Synthetic peptide
  XENP018621 vlCDR1
RASQSVSNDVA

SEQ ID NO: 12122 - protein, 7 aa, Artificial Sequence
  Description of Artificial Sequence: Synthetic peptide
  XENP018621 vlCDR2
YASHRYT

SEQ ID NO: 12123 - protein, 9 aa, Artificial Sequence
  Description of Artificial Sequence: Synthetic peptide
  XENP018621 vlCDR3
QQDYSSPRT

SEQ ID NO: 12124 - protein, 249 aa, Artificial Sequence
  Description of Artificial Sequence: Synthetic polypeptide
  XENP018622 1G6_H1.122_L1_scFv(GKPGS)4
EVQLVESGGGLVKPGGSLRLSCAASGFTFSNYWMNWVRQAPGKGLEWVGEIRLKSNNWATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 12125 - protein, 122 aa, Artificial Sequence
  Description of Artificial Sequence: Synthetic polypeptide
  VH of XENP018622
EVQLVESGGGLVKPGGSLRLSCAASGFTFSNYWMNWVRQAPGKGLEWVGEIRLKSNNWATHYAEPVKGRFTISRDDSKSTVYLQMNSLKTEDTAVYYCTRYYGNYGGYFDVWGAGTLVTVSS

SEQ ID NO: 12126 - protein, 107 aa, Artificial Sequence; identical to SEQ ID NO: 10923
  Description of Artificial Sequence: Synthetic polypeptide
  VL of XENP018622

SEQ ID NO: 12127 - protein, 5 aa, Artificial Sequence
  Description of Artificial Sequence: Synthetic peptide
  XENP018622 vhCDR1
NYWMN

SEQ ID NO: 12128 - protein, 19 aa, Artificial Sequence
  Description of Artificial Sequence: Synthetic peptide
  XENP018622 vhCDR2
EIRLKSNNWATHYAEPVKG

SEQ ID NO: 12129 - protein, 11 aa, Artificial Sequence
  Description of Artificial Sequence: Synthetic peptide
  XENP018622 vhCDR3
YYGNYGGYFDV

SEQ ID NO: 12130 - protein, 11 aa, Artificial Sequence
  Description of Artificial Sequence: Synthetic peptide
  XENP018622 vlCDR1
RASQSVSNDVA

SEQ ID NO: 12131 - protein, 7 aa, Artificial Sequence
  Description of Artificial Sequence: Synthetic peptide
  XENP018622 vlCDR2
YASHRYT

SEQ ID NO: 12132 - protein, 9 aa, Artificial Sequence
  Description of Artificial Sequence: Synthetic peptide
  XENP018622 vlCDR3
QQDYSSPRT

SEQ ID NO: 12133 - protein, 249 aa, Artificial Sequence
  Description of Artificial Sequence: Synthetic polypeptide
  XENP018623 1G6_H1.123_L1_scFv(GKPGS)4
EVQLVESGGGLVKPGGSLRLSCAASGFTFSNYWMNWVRQAPGKGLEWVGEIRLKSNNVATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 12134 - protein, 122 aa, Artificial Sequence
  Description of Artificial Sequence: Synthetic polypeptide
  VH of XENP018623
EVQLVESGGGLVKPGGSLRLSCAASGFTFSNYWMNWVRQAPGKGLEWVGEIRLKSNNVATHYAEPVKGRFTISRDDSKSTVYLQMNSLKTEDTAVYYCTRYYGNYGGYFDVWGAGTLVTVSS

SEQ ID NO: 12135 - protein, 107 aa, Artificial Sequence; identical to SEQ ID NO: 10923
  Description of Artificial Sequence: Synthetic polypeptide
  VL of XENP018623

SEQ ID NO: 12136 - protein, 5 aa, Artificial Sequence
  Description of Artificial Sequence: Synthetic peptide
  XENP018623 vhCDR1
NYWMN

SEQ ID NO: 12137 - protein, 19 aa, Artificial Sequence
  Description of Artificial Sequence: Synthetic peptide
  XENP018623 vhCDR2
EIRLKSNNVATHYAEPVKG

SEQ ID NO: 12138 - protein, 11 aa, Artificial Sequence
  Description of Artificial Sequence: Synthetic peptide
  XENP018623 vhCDR3
YYGNYGGYFDV

SEQ ID NO: 12139 - protein, 11 aa, Artificial Sequence
  Description of Artificial Sequence: Synthetic peptide
  XENP018623 vlCDR1
RASQSVSNDVA

SEQ ID NO: 12140 - protein, 7 aa, Artificial Sequence
  Description of Artificial Sequence: Synthetic peptide
  XENP018623 vlCDR2
YASHRYT

SEQ ID NO: 12141 - protein, 9 aa, Artificial Sequence
  Description of Artificial Sequence: Synthetic peptide
  XENP018623 vlCDR3
QQDYSSPRT

SEQ ID NO: 12142 - protein, 249 aa, Artificial Sequence
  Description of Artificial Sequence: Synthetic polypeptide
  XENP018624 1G6_H1.124_L1_scFv(GKPGS)4
EVQLVESGGGLVKPGGSLRLSCAASGFTFSNYWMNWVRQAPGKGLEWVGEIRLKSNNAATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 12143 - protein, 122 aa, Artificial Sequence
  Description of Artificial Sequence: Synthetic polypeptide
  VH of XENP018624
EVQLVESGGGLVKPGGSLRLSCAASGFTFSNYWMNWVRQAPGKGLEWVGEIRLKSNNAATHYAEPVKGRFTISRDDSKSTVYLQMNSLKTEDTAVYYCTRYYGNYGGYFDVWGAGTLVTVSS

SEQ ID NO: 12144 - protein, 107 aa, Artificial Sequence; identical to SEQ ID NO: 10923
  Description of Artificial Sequence: Synthetic polypeptide
  VL of XENP018624

SEQ ID NO: 12145 - protein, 5 aa, Artificial Sequence
  Description of Artificial Sequence: Synthetic peptide
  XENP018624 vhCDR1
NYWMN

SEQ ID NO: 12146 - protein, 19 aa, Artificial Sequence
  Description of Artificial Sequence: Synthetic peptide
  XENP018624 vhCDR2
EIRLKSNNAATHYAEPVKG

SEQ ID NO: 12147 - protein, 11 aa, Artificial Sequence
  Description of Artificial Sequence: Synthetic peptide
  XENP018624 vhCDR3
YYGNYGGYFDV

SEQ ID NO: 12148 - protein, 11 aa, Artificial Sequence
  Description of Artificial Sequence: Synthetic peptide
  XENP018624 vlCDR1
RASQSVSNDVA

SEQ ID NO: 12149 - protein, 7 aa, Artificial Sequence
  Description of Artificial Sequence: Synthetic peptide
  XENP018624 vlCDR2
YASHRYT

SEQ ID NO: 12150 - protein, 9 aa, Artificial Sequence
  Description of Artificial Sequence: Synthetic peptide
  XENP018624 vlCDR3
QQDYSSPRT

SEQ ID NO: 12151 - protein, 249 aa, Artificial Sequence
  Description of Artificial Sequence: Synthetic polypeptide
  XENP018625 1G6_H1.125_L1_scFv(GKPGS)4
EVQLVESGGGLVKPGGSLRLSCAASGFTFSNYWMNWVRQAPGKGLEWVGEIRLKSNNQATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 12152 - protein, 122 aa, Artificial Sequence
  Description of Artificial Sequence: Synthetic polypeptide
  VH of XENP018625
EVQLVESGGGLVKPGGSLRLSCAASGFTFSNYWMNWVRQAPGKGLEWVGEIRLKSNNQATHYAEPVKGRFTISRDDSKSTVYLQMNSLKTEDTAVYYCTRYYGNYGGYFDVWGAGTLVTVSS

SEQ ID NO: 12153 - protein, 107 aa, Artificial Sequence; identical to SEQ ID NO: 10923
  Description of Artificial Sequence: Synthetic polypeptide
  VL of XENP018625

SEQ ID NO: 12154 - protein, 5 aa, Artificial Sequence
  Description of Artificial Sequence: Synthetic peptide
  XENP018625 vhCDR1
NYWMN

SEQ ID NO: 12155 - protein, 19 aa, Artificial Sequence
  Description of Artificial Sequence: Synthetic peptide
  XENP018625 vhCDR2
EIRLKSNNQATHYAEPVKG

SEQ ID NO: 12156 - protein, 11 aa, Artificial Sequence
  Description of Artificial Sequence: Synthetic peptide
  XENP018625 vhCDR3
YYGNYGGYFDV

SEQ ID NO: 12157 - protein, 11 aa, Artificial Sequence
  Description of Artificial Sequence: Synthetic peptide
  XENP018625 vlCDR1
RASQSVSNDVA

SEQ ID NO: 12158 - protein, 7 aa, Artificial Sequence
  Description of Artificial Sequence: Synthetic peptide
  XENP018625 vlCDR2
YASHRYT

SEQ ID NO: 12159 - protein, 9 aa, Artificial Sequence
  Description of Artificial Sequence: Synthetic peptide
  XENP018625 vlCDR3
QQDYSSPRT

SEQ ID NO: 12160 - protein, 249 aa, Artificial Sequence
  Description of Artificial Sequence: Synthetic polypeptide
  XENP018626 1G6_H1.126_L1_scFv(GKPGS)4
EVQLVESGGGLVKPGGSLRLSCAASGFTFSNYWMNWVRQAPGKGLEWVGEIRLKSNNDATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 12161 - protein, 122 aa, Artificial Sequence
  Description of Artificial Sequence: Synthetic polypeptide
  VH of XENP018626
EVQLVESGGGLVKPGGSLRLSCAASGFTFSNYWMNWVRQAPGKGLEWVGEIRLKSNNDATHYAEPVKGRFTISRDDSKSTVYLQMNSLKTEDTAVYYCTRYYGNYGGYFDVWGAGTLVTVSS

SEQ ID NO: 12162 - protein, 107 aa, Artificial Sequence; identical to SEQ ID NO: 10923
  Description of Artificial Sequence: Synthetic polypeptide
  VL of XENP018626

SEQ ID NO: 12163 - protein, 5 aa, Artificial Sequence
  Description of Artificial Sequence: Synthetic peptide
  XENP018626 vhCDR1
NYWMN

SEQ ID NO: 12164 - protein, 19 aa, Artificial Sequence
  Description of Artificial Sequence: Synthetic peptide
  XENP018626 vhCDR2
EIRLKSNNDATHYAEPVKG

SEQ ID NO: 12165 - protein, 11 aa, Artificial Sequence
  Description of Artificial Sequence: Synthetic peptide
  XENP018626 vhCDR3
YYGNYGGYFDV

SEQ ID NO: 12166 - protein, 11 aa, Artificial Sequence
  Description of Artificial Sequence: Synthetic peptide
  XENP018626 vlCDR1
RASQSVSNDVA

SEQ ID NO: 12167 - protein, 7 aa, Artificial Sequence
  Description of Artificial Sequence: Synthetic peptide
  XENP018626 vlCDR2
YASHRYT

SEQ ID NO: 12168 - protein, 9 aa, Artificial Sequence
  Description of Artificial Sequence: Synthetic peptide
  XENP018626 vlCDR3
QQDYSSPRT

SEQ ID NO: 12169 - protein, 249 aa, Artificial Sequence
  Description of Artificial Sequence: Synthetic polypeptide
  XENP018627 1G6_H1.127_L1_scFv(GKPGS)4
EVQLVESGGGLVKPGGSLRLSCAASGFTFSNYWMNWVRQAPGKGLEWVGEIRLKSNNKATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 12170 - protein, 122 aa, Artificial Sequence
  Description of Artificial Sequence: Synthetic polypeptide
  VH of XENP018627
EVQLVESGGGLVKPGGSLRLSCAASGFTFSNYWMNWVRQAPGKGLEWVGEIRLKSNNKATHYAEPVKGRFTISRDDSKSTVYLQMNSLKTEDTAVYYCTRYYGNYGGYFDVWGAGTLVTVSS

SEQ ID NO: 12171 - protein, 107 aa, Artificial Sequence; identical to SEQ ID NO: 10923
  Description of Artificial Sequence: Synthetic polypeptide
  VL of XENP018627

SEQ ID NO: 12172 - protein, 5 aa, Artificial Sequence
  Description of Artificial Sequence: Synthetic peptide
  XENP018627 vhCDR1
NYWMN

SEQ ID NO: 12173 - protein, 19 aa, Artificial Sequence
  Description of Artificial Sequence: Synthetic peptide
  XENP018627 vhCDR2
EIRLKSNNKATHYAEPVKG

SEQ ID NO: 12174 - protein, 11 aa, Artificial Sequence
  Description of Artificial Sequence: Synthetic peptide
  XENP018627 vhCDR3
YYGNYGGYFDV

SEQ ID NO: 12175 - protein, 11 aa, Artificial Sequence
  Description of Artificial Sequence: Synthetic peptide
  XENP018627 vlCDR1
RASQSVSNDVA

SEQ ID NO: 12176 - protein, 7 aa, Artificial Sequence
  Description of Artificial Sequence: Synthetic peptide
  XENP018627 vlCDR2
YASHRYT

SEQ ID NO: 12177 - protein, 9 aa, Artificial Sequence
  Description of Artificial Sequence: Synthetic peptide
  XENP018627 vlCDR3
QQDYSSPRT

SEQ ID NO: 12178 - protein, 249 aa, Artificial Sequence
  Description of Artificial Sequence: Synthetic polypeptide
  XENP018628 1G6_H1.128_L1_scFv(GKPGS)4
EVQLVESGGGLVKPGGSLRLSCAASGFTFSNYWMNWVRQAPGKGLEWVGEIRLKSNNYGTHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 12179 - protein, 122 aa, Artificial Sequence
  Description of Artificial Sequence: Synthetic polypeptide
  VH of XENP018628
EVQLVESGGGLVKPGGSLRLSCAASGFTFSNYWMNWVRQAPGKGLEWVGEIRLKSNNYGTHYAEPVKGRFTISRDDSKSTVYLQMNSLKTEDTAVYYCTRYYGNYGGYFDVWGAGTLVTVSS

SEQ ID NO: 12180 - protein, 107 aa, Artificial Sequence; identical to SEQ ID NO: 10923
  Description of Artificial Sequence: Synthetic polypeptide
  VL of XENP018628

SEQ ID NO: 12181 - protein, 5 aa, Artificial Sequence
  Description of Artificial Sequence: Synthetic peptide
  XENP018628 vhCDR1
NYWMN

SEQ ID NO: 12182 - protein, 19 aa, Artificial Sequence
  Description of Artificial Sequence: Synthetic peptide
  XENP018628 vhCDR2
EIRLKSNNYGTHYAEPVKG

SEQ ID NO: 12183 - protein, 11 aa, Artificial Sequence
  Description of Artificial Sequence: Synthetic peptide
  XENP018628 vhCDR3
YYGNYGGYFDV

SEQ ID NO: 12184 - protein, 11 aa, Artificial Sequence
  Description of Artificial Sequence: Synthetic peptide
  XENP018628 vlCDR1
RASQSVSNDVA

SEQ ID NO: 12185 - protein, 7 aa, Artificial Sequence
  Description of Artificial Sequence: Synthetic peptide
  XENP018628 vlCDR2
YASHRYT

SEQ ID NO: 12186 - protein, 9 aa, Artificial Sequence
  Description of Artificial Sequence: Synthetic peptide
  XENP018628 vlCDR3
QQDYSSPRT

SEQ ID NO: 12187 - protein, 249 aa, Artificial Sequence
  Description of Artificial Sequence: Synthetic polypeptide
  XENP018629 1G6_H1.129_L1_scFv(GKPGS)4
EVQLVESGGGLVKPGGSLRLSCAASGFTFSNYWMNWVRQAPGKGLEWVGEIRLKSNNYHTHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 12188 - protein, 122 aa, Artificial Sequence
  Description of Artificial Sequence: Synthetic polypeptide
  VH of XENP018629
EVQLVESGGGLVKPGGSLRLSCAASGFTFSNYWMNWVRQAPGKGLEWVGEIRLKSNNYHTHYAEPVKGRFTISRDDSKSTVYLQMNSLKTEDTAVYYCTRYYGNYGGYFDVWGAGTLVTVSS

SEQ ID NO: 12189 - protein, 107 aa, Artificial Sequence; identical to SEQ ID NO: 10923
  Description of Artificial Sequence: Synthetic polypeptide
  VL of XENP018629

SEQ ID NO: 12190 - protein, 5 aa, Artificial Sequence
  Description of Artificial Sequence: Synthetic peptide
  XENP018629 vhCDR1
NYWMN

SEQ ID NO: 12191 - protein, 19 aa, Artificial Sequence
  Description of Artificial Sequence: Synthetic peptide
  XENP018629 vhCDR2
EIRLKSNNYHTHYAEPVKG

SEQ ID NO: 12192 - protein, 11 aa, Artificial Sequence
  Description of Artificial Sequence: Synthetic peptide
  XENP018629 vhCDR3
YYGNYGGYFDV

SEQ ID NO: 12193 - protein, 11 aa, Artificial Sequence
  Description of Artificial Sequence: Synthetic peptide
  XENP018629 vlCDR1
RASQSVSNDVA

SEQ ID NO: 12194 - protein, 7 aa, Artificial Sequence
  Description of Artificial Sequence: Synthetic peptide
  XENP018629 vlCDR2
YASHRYT

SEQ ID NO: 12195 - protein, 9 aa, Artificial Sequence
  Description of Artificial Sequence: Synthetic peptide
  XENP018629 vlCDR3
QQDYSSPRT

SEQ ID NO: 12196 - protein, 249 aa, Artificial Sequence
  Description of Artificial Sequence: Synthetic polypeptide
  XENP018630 1G6_H1.130_L1_scFv(GKPGS)4
EVQLVESGGGLVKPGGSLRLSCAASGFTFSNYWMNWVRQAPGKGLEWVGEIRLKSNNYQTHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 12197 - protein, 122 aa, Artificial Sequence
  Description of Artificial Sequence: Synthetic polypeptide
  VH of XENP018630
EVQLVESGGGLVKPGGSLRLSCAASGFTFSNYWMNWVRQAPGKGLEWVGEIRLKSNNYQTHYAEPVKGRFTISRDDSKSTVYLQMNSLKTEDTAVYYCTRYYGNYGGYFDVWGAGTLVTVSS

SEQ ID NO: 12198 - protein, 107 aa, Artificial Sequence; identical to SEQ ID NO: 10923
  Description of Artificial Sequence: Synthetic polypeptide
  VL of XENP018630

SEQ ID NO: 12199 - protein, 5 aa, Artificial Sequence
  Description of Artificial Sequence: Synthetic peptide
  XENP018630 vhCDR1
NYWMN

SEQ ID NO: 12200 - protein, 19 aa, Artificial Sequence
  Description of Artificial Sequence: Synthetic peptide
  XENP018630 vhCDR2
EIRLKSNNYQTHYAEPVKG

SEQ ID NO: 12201 - protein, 11 aa, Artificial Sequence
  Description of Artificial Sequence: Synthetic peptide
  XENP018630 vhCDR3
YYGNYGGYFDV

SEQ ID NO: 12202 - protein, 11 aa, Artificial Sequence
  Description of Artificial Sequence: Synthetic peptide
  XENP018630 vlCDR1
RASQSVSNDVA

SEQ ID NO: 12203 - protein, 7 aa, Artificial Sequence
  Description of Artificial Sequence: Synthetic peptide
  XENP018630 vlCDR2
YASHRYT

SEQ ID NO: 12204 - protein, 9 aa, Artificial Sequence
  Description of Artificial Sequence: Synthetic peptide
  XENP018630 vlCDR3
QQDYSSPRT

SEQ ID NO: 12205 - protein, 249 aa, Artificial Sequence
  Description of Artificial Sequence: Synthetic polypeptide
  XENP018631 1G6_H1.131_L1_scFv(GKPGS)4
EVQLVESGGGLVKPGGSLRLSCAASGFTFSNYWMNWVRQAPGKGLEWVGEIRLKSNNYDTHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 12206 - protein, 122 aa, Artificial Sequence
  Description of Artificial Sequence: Synthetic polypeptide
  VH of XENP018631
EVQLVESGGGLVKPGGSLRLSCAASGFTFSNYWMNWVRQAPGKGLEWVGEIRLKSNNYDTHYAEPVKGRFTISRDDSKSTVYLQMNSLKTEDTAVYYCTRYYGNYGGYFDVWGAGTLVTVSS

SEQ ID NO: 12207 - protein, 107 aa, Artificial Sequence; identical to SEQ ID NO: 10923
  Description of Artificial Sequence: Synthetic polypeptide
  VL of XENP018631

SEQ ID NO: 12208 - protein, 5 aa, Artificial Sequence
  Description of Artificial Sequence: Synthetic peptide
  XENP018631 vhCDR1
NYWMN

SEQ ID NO: 12209 - protein, 19 aa, Artificial Sequence
  Description of Artificial Sequence: Synthetic peptide
  XENP018631 vhCDR2
EIRLKSNNYDTHYAEPVKG

SEQ ID NO: 12210 - protein, 11 aa, Artificial Sequence
  Description of Artificial Sequence: Synthetic peptide
  XENP018631 vhCDR3
YYGNYGGYFDV

SEQ ID NO: 12211 - protein, 11 aa, Artificial Sequence
  Description of Artificial Sequence: Synthetic peptide
  XENP018631 vlCDR1
RASQSVSNDVA

SEQ ID NO: 12212 - protein, 7 aa, Artificial Sequence
  Description of Artificial Sequence: Synthetic peptide
  XENP018631 vlCDR2
YASHRYT

SEQ ID NO: 12213 - protein, 9 aa, Artificial Sequence
  Description of Artificial Sequence: Synthetic peptide
  XENP018631 vlCDR3
QQDYSSPRT

SEQ ID NO: 12214 - protein, 249 aa, Artificial Sequence
  Description of Artificial Sequence: Synthetic polypeptide
  XENP018632 1G6_H1.132_L1_scFv(GKPGS)4
EVQLVESGGGLVKPGGSLRLSCAASGFTFSNYWMNWVRQAPGKGLEWVGEIRLKSNNYLTHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 12215 - protein, 122 aa, Artificial Sequence
  Description of Artificial Sequence: Synthetic polypeptide
  VH of XENP018632
EVQLVESGGGLVKPGGSLRLSCAASGFTFSNYWMNWVRQAPGKGLEWVGEIRLKSNNYLTHYAEPVKGRFTISRDDSKSTVYLQMNSLKTEDTAVYYCTRYYGNYGGYFDVWGAGTLVTVSS

SEQ ID NO: 12216 - protein, 107 aa, Artificial Sequence; identical to SEQ ID NO: 10923
  Description of Artificial Sequence: Synthetic polypeptide
  VL of XENP018632

SEQ ID NO: 12217 - protein, 5 aa, Artificial Sequence
  Description of Artificial Sequence: Synthetic peptide
  XENP018632 vhCDR1
NYWMN

SEQ ID NO: 12218 - protein, 19 aa, Artificial Sequence
  Description of Artificial Sequence: Synthetic peptide
  XENP018632 vhCDR2
EIRLKSNNYLTHYAEPVKG

SEQ ID NO: 12219 - protein, 11 aa, Artificial Sequence
  Description of Artificial Sequence: Synthetic peptide
  XENP018632 vhCDR3
YYGNYGGYFDV

SEQ ID NO: 12220 - protein, 11 aa, Artificial Sequence
  Description of Artificial Sequence: Synthetic peptide
  XENP018632 vlCDR1
RASQSVSNDVA

SEQ ID NO: 12221 - protein, 7 aa, Artificial Sequence
  Description of Artificial Sequence: Synthetic peptide
  XENP018632 vlCDR2
YASHRYT

SEQ ID NO: 12222 - protein, 9 aa, Artificial Sequence
  Description of Artificial Sequence: Synthetic peptide
  XENP018632 vlCDR3
QQDYSSPRT

SEQ ID NO: 12223 - protein, 249 aa, Artificial Sequence
  Description of Artificial Sequence: Synthetic polypeptide
  XENP018633 1G6_H1.133_L1_scFv(GKPGS)4
EVQLVESGGGLVKPGGSLRLSCAASGFTFSNYWMNWVRQAPGKGLEWVGEIRLKSNNYKTHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 12224 - protein, 122 aa, Artificial Sequence
  Description of Artificial Sequence: Synthetic polypeptide
  VH of XENP018633
EVQLVESGGGLVKPGGSLRLSCAASGFTFSNYWMNWVRQAPGKGLEWVGEIRLKSNNYKTHYAEPVKGRFTISRDDSKSTVYLQMNSLKTEDTAVYYCTRYYGNYGGYFDVWGAGTLVTVSS

SEQ ID NO: 12225 - protein, 107 aa, Artificial Sequence; identical to SEQ ID NO: 10923
  Description of Artificial Sequence: Synthetic polypeptide
  VL of XENP018633

SEQ ID NO: 12226 - protein, 5 aa, Artificial Sequence
  Description of Artificial Sequence: Synthetic peptide
  XENP018633 vhCDR1
NYWMN

SEQ ID NO: 12227 - protein, 19 aa, Artificial Sequence
  Description of Artificial Sequence: Synthetic peptide
  XENP018633 vhCDR2
EIRLKSNNYKTHYAEPVKG

SEQ ID NO: 12228 - protein, 11 aa, Artificial Sequence
  Description of Artificial Sequence: Synthetic peptide
  XENP018633 vhCDR3
YYGNYGGYFDV

SEQ ID NO: 12229 - protein, 11 aa, Artificial Sequence
  Description of Artificial Sequence: Synthetic peptide
  XENP018633 vlCDR1
RASQSVSNDVA

SEQ ID NO: 12230 - protein, 7 aa, Artificial Sequence
  Description of Artificial Sequence: Synthetic peptide
  XENP018633 vlCDR2
YASHRYT

SEQ ID NO: 12231 - protein, 9 aa, Artificial Sequence
  Description of Artificial Sequence: Synthetic peptide
  XENP018633 vlCDR3
QQDYSSPRT

SEQ ID NO: 12232 - protein, 249 aa, Artificial Sequence
  Description of Artificial Sequence: Synthetic polypeptide
  XENP018634 1G6_H1.134_L1_scFv(GKPGS)4
EVQLVESGGGLVKPGGSLRLSCAASGFTFSNYWMNWVRQAPGKGLEWVGEIRLKSNNYYTHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 12233 - protein, 122 aa, Artificial Sequence
  Description of Artificial Sequence: Synthetic polypeptide
  VH of XENP018634
EVQLVESGGGLVKPGGSLRLSCAASGFTFSNYWMNWVRQAPGKGLEWVGEIRLKSNNYYTHYAEPVKGRFTISRDDSKSTVYLQMNSLKTEDTAVYYCTRYYGNYGGYFDVWGAGTLVTVSS

SEQ ID NO: 12234 - protein, 107 aa, Artificial Sequence; identical to SEQ ID NO: 10923
  Description of Artificial Sequence: Synthetic polypeptide
  VL of XENP018634

SEQ ID NO: 12235 - protein, 5 aa, Artificial Sequence
  Description of Artificial Sequence: Synthetic peptide
  XENP018634 vhCDR1
NYWMN

SEQ ID NO: 12236 - protein, 19 aa, Artificial Sequence
  Description of Artificial Sequence: Synthetic peptide
  XENP018634 vhCDR2
EIRLKSNNYYTHYAEPVKG

SEQ ID NO: 12237 - protein, 11 aa, Artificial Sequence
  Description of Artificial Sequence: Synthetic peptide
  XENP018634 vhCDR3
YYGNYGGYFDV

SEQ ID NO: 12238 - protein, 11 aa, Artificial Sequence
  Description of Artificial Sequence: Synthetic peptide
  XENP018634 vlCDR1
RASQSVSNDVA

SEQ ID NO: 12239 - protein, 7 aa, Artificial Sequence
  Description of Artificial Sequence: Synthetic peptide
  XENP018634 vlCDR2
YASHRYT

SEQ ID NO: 12240 - protein, 9 aa, Artificial Sequence
  Description of Artificial Sequence: Synthetic peptide
  XENP018634 vlCDR3
QQDYSSPRT

SEQ ID NO: 12241 - protein, 249 aa, Artificial Sequence
  Description of Artificial Sequence: Synthetic polypeptide
  XENP018635 1G6_H1.135_L1_scFv(GKPGS)4
EVQLVESGGGLVKPGGSLRLSCAASGFTFSNYWMNWVRQAPGKGLEWVGEIRLKSNNYAKHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 12242 - protein, 122 aa, Artificial Sequence
  Description of Artificial Sequence: Synthetic polypeptide
  VH of XENP018635
EVQLVESGGGLVKPGGSLRLSCAASGFTFSNYWMNWVRQAPGKGLEWVGEIRLKSNNYAKHYAEPVKGRFTISRDDSKSTVYLQMNSLKTEDTAVYYCTRYYGNYGGYFDVWGAGTLVTVSS

SEQ ID NO: 12243 - protein, 107 aa, Artificial Sequence; identical to SEQ ID NO: 10923
  Description of Artificial Sequence: Synthetic polypeptide
  VL of XENP018635

SEQ ID NO: 12244 - protein, 5 aa, Artificial Sequence
  Description of Artificial Sequence: Synthetic peptide
  XENP018635 vhCDR1
NYWMN

SEQ ID NO: 12245 - protein, 19 aa, Artificial Sequence
  Description of Artificial Sequence: Synthetic peptide
  XENP018635 vhCDR2
EIRLKSNNYAKHYAEPVKG

SEQ ID NO: 12246 - protein, 11 aa, Artificial Sequence
  Description of Artificial Sequence: Synthetic peptide
  XENP018635 vhCDR3
YYGNYGGYFDV

SEQ ID NO: 12247 - protein, 11 aa, Artificial Sequence
  Description of Artificial Sequence: Synthetic peptide
  XENP018635 vlCDR1
RASQSVSNDVA

SEQ ID NO: 12248 - protein, 7 aa, Artificial Sequence
  Description of Artificial Sequence: Synthetic peptide
  XENP018635 vlCDR2
YASHRYT

SEQ ID NO: 12249 - protein, 9 aa, Artificial Sequence
  Description of Artificial Sequence: Synthetic peptide
  XENP018635 vlCDR3
QQDYSSPRT

SEQ ID NO: 12250 - protein, 249 aa, Artificial Sequence
  Description of Artificial Sequence: Synthetic polypeptide
  XENP018636 1G6_H1.136_L1_scFv(GKPGS)4
EVQLVESGGGLVKPGGSLRLSCAASGFTFSNYWMNWVRQAPGKGLEWVGEIRLKSNNYAIHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 12251 - protein, 122 aa, Artificial Sequence
  Description of Artificial Sequence: Synthetic polypeptide
  VH of XENP018636
EVQLVESGGGLVKPGGSLRLSCAASGFTFSNYWMNWVRQAPGKGLEWVGEIRLKSNNYAIHYAEPVKGRFTISRDDSKSTVYLQMNSLKTEDTAVYYCTRYYGNYGGYFDVWGAGTLVTVSS

SEQ ID NO: 12252 - protein, 107 aa, Artificial Sequence; identical to SEQ ID NO: 10923
  Description of Artificial Sequence: Synthetic polypeptide
  VL of XENP018636

SEQ ID NO: 12253 - protein, 5 aa, Artificial Sequence
  Description of Artificial Sequence: Synthetic peptide
  XENP018636 vhCDR1
NYWMN

SEQ ID NO: 12254 - protein, 19 aa, Artificial Sequence
  Description of Artificial Sequence: Synthetic peptide
  XENP018636 vhCDR2
EIRLKSNNYAIHYAEPVKG

SEQ ID NO: 12255 - protein, 11 aa, Artificial Sequence
  Description of Artificial Sequence: Synthetic peptide
  XENP018636 vhCDR3
YYGNYGGYFDV

SEQ ID NO: 12256 - protein, 11 aa, Artificial Sequence
  Description of Artificial Sequence: Synthetic peptide
  XENP018636 vlCDR1
RASQSVSNDVA

SEQ ID NO: 12257 - protein, 7 aa, Artificial Sequence
  Description of Artificial Sequence: Synthetic peptide
  XENP018636 vlCDR2
YASHRYT

SEQ ID NO: 12258 - protein, 9 aa, Artificial Sequence
  Description of Artificial Sequence: Synthetic peptide
  XENP018636 vlCDR3
QQDYSSPRT

SEQ ID NO: 12259 - protein, 249 aa, Artificial Sequence
  Description of Artificial Sequence: Synthetic polypeptide
  XENP018637 1G6_H1.137_L1_scFv(GKPGS)4
EVQLVESGGGLVKPGGSLRLSCAASGFTFSNYWMNWVRQAPGKGLEWVGEIRLKSNNYATYYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 12260 - protein, 122 aa, Artificial Sequence
  Description of Artificial Sequence: Synthetic polypeptide
  VH of XENP018637
EVQLVESGGGLVKPGGSLRLSCAASGFTFSNYWMNWVRQAPGKGLEWVGEIRLKSNNYATYYAEPVKGRFTISRDDSKSTVYLQMNSLKTEDTAVYYCTRYYGNYGGYFDVWGAGTLVTVSS

SEQ ID NO: 12261 - protein, 107 aa, Artificial Sequence; identical to SEQ ID NO: 10923
  Description of Artificial Sequence: Synthetic polypeptide
  VL of XENP018637

SEQ ID NO: 12262 - protein, 5 aa, Artificial Sequence
  Description of Artificial Sequence: Synthetic peptide
  XENP018637 vhCDR1
NYWMN

SEQ ID NO: 12263 - protein, 19 aa, Artificial Sequence
  Description of Artificial Sequence: Synthetic peptide
  XENP018637 vhCDR2
EIRLKSNNYATYYAEPVKG

SEQ ID NO: 12264 - protein, 11 aa, Artificial Sequence
  Description of Artificial Sequence: Synthetic peptide
  XENP018637 vhCDR3
YYGNYGGYFDV

SEQ ID NO: 12265 - protein, 11 aa, Artificial Sequence
  Description of Artificial Sequence: Synthetic peptide
  XENP018637 vlCDR1
RASQSVSNDVA

SEQ ID NO: 12266 - protein, 7 aa, Artificial Sequence
  Description of Artificial Sequence: Synthetic peptide
  XENP018637 vlCDR2
YASHRYT

SEQ ID NO: 12267 - protein, 9 aa, Artificial Sequence
  Description of Artificial Sequence: Synthetic peptide
  XENP018637 vlCDR3
QQDYSSPRT

SEQ ID NO: 12268 - protein, 249 aa, Artificial Sequence
  Description of Artificial Sequence: Synthetic polypeptide
  XENP018638 1G6_H1.138_L1_scFv(GKPGS)4
EVQLVESGGGLVKPGGSLRLSCAASGFTFSNYWMNWVRQAPGKGLEWVGEIRLKSNNYATQYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 12269 - protein, 122 aa, Artificial Sequence
  Description of Artificial Sequence: Synthetic polypeptide
  VH of XENP018638
EVQLVESGGGLVKPGGSLRLSCAASGFTFSNYWMNWVRQAPGKGLEWVGEIRLKSNNYATQYAEPVKGRFTISRDDSKSTVYLQMNSLKTEDTAVYYCTRYYGNYGGYFDVWGAGTLVTVSS

SEQ ID NO: 12270 - protein, 107 aa, Artificial Sequence; identical to SEQ ID NO: 10923
  Description of Artificial Sequence: Synthetic polypeptide
  VL of XENP018638

SEQ ID NO: 12271 - protein, 5 aa, Artificial Sequence
  Description of Artificial Sequence: Synthetic peptide
  XENP018638 vhCDR1
NYWMN

SEQ ID NO: 12272 - protein, 19 aa, Artificial Sequence
  Description of Artificial Sequence: Synthetic peptide
  XENP018638 vhCDR2
EIRLKSNNYATQYAEPVKG

SEQ ID NO: 12273 - protein, 11 aa, Artificial Sequence
  Description of Artificial Sequence: Synthetic peptide
  XENP018638 vhCDR3
YYGNYGGYFDV

SEQ ID NO: 12274 - protein, 11 aa, Artificial Sequence
  Description of Artificial Sequence: Synthetic peptide
  XENP018638 vlCDR1
RASQSVSNDVA

SEQ ID NO: 12275 - protein, 7 aa, Artificial Sequence
  Description of Artificial Sequence: Synthetic peptide
  XENP018638 vlCDR2
YASHRYT

SEQ ID NO: 12276 - protein, 9 aa, Artificial Sequence
  Description of Artificial Sequence: Synthetic peptide
  XENP018638 vlCDR3
QQDYSSPRT

SEQ ID NO: 12277 - protein, 249 aa, Artificial Sequence
  Description of Artificial Sequence: Synthetic polypeptide
  XENP018639 1G6_H1.139_L1_scFv(GKPGS)4
EVQLVESGGGLVKPGGSLRLSCAASGFTFSNYWMNWVRQAPGKGLEWVGEIRLKSNNYATDYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 12278 - protein, 122 aa, Artificial Sequence
  Description of Artificial Sequence: Synthetic polypeptide
  VH of XENP018639
EVQLVESGGGLVKPGGSLRLSCAASGFTFSNYWMNWVRQAPGKGLEWVGEIRLKSNNYATDYAEPVKGRFTISRDDSKSTVYLQMNSLKTEDTAVYYCTRYYGNYGGYFDVWGAGTLVTVSS

SEQ ID NO: 12279 - protein, 107 aa, Artificial Sequence; identical to SEQ ID NO: 10923
  Description of Artificial Sequence: Synthetic polypeptide
  VL of XENP018639

SEQ ID NO: 12280 - protein, 5 aa, Artificial Sequence
  Description of Artificial Sequence: Synthetic peptide
  XENP018639 vhCDR1
NYWMN

SEQ ID NO: 12281 - protein, 19 aa, Artificial Sequence
  Description of Artificial Sequence: Synthetic peptide
  XENP018639 vhCDR2
EIRLKSNNYATDYAEPVKG

SEQ ID NO: 12282 - protein, 11 aa, Artificial Sequence
  Description of Artificial Sequence: Synthetic peptide
  XENP018639 vhCDR3
YYGNYGGYFDV

SEQ ID NO: 12283 - protein, 11 aa, Artificial Sequence
  Description of Artificial Sequence: Synthetic peptide
  XENP018639 vlCDR1
RASQSVSNDVA

SEQ ID NO: 12284 - protein, 7 aa, Artificial Sequence
  Description of Artificial Sequence: Synthetic peptide
  XENP018639 vlCDR2
YASHRYT

SEQ ID NO: 12285 - protein, 9 aa, Artificial Sequence
  Description of Artificial Sequence: Synthetic peptide
  XENP018639 vlCDR3
QQDYSSPRT

SEQ ID NO: 12286 - protein, 249 aa, Artificial Sequence
  Description of Artificial Sequence: Synthetic polypeptide
  XENP018640 1G6_H1.140_L1_scFv(GKPGS)4
EVQLVESGGGLVKPGGSLRLSCAASGFTFSNYWMNWVRQAPGKGLEWVGEIRLKSNNYATFYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 12287 - protein, 122 aa, Artificial Sequence
  Description of Artificial Sequence: Synthetic polypeptide
  VH of XENP018640
EVQLVESGGGLVKPGGSLRLSCAASGFTFSNYWMNWVRQAPGKGLEWVGEIRLKSNNYATFYAEPVKGRFTISRDDSKSTVYLQMNSLKTEDTAVYYCTRYYGNYGGYFDVWGAGTLVTVSS

SEQ ID NO: 12288 - protein, 107 aa, Artificial Sequence; identical to SEQ ID NO: 10923
  Description of Artificial Sequence: Synthetic polypeptide
  VL of XENP018640

SEQ ID NO: 12289 - protein, 5 aa, Artificial Sequence
  Description of Artificial Sequence: Synthetic peptide
  XENP018640 vhCDR1
NYWMN

SEQ ID NO: 12290 - protein, 19 aa, Artificial Sequence
  Description of Artificial Sequence: Synthetic peptide
  XENP018640 vhCDR2
EIRLKSNNYATFYAEPVKG

SEQ ID NO: 12291 - protein, 11 aa, Artificial Sequence
  Description of Artificial Sequence: Synthetic peptide
  XENP018640 vhCDR3
YYGNYGGYFDV

SEQ ID NO: 12292 - protein, 11 aa, Artificial Sequence
  Description of Artificial Sequence: Synthetic peptide
  XENP018640 vlCDR1
RASQSVSNDVA

SEQ ID NO: 12293 - protein, 7 aa, Artificial Sequence
  Description of Artificial Sequence: Synthetic peptide
  XENP018640 vlCDR2
YASHRYT

SEQ ID NO: 12294 - protein, 9 aa, Artificial Sequence
  Description of Artificial Sequence: Synthetic peptide
  XENP018640 vlCDR3
QQDYSSPRT

SEQ ID NO: 12295 - protein, 249 aa, Artificial Sequence
  Description of Artificial Sequence: Synthetic polypeptide
  XENP018641 1G6_H1.141_L1_scFv(GKPGS)4
EVQLVESGGGLVKPGGSLRLSCAASGFTFSNYWMNWVRQAPGKGLEWVGEIRLKSNNYATAYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 12296 - protein, 122 aa, Artificial Sequence
  Description of Artificial Sequence: Synthetic polypeptide
  VH of XENP018641
EVQLVESGGGLVKPGGSLRLSCAASGFTFSNYWMNWVRQAPGKGLEWVGEIRLKSNNYATAYAEPVKGRFTISRDDSKSTVYLQMNSLKTEDTAVYYCTRYYGNYGGYFDVWGAGTLVTVSS

SEQ ID NO: 12297 - protein, 107 aa, Artificial Sequence; identical to SEQ ID NO: 10923
  Description of Artificial Sequence: Synthetic polypeptide
  VL of XENP018641

SEQ ID NO: 12298 - protein, 5 aa, Artificial Sequence
  Description of Artificial Sequence: Synthetic peptide
  XENP018641 vhCDR1
NYWMN

SEQ ID NO: 12299 - protein, 19 aa, Artificial Sequence
  Description of Artificial Sequence: Synthetic peptide
  XENP018641 vhCDR2
EIRLKSNNYATAYAEPVKG

SEQ ID NO: 12300 - protein, 11 aa, Artificial Sequence
  Description of Artificial Sequence: Synthetic peptide
  XENP018641 vhCDR3
YYGNYGGYFDV

SEQ ID NO: 12301 - protein, 11 aa, Artificial Sequence
  Description of Artificial Sequence: Synthetic peptide
  XENP018641 vlCDR1
RASQSVSNDVA

SEQ ID NO: 12302 - protein, 7 aa, Artificial Sequence
  Description of Artificial Sequence: Synthetic peptide
  XENP018641 vlCDR2
YASHRYT

SEQ ID NO: 12303 - protein, 9 aa, Artificial Sequence
  Description of Artificial Sequence: Synthetic peptide
  XENP018641 vlCDR3
QQDYSSPRT

SEQ ID NO: 12304 - protein, 249 aa, Artificial Sequence
  Description of Artificial Sequence: Synthetic polypeptide
  XENP018642 1G6_H1.142_L1_scFv(GKPGS)4
EVQLVESGGGLVKPGGSLRLSCAASGFTFSNYWMNWVRQAPGKGLEWVGEIRLKSNNYATTYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 12305 - protein, 122 aa, Artificial Sequence
  Description of Artificial Sequence: Synthetic polypeptide
  VH of XENP018642
EVQLVESGGGLVKPGGSLRLSCAASGFTFSNYWMNWVRQAPGKGLEWVGEIRLKSNNYATTYAEPVKGRFTISRDDSKSTVYLQMNSLKTEDTAVYYCTRYYGNYGGYFDVWGAGTLVTVSS

SEQ ID NO: 12306 - protein, 107 aa, Artificial Sequence; identical to SEQ ID NO: 10923
  Description of Artificial Sequence: Synthetic polypeptide
  VL of XENP018642

SEQ ID NO: 12307 - protein, 5 aa, Artificial Sequence
  Description of Artificial Sequence: Synthetic peptide
  XENP018642 vhCDR1
NYWMN

SEQ ID NO: 12308 - protein, 19 aa, Artificial Sequence
  Description of Artificial Sequence: Synthetic peptide
  XENP018642 vhCDR2
EIRLKSNNYATTYAEPVKG

SEQ ID NO: 12309 - protein, 11 aa, Artificial Sequence
  Description of Artificial Sequence: Synthetic peptide
  XENP018642 vhCDR3
YYGNYGGYFDV

SEQ ID NO: 12310 - protein, 11 aa, Artificial Sequence
  Description of Artificial Sequence: Synthetic peptide
  XENP018642 vlCDR1
RASQSVSNDVA

SEQ ID NO: 12311 - protein, 7 aa, Artificial Sequence
  Description of Artificial Sequence: Synthetic peptide
  XENP018642 vlCDR2
YASHRYT

SEQ ID NO: 12312 - protein, 9 aa, Artificial Sequence
  Description of Artificial Sequence: Synthetic peptide
  XENP018642 vlCDR3
QQDYSSPRT

SEQ ID NO: 12313 - protein, 249 aa, Artificial Sequence
  Description of Artificial Sequence: Synthetic polypeptide
  XENP018643 1G6_H1.143_L1_scFv(GKPGS)4
EVQLVESGGGLVKPGGSLRLSCAASGFTFSNYWMNWVRQAPGKGLEWVGEIRLKSNNYATKYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 12314 - protein, 122 aa, Artificial Sequence
  Description of Artificial Sequence: Synthetic polypeptide
  VH of XENP018643
EVQLVESGGGLVKPGGSLRLSCAASGFTFSNYWMNWVRQAPGKGLEWVGEIRLKSNNYATKYAEPVKGRFTISRDDSKSTVYLQMNSLKTEDTAVYYCTRYYGNYGGYFDVWGAGTLVTVSS

SEQ ID NO: 12315 - protein, 107 aa, Artificial Sequence; identical to SEQ ID NO: 10923
  Description of Artificial Sequence: Synthetic polypeptide
  VL of XENP018643

SEQ ID NO: 12316 - protein, 5 aa, Artificial Sequence
  Description of Artificial Sequence: Synthetic peptide
  XENP018643 vhCDR1
NYWMN

SEQ ID NO: 12317 - protein, 19 aa, Artificial Sequence
  Description of Artificial Sequence: Synthetic peptide
  XENP018643 vhCDR2
EIRLKSNNYATKYAEPVKG

SEQ ID NO: 12318 - protein, 11 aa, Artificial Sequence
  Description of Artificial Sequence: Synthetic peptide
  XENP018643 vhCDR3
YYGNYGGYFDV

SEQ ID NO: 12319 - protein, 11 aa, Artificial Sequence
  Description of Artificial Sequence: Synthetic peptide
  XENP018643 vlCDR1
RASQSVSNDVA

SEQ ID NO: 12320 - protein, 7 aa, Artificial Sequence
  Description of Artificial Sequence: Synthetic peptide
  XENP018643 vlCDR2
YASHRYT

SEQ ID NO: 12321 - protein, 9 aa, Artificial Sequence
  Description of Artificial Sequence: Synthetic peptide
  XENP018643 vlCDR3
QQDYSSPRT

SEQ ID NO: 12322 - protein, 249 aa, Artificial Sequence
  Description of Artificial Sequence: Synthetic polypeptide
  XENP018644 1G6_H1.144_L1_scFv(GKPGS)4
EVQLVESGGGLVKPGGSLRLSCAASGFTFSNYWMNWVRQAPGKGLEWVGEIRLKSNNYATGYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 12323 - protein, 122 aa, Artificial Sequence
  Description of Artificial Sequence: Synthetic polypeptide
  VH of XENP018644
EVQLVESGGGLVKPGGSLRLSCAASGFTFSNYWMNWVRQAPGKGLEWVGEIRLKSNNYATGYAEPVKGRFTISRDDSKSTVYLQMNSLKTEDTAVYYCTRYYGNYGGYFDVWGAGTLVTVSS

SEQ ID NO: 12324 - protein, 107 aa, Artificial Sequence; identical to SEQ ID NO: 10923
  Description of Artificial Sequence: Synthetic polypeptide
  VL of XENP018644

SEQ ID NO: 12325 - protein, 5 aa, Artificial Sequence
  Description of Artificial Sequence: Synthetic peptide
  XENP018644 vhCDR1
NYWMN

SEQ ID NO: 12326 - protein, 19 aa, Artificial Sequence
  Description of Artificial Sequence: Synthetic peptide
  XENP018644 vhCDR2
EIRLKSNNYATGYAEPVKG

SEQ ID NO: 12327 - protein, 11 aa, Artificial Sequence
  Description of Artificial Sequence: Synthetic peptide
  XENP018644 vhCDR3
YYGNYGGYFDV

SEQ ID NO: 12328 - protein, 11 aa, Artificial Sequence
  Description of Artificial Sequence: Synthetic peptide
  XENP018644 vlCDR1
RASQSVSNDVA

SEQ ID NO: 12329 - protein, 7 aa, Artificial Sequence
  Description of Artificial Sequence: Synthetic peptide
  XENP018644 vlCDR2
YASHRYT

SEQ ID NO: 12330 - protein, 9 aa, Artificial Sequence
  Description of Artificial Sequence: Synthetic peptide
  XENP018644 vlCDR3
QQDYSSPRT

SEQ ID NO: 12331 - protein, 249 aa, Artificial Sequence
  Description of Artificial Sequence: Synthetic polypeptide
  XENP018645 1G6_H1.145_L1_scFv(GKPGS)4
EVQLVESGGGLVKPGGSLRLSCAASGFTFSNYWMNWVRQAPGKGLEWVGEIRLKSNNYATLYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 12332 - protein, 122 aa, Artificial Sequence
  Description of Artificial Sequence: Synthetic polypeptide
  VH of XENP018645
EVQLVESGGGLVKPGGSLRLSCAASGFTFSNYWMNWVRQAPGKGLEWVGEIRLKSNNYATLYAEPVKGRFTISRDDSKSTVYLQMNSLKTEDTAVYYCTRYYGNYGGYFDVWGAGTLVTVSS

SEQ ID NO: 12333 - protein, 107 aa, Artificial Sequence; identical to SEQ ID NO: 10923
  Description of Artificial Sequence: Synthetic polypeptide
  VL of XENP018645

SEQ ID NO: 12334 - protein, 5 aa, Artificial Sequence
  Description of Artificial Sequence: Synthetic peptide
  XENP018645 vhCDR1
NYWMN

SEQ ID NO: 12335 - protein, 19 aa, Artificial Sequence
  Description of Artificial Sequence: Synthetic peptide
  XENP018645 vhCDR2
EIRLKSNNYATLYAEPVKG

SEQ ID NO: 12336 - protein, 11 aa, Artificial Sequence
  Description of Artificial Sequence: Synthetic peptide
  XENP018645 vhCDR3
YYGNYGGYFDV

SEQ ID NO: 12337 - protein, 11 aa, Artificial Sequence
  Description of Artificial Sequence: Synthetic peptide
  XENP018645 vlCDR1
RASQSVSNDVA

SEQ ID NO: 12338 - protein, 7 aa, Artificial Sequence
  Description of Artificial Sequence: Synthetic peptide
  XENP018645 vlCDR2
YASHRYT

SEQ ID NO: 12339 - protein, 9 aa, Artificial Sequence
  Description of Artificial Sequence: Synthetic peptide
  XENP018645 vlCDR3
QQDYSSPRT

SEQ ID NO: 12340 - protein, 249 aa, Artificial Sequence
  Description of Artificial Sequence: Synthetic polypeptide
  XENP018646 1G6_H1.146_L1_scFv(GKPGS)4
EVQLVESGGGLVKPGGSLRLSCAASGFTFSNYWMNWVRQAPGKGLEWVGEIRLKSNNYATHYPEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 12341 - protein, 122 aa, Artificial Sequence
  Description of Artificial Sequence: Synthetic polypeptide
  VH of XENP018646
EVQLVESGGGLVKPGGSLRLSCAASGFTFSNYWMNWVRQAPGKGLEWVGEIRLKSNNYATHYPEPVKGRFTISRDDSKSTVYLQMNSLKTEDTAVYYCTRYYGNYGGYFDVWGAGTLVTVSS

SEQ ID NO: 12342 - protein, 107 aa, Artificial Sequence; identical to SEQ ID NO: 10923
  Description of Artificial Sequence: Synthetic polypeptide
  VL of XENP018646

SEQ ID NO: 12343 - protein, 5 aa, Artificial Sequence
  Description of Artificial Sequence: Synthetic peptide
  XENP018646 vhCDR1
NYWMN

SEQ ID NO: 12344 - protein, 19 aa, Artificial Sequence
  Description of Artificial Sequence: Synthetic peptide
  XENP018646 vhCDR2
EIRLKSNNYATHYPEPVKG

SEQ ID NO: 12345 - protein, 11 aa, Artificial Sequence
  Description of Artificial Sequence: Synthetic peptide
  XENP018646 vhCDR3
YYGNYGGYFDV

SEQ ID NO: 12346 - protein, 11 aa, Artificial Sequence
  Description of Artificial Sequence: Synthetic peptide
  XENP018646 vlCDR1
RASQSVSNDVA

SEQ ID NO: 12347 - protein, 7 aa, Artificial Sequence
  Description of Artificial Sequence: Synthetic peptide
  XENP018646 vlCDR2
YASHRYT

SEQ ID NO: 12348 - protein, 9 aa, Artificial Sequence
  Description of Artificial Sequence: Synthetic peptide
  XENP018646 vlCDR3
QQDYSSPRT

SEQ ID NO: 12349 - protein, 249 aa, Artificial Sequence
  Description of Artificial Sequence: Synthetic polypeptide
  XENP018647 1G6_H1.147_L1_scFv(GKPGS)4
EVQLVESGGGLVKPGGSLRLSCAASGFTFSNYWMNWVRQAPGKGLEWVGEIRLKSNNYATHYVEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 12350 - protein, 122 aa, Artificial Sequence
  Description of Artificial Sequence: Synthetic polypeptide
  VH of XENP018647
EVQLVESGGGLVKPGGSLRLSCAASGFTFSNYWMNWVRQAPGKGLEWVGEIRLKSNNYATHYVEPVKGRFTISRDDSKSTVYLQMNSLKTEDTAVYYCTRYYGNYGGYFDVWGAGTLVTVSS

SEQ ID NO: 12351 - protein, 107 aa, Artificial Sequence; identical to SEQ ID NO: 10923
  Description of Artificial Sequence: Synthetic polypeptide
  VL of XENP018647

SEQ ID NO: 12352 - protein, 5 aa, Artificial Sequence
  Description of Artificial Sequence: Synthetic peptide
  XENP018647 vhCDR1
NYWMN

SEQ ID NO: 12353 - protein, 19 aa, Artificial Sequence
  Description of Artificial Sequence: Synthetic peptide
  XENP018647 vhCDR2
EIRLKSNNYATHYVEPVKG

SEQ ID NO: 12354 - protein, 11 aa, Artificial Sequence
  Description of Artificial Sequence: Synthetic peptide
  XENP018647 vhCDR3
YYGNYGGYFDV

SEQ ID NO: 12355 - protein, 11 aa, Artificial Sequence
  Description of Artificial Sequence: Synthetic peptide
  XENP018647 vlCDR1
RASQSVSNDVA

SEQ ID NO: 12356 - protein, 7 aa, Artificial Sequence
  Description of Artificial Sequence: Synthetic peptide
  XENP018647 vlCDR2
YASHRYT

SEQ ID NO: 12357 - protein, 9 aa, Artificial Sequence
  Description of Artificial Sequence: Synthetic peptide
  XENP018647 vlCDR3
QQDYSSPRT

SEQ ID NO: 12358 - protein, 249 aa, Artificial Sequence
  Description of Artificial Sequence: Synthetic polypeptide
  XENP018648 1G6_H1.148_L1_scFv(GKPGS)4
EVQLVESGGGLVKPGGSLRLSCAASGFTFSNYWMNWVRQAPGKGLEWVGEIRLKSNNYATHYADPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 12359 - protein, 122 aa, Artificial Sequence
  Description of Artificial Sequence: Synthetic polypeptide
  VH of XENP018648
EVQLVESGGGLVKPGGSLRLSCAASGFTFSNYWMNWVRQAPGKGLEWVGEIRLKSNNYATHYADPVKGRFTISRDDSKSTVYLQMNSLKTEDTAVYYCTRYYGNYGGYFDVWGAGTLVTVSS

SEQ ID NO: 12360 - protein, 107 aa, Artificial Sequence; identical to SEQ ID NO: 10923
  Description of Artificial Sequence: Synthetic polypeptide
  VL of XENP018648

SEQ ID NO: 12361 - protein, 5 aa, Artificial Sequence
  Description of Artificial Sequence: Synthetic peptide
  XENP018648 vhCDR1
NYWMN

SEQ ID NO: 12362 - protein, 19 aa, Artificial Sequence
  Description of Artificial Sequence: Synthetic peptide
  XENP018648 vhCDR2
EIRLKSNNYATHYADPVKG

SEQ ID NO: 12363 - protein, 11 aa, Artificial Sequence
  Description of Artificial Sequence: Synthetic peptide
  XENP018648 vhCDR3
YYGNYGGYFDV

SEQ ID NO: 12364 - protein, 11 aa, Artificial Sequence
  Description of Artificial Sequence: Synthetic peptide
  XENP018648 vlCDR1
RASQSVSNDVA

SEQ ID NO: 12365 - protein, 7 aa, Artificial Sequence
  Description of Artificial Sequence: Synthetic peptide
  XENP018648 vlCDR2
YASHRYT

SEQ ID NO: 12366 - protein, 9 aa, Artificial Sequence
  Description of Artificial Sequence: Synthetic peptide
  XENP018648 vlCDR3
QQDYSSPRT

SEQ ID NO: 12367 - protein, 249 aa, Artificial Sequence
  Description of Artificial Sequence: Synthetic polypeptide
  XENP018649 1G6_H1.149_L1_scFv(GKPGS)4
EVQLVESGGGLVKPGGSLRLSCAASGFTFSNYWMNWVRQAPGKGLEWVGEIRLKSNNYATHYAGPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 12368 - protein, 122 aa, Artificial Sequence
  Description of Artificial Sequence: Synthetic polypeptide
  VH of XENP018649
EVQLVESGGGLVKPGGSLRLSCAASGFTFSNYWMNWVRQAPGKGLEWVGEIRLKSNNYATHYAGPVKGRFTISRDDSKSTVYLQMNSLKTEDTAVYYCTRYYGNYGGYFDVWGAGTLVTVSS

SEQ ID NO: 12369 - protein, 107 aa, Artificial Sequence; identical to SEQ ID NO: 10923
  Description of Artificial Sequence: Synthetic polypeptide
  VL of XENP018649

SEQ ID NO: 12370 - protein, 5 aa, Artificial Sequence
  Description of Artificial Sequence: Synthetic peptide
  XENP018649 vhCDR1
NYWMN

SEQ ID NO: 12371 - protein, 19 aa, Artificial Sequence
  Description of Artificial Sequence: Synthetic peptide
  XENP018649 vhCDR2
EIRLKSNNYATHYAGPVKG

SEQ ID NO: 12372 - protein, 11 aa, Artificial Sequence
  Description of Artificial Sequence: Synthetic peptide
  XENP018649 vhCDR3
YYGNYGGYFDV

SEQ ID NO: 12373 - protein, 11 aa, Artificial Sequence
  Description of Artificial Sequence: Synthetic peptide
  XENP018649 vlCDR1
RASQSVSNDVA

SEQ ID NO: 12374 - protein, 7 aa, Artificial Sequence
  Description of Artificial Sequence: Synthetic peptide
  XENP018649 vlCDR2
YASHRYT

SEQ ID NO: 12375 - protein, 9 aa, Artificial Sequence
  Description of Artificial Sequence: Synthetic peptide
  XENP018649 vlCDR3
QQDYSSPRT

SEQ ID NO: 12376 - protein, 249 aa, Artificial Sequence
  Description of Artificial Sequence: Synthetic polypeptide
  XENP018650 1G6_H1.150_L1_scFv(GKPGS)4
EVQLVESGGGLVKPGGSLRLSCAASGFTFSNYWMNWVRQAPGKGLEWVGEIRLKSNNYATHYAAPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 12377 - protein, 122 aa, Artificial Sequence
  Description of Artificial Sequence: Synthetic polypeptide
  VH of XENP018650
EVQLVESGGGLVKPGGSLRLSCAASGFTFSNYWMNWVRQAPGKGLEWVGEIRLKSNNYATHYAAPVKGRFTISRDDSKSTVYLQMNSLKTEDTAVYYCTRYYGNYGGYFDVWGAGTLVTVSS

SEQ ID NO: 12378 - protein, 107 aa, Artificial Sequence; identical to SEQ ID NO: 10923
  Description of Artificial Sequence: Synthetic polypeptide
  VL of XENP018650

SEQ ID NO: 12379 - protein, 5 aa, Artificial Sequence
  Description of Artificial Sequence: Synthetic peptide
  XENP018650 vhCDR1
NYWMN

SEQ ID NO: 12380 - protein, 19 aa, Artificial Sequence
  Description of Artificial Sequence: Synthetic peptide
  XENP018650 vhCDR2
EIRLKSNNYATHYAAPVKG

SEQ ID NO: 12381 - protein, 11 aa, Artificial Sequence
  Description of Artificial Sequence: Synthetic peptide
  XENP018650 vhCDR3
YYGNYGGYFDV

SEQ ID NO: 12382 - protein, 11 aa, Artificial Sequence
  Description of Artificial Sequence: Synthetic peptide
  XENP018650 vlCDR1
RASQSVSNDVA

SEQ ID NO: 12383 - protein, 7 aa, Artificial Sequence
  Description of Artificial Sequence: Synthetic peptide
  XENP018650 vlCDR2
YASHRYT

SEQ ID NO: 12384 - protein, 9 aa, Artificial Sequence
  Description of Artificial Sequence: Synthetic peptide
  XENP018650 vlCDR3
QQDYSSPRT

SEQ ID NO: 12385 - protein, 249 aa, Artificial Sequence
  Description of Artificial Sequence: Synthetic polypeptide
  XENP018651 1G6_H1.151_L1_scFv(GKPGS)4
EVQLVESGGGLVKPGGSLRLSCAASGFTFSNYWMNWVRQAPGKGLEWVGEIRLKSNNYATHYAESVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 12386 - protein, 122 aa, Artificial Sequence
  Description of Artificial Sequence: Synthetic polypeptide
  VH of XENP018651
EVQLVESGGGLVKPGGSLRLSCAASGFTFSNYWMNWVRQAPGKGLEWVGEIRLKSNNYATHYAESVKGRFTISRDDSKSTVYLQMNSLKTEDTAVYYCTRYYGNYGGYFDVWGAGTLVTVSS

SEQ ID NO: 12387 - protein, 107 aa, Artificial Sequence; identical to SEQ ID NO: 10923
  Description of Artificial Sequence: Synthetic polypeptide
  VL of XENP018651

SEQ ID NO: 12388 - protein, 5 aa, Artificial Sequence
  Description of Artificial Sequence: Synthetic peptide
  XENP018651 vhCDR1
NYWMN

SEQ ID NO: 12389 - protein, 19 aa, Artificial Sequence
  Description of Artificial Sequence: Synthetic peptide
  XENP018651 vhCDR2
EIRLKSNNYATHYAESVKG

SEQ ID NO: 12390 - protein, 11 aa, Artificial Sequence
  Description of Artificial Sequence: Synthetic peptide
  XENP018651 vhCDR3
YYGNYGGYFDV

SEQ ID NO: 12391 - protein, 11 aa, Artificial Sequence
  Description of Artificial Sequence: Synthetic peptide
  XENP018651 vlCDR1
RASQSVSNDVA

SEQ ID NO: 12392 - protein, 7 aa, Artificial Sequence
  Description of Artificial Sequence: Synthetic peptide
  XENP018651 vlCDR2
YASHRYT

SEQ ID NO: 12393 - protein, 9 aa, Artificial Sequence
  Description of Artificial Sequence: Synthetic peptide
  XENP018651 vlCDR3
QQDYSSPRT

SEQ ID NO: 12394 - protein, 249 aa, Artificial Sequence
  Description of Artificial Sequence: Synthetic polypeptide
  XENP018652 1G6_H1.152_L1_scFv(GKPGS)4
EVQLVESGGGLVKPGGSLRLSCAASGFTFSNYWMNWVRQAPGKGLEWVGEIRLKSNNYATHYAEPVKGRFTISRDNSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 12395 - protein, 122 aa, Artificial Sequence
  Description of Artificial Sequence: Synthetic polypeptide
  VH of XENP018652
EVQLVESGGGLVKPGGSLRLSCAASGFTFSNYWMNWVRQAPGKGLEWVGEIRLKSNNYATHYAEPVKGRFTISRDNSKSTVYLQMNSLKTEDTAVYYCTRYYGNYGGYFDVWGAGTLVTVSS

SEQ ID NO: 12396 - protein, 107 aa, Artificial Sequence; identical to SEQ ID NO: 10923
  Description of Artificial Sequence: Synthetic polypeptide
  VL of XENP018652

SEQ ID NO: 12397 - protein, 5 aa, Artificial Sequence
  Description of Artificial Sequence: Synthetic peptide
  XENP018652 vhCDR1
NYWMN

SEQ ID NO: 12398 - protein, 19 aa, Artificial Sequence
  Description of Artificial Sequence: Synthetic peptide
  XENP018652 vhCDR2
EIRLKSNNYATHYAEPVKG

SEQ ID NO: 12399 - protein, 11 aa, Artificial Sequence
  Description of Artificial Sequence: Synthetic peptide
  XENP018652 vhCDR3
YYGNYGGYFDV

SEQ ID NO: 12400 - protein, 11 aa, Artificial Sequence
  Description of Artificial Sequence: Synthetic peptide
  XENP018652 vlCDR1
RASQSVSNDVA

SEQ ID NO: 12401 - protein, 7 aa, Artificial Sequence
  Description of Artificial Sequence: Synthetic peptide
  XENP018652 vlCDR2
YASHRYT

SEQ ID NO: 12402 - protein, 9 aa, Artificial Sequence
  Description of Artificial Sequence: Synthetic peptide
  XENP018652 vlCDR3
QQDYSSPRT

SEQ ID NO: 12403 - protein, 249 aa, Artificial Sequence
  Description of Artificial Sequence: Synthetic polypeptide
  XENP018653 1G6_H1.153_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKNTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 12404 - protein, 122 aa, Artificial Sequence
  Description of Artificial Sequence: Synthetic polypeptide
  VH of XENP018653
EVQLVESGGGLVKPGGSLRLSCAASGFTFSNYWMNWVRQAPGKGLEWVGEIRLKSNNYATHYAEPVKGRFTISRDDSKNTVYLQMNSLKTEDTAVYYCTRYYGNYGGYFDVWGAGTLVTVSS

SEQ ID NO: 12405 - protein, 107 aa, Artificial Sequence; identical to SEQ ID NO: 10923
  Description of Artificial Sequence: Synthetic polypeptide
  VL of XENP018653

SEQ ID NO: 12406 - protein, 5 aa, Artificial Sequence
  Description of Artificial Sequence: Synthetic peptide
  XENP018653 vhCDR1
NYWMN

SEQ ID NO: 12407 - protein, 19 aa, Artificial Sequence
  Description of Artificial Sequence: Synthetic peptide
  XENP018653 vhCDR2
EIRLKSNNYATHYAEPVKG

SEQ ID NO: 12408 - protein, 11 aa, Artificial Sequence
  Description of Artificial Sequence: Synthetic peptide
  XENP018653 vhCDR3
YYGNYGGYFDV

SEQ ID NO: 12409 - protein, 11 aa, Artificial Sequence
  Description of Artificial Sequence: Synthetic peptide
  XENP018653 vlCDR1
RASQSVSNDVA

SEQ ID NO: 12410 - protein, 7 aa, Artificial Sequence
  Description of Artificial Sequence: Synthetic peptide
  XENP018653 vlCDR2
YASHRYT

SEQ ID NO: 12411 - protein, 9 aa, Artificial Sequence
  Description of Artificial Sequence: Synthetic peptide
  XENP018653 vlCDR3
QQDYSSPRT

SEQ ID NO: 12412 - protein, 249 aa, Artificial Sequence
  Description of Artificial Sequence: Synthetic polypeptide
  XENP018654 1G6_H1.154_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSSVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 12413 - protein, 122 aa, Artificial Sequence
  Description of Artificial Sequence: Synthetic polypeptide
  VH of XENP018654
EVQLVESGGGLVKPGGSLRLSCAASGFTFSNYWMNWVRQAPGKGLEWVGEIRLKSNNYATHYAEPVKGRFTISRDDSKSSVYLQMNSLKTEDTAVYYCTRYYGNYGGYFDVWGAGTLVTVSS

SEQ ID NO: 12414 - protein, 107 aa, Artificial Sequence; identical to SEQ ID NO: 10923
  Description of Artificial Sequence: Synthetic polypeptide
  VL of XENP018654

SEQ ID NO: 12415 - protein, 5 aa, Artificial Sequence
  Description of Artificial Sequence: Synthetic peptide
  XENP018654 vhCDR1
NYWMN

SEQ ID NO: 12416 - protein, 19 aa, Artificial Sequence
  Description of Artificial Sequence: Synthetic peptide
  XENP018654 vhCDR2
EIRLKSNNYATHYAEPVKG

SEQ ID NO: 12417 - protein, 11 aa, Artificial Sequence
  Description of Artificial Sequence: Synthetic peptide
  XENP018654 vhCDR3
YYGNYGGYFDV

SEQ ID NO: 12418 - protein, 11 aa, Artificial Sequence
  Description of Artificial Sequence: Synthetic peptide
  XENP018654 vlCDR1
RASQSVSNDVA

SEQ ID NO: 12419 - protein, 7 aa, Artificial Sequence
  Description of Artificial Sequence: Synthetic peptide
  XENP018654 vlCDR2
YASHRYT

SEQ ID NO: 12420 - protein, 9 aa, Artificial Sequence
  Description of Artificial Sequence: Synthetic peptide
  XENP018654 vlCDR3
QQDYSSPRT

SEQ ID NO: 12421 - protein, 249 aa, Artificial Sequence
  Description of Artificial Sequence: Synthetic polypeptide
  XENP018655 1G6_H1.155_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTLYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 12422 - protein, 122 aa, Artificial Sequence
  Description of Artificial Sequence: Synthetic polypeptide
  VH of XENP018655
EVQLVESGGGLVKPGGSLRLSCAASGFTFSNYWMNWVRQAPGKGLEWVGEIRLKSNNYATHYAEPVKGRFTISRDDSKSTLYLQMNSLKTEDTAVYYCTRYYGNYGGYFDVWGAGTLVTVSS

SEQ ID NO: 12423 - protein, 107 aa, Artificial Sequence; identical to SEQ ID NO: 10923
  Description of Artificial Sequence: Synthetic polypeptide
  VL of XENP018655

SEQ ID NO: 12424 - protein, 5 aa, Artificial Sequence
  Description of Artificial Sequence: Synthetic peptide
  XENP018655 vhCDR1
NYWMN

SEQ ID NO: 12425 - protein, 19 aa, Artificial Sequence
  Description of Artificial Sequence: Synthetic peptide
  XENP018655 vhCDR2
EIRLKSNNYATHYAEPVKG

SEQ ID NO: 12426 - protein, 11 aa, Artificial Sequence
  Description of Artificial Sequence: Synthetic peptide
  XENP018655 vhCDR3
YYGNYGGYFDV

SEQ ID NO: 12427 - protein, 11 aa, Artificial Sequence
  Description of Artificial Sequence: Synthetic peptide
  XENP018655 vlCDR1
RASQSVSNDVA

SEQ ID NO: 12428 - protein, 7 aa, Artificial Sequence
  Description of Artificial Sequence: Synthetic peptide
  XENP018655 vlCDR2
YASHRYT

SEQ ID NO: 12429 - protein, 9 aa, Artificial Sequence
  Description of Artificial Sequence: Synthetic peptide
  XENP018655 vlCDR3
QQDYSSPRT

SEQ ID NO: 12430 - protein, 249 aa, Artificial Sequence
  Description of Artificial Sequence: Synthetic polypeptide
  XENP018656 1G6_H1.156_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTAYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 12431 - protein, 122 aa, Artificial Sequence
  Description of Artificial Sequence: Synthetic polypeptide
  VH of XENP018656
EVQLVESGGGLVKPGGSLRLSCAASGFTFSNYWMNWVRQAPGKGLEWVGEIRLKSNNYATHYAEPVKGRFTISRDDSKSTAYLQMNSLKTEDTAVYYCTRYYGNYGGYFDVWGAGTLVTVSS

SEQ ID NO: 12432 - protein, 107 aa, Artificial Sequence; identical to SEQ ID NO: 10923
  Description of Artificial Sequence: Synthetic polypeptide
  VL of XENP018656

SEQ ID NO: 12433 - protein, 5 aa, Artificial Sequence
  Description of Artificial Sequence: Synthetic peptide
  XENP018656 vhCDR1
NYWMN

SEQ ID NO: 12434 - protein, 19 aa, Artificial Sequence
  Description of Artificial Sequence: Synthetic peptide
  XENP018656 vhCDR2
EIRLKSNNYATHYAEPVKG

SEQ ID NO: 12435 - protein, 11 aa, Artificial Sequence
  Description of Artificial Sequence: Synthetic peptide
  XENP018656 vhCDR3
YYGNYGGYFDV

SEQ ID NO: 12436 - protein, 11 aa, Artificial Sequence
  Description of Artificial Sequence: Synthetic peptide
  XENP018656 vlCDR1
RASQSVSNDVA

SEQ ID NO: 12437 - protein, 7 aa, Artificial Sequence
  Description of Artificial Sequence: Synthetic peptide
  XENP018656 vlCDR2
YASHRYT

SEQ ID NO: 12438 - protein, 9 aa, Artificial Sequence
  Description of Artificial Sequence: Synthetic peptide
  XENP018656 vlCDR3
QQDYSSPRT

SEQ ID NO: 12439 - protein, 249 aa, Artificial Sequence
  Description of Artificial Sequence: Synthetic polypeptide
  XENP018657 1G6_H1.157_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNNLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 12440 - protein, 122 aa, Artificial Sequence
  Description of Artificial Sequence: Synthetic polypeptide
  VH of XENP018657
EVQLVESGGGLVKPGGSLRLSCAASGFTFSNYWMNWVRQAPGKGLEWVGEIRLKSNNYATHYAEPVKGRFTISRDDSKSTVYLQMNNLKTEDTAVYYCTRYYGNYGGYFDVWGAGTLVTVSS

SEQ ID NO: 12441 - protein, 107 aa, Artificial Sequence; identical to SEQ ID NO: 10923
  Description of Artificial Sequence: Synthetic polypeptide
  VL of XENP018657

SEQ ID NO: 12442 - protein, 5 aa, Artificial Sequence
  Description of Artificial Sequence: Synthetic peptide
  XENP018657 vhCDR1
NYWMN

SEQ ID NO: 12443 - protein, 19 aa, Artificial Sequence
  Description of Artificial Sequence: Synthetic peptide
  XENP018657 vhCDR2
EIRLKSNNYATHYAEPVKG

SEQ ID NO: 12444 - protein, 11 aa, Artificial Sequence
  Description of Artificial Sequence: Synthetic peptide
  XENP018657 vhCDR3
YYGNYGGYFDV

SEQ ID NO: 12445 - protein, 11 aa, Artificial Sequence
  Description of Artificial Sequence: Synthetic peptide
  XENP018657 vlCDR1
RASQSVSNDVA

SEQ ID NO: 12446 - protein, 7 aa, Artificial Sequence
  Description of Artificial Sequence: Synthetic peptide
  XENP018657 vlCDR2
YASHRYT

SEQ ID NO: 12447 - protein, 9 aa, Artificial Sequence
  Description of Artificial Sequence: Synthetic peptide
  XENP018657 vlCDR3
QQDYSSPRT

SEQ ID NO: 12448 - protein, 249 aa, Artificial Sequence
  Description of Artificial Sequence: Synthetic polypeptide
  XENP018658 1G6_H1.158_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLRTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 12449 - protein, 122 aa, Artificial Sequence
  Description of Artificial Sequence: Synthetic polypeptide
  VH of XENP018658
EVQLVESGGGLVKPGGSLRLSCAASGFTFSNYWMNWVRQAPGKGLEWVGEIRLKSNNYATHYAEPVKGRFTISRDDSKSTVYLQMNSLRTEDTAVYYCTRYYGNYGGYFDVWGAGTLVTVSS

SEQ ID NO: 12450 - protein, 107 aa, Artificial Sequence; identical to SEQ ID NO: 10923
  Description of Artificial Sequence: Synthetic polypeptide
  VL of XENP018658

SEQ ID NO: 12451 - protein, 5 aa, Artificial Sequence
  Description of Artificial Sequence: Synthetic peptide
  XENP018658 vhCDR1
NYWMN

SEQ ID NO: 12452 - protein, 19 aa, Artificial Sequence
  Description of Artificial Sequence: Synthetic peptide
  XENP018658 vhCDR2
EIRLKSNNYATHYAEPVKG

SEQ ID NO: 12453 - protein, 11 aa, Artificial Sequence
  Description of Artificial Sequence: Synthetic peptide
  XENP018658 vhCDR3
YYGNYGGYFDV

SEQ ID NO: 12454 - protein, 11 aa, Artificial Sequence
  Description of Artificial Sequence: Synthetic peptide
  XENP018658 vlCDR1
RASQSVSNDVA

SEQ ID NO: 12455 - protein, 7 aa, Artificial Sequence
  Description of Artificial Sequence: Synthetic peptide
  XENP018658 vlCDR2
YASHRYT

SEQ ID NO: 12456 - protein, 9 aa, Artificial Sequence
  Description of Artificial Sequence: Synthetic peptide
  XENP018658 vlCDR3
QQDYSSPRT

SEQ ID NO: 12457 - protein, 249 aa, Artificial Sequence
  Description of Artificial Sequence: Synthetic polypeptide
  XENP018659 1G6_H1.159_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKAEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 12458 - protein, 122 aa, Artificial Sequence
  Description of Artificial Sequence: Synthetic polypeptide
  VH of XENP018659
EVQLVESGGGLVKPGGSLRLSCAASGFTFSNYWMNWVRQAPGKGLEWVGEIRLKSNNYATHYAEPVKGRFTISRDDSKSTVYLQMNSLKAEDTAVYYCTRYYGNYGGYFDVWGAGTLVTVSS

SEQ ID NO: 12459 - protein, 107 aa, Artificial Sequence; identical to SEQ ID NO: 10923
  Description of Artificial Sequence: Synthetic polypeptide
  VL of XENP018659

SEQ ID NO: 12460 - protein, 5 aa, Artificial Sequence
  Description of Artificial Sequence: Synthetic peptide
  XENP018659 vhCDR1
NYWMN

SEQ ID NO: 12461 - protein, 19 aa, Artificial Sequence
  Description of Artificial Sequence: Synthetic peptide
  XENP018659 vhCDR2
EIRLKSNNYATHYAEPVKG

SEQ ID NO: 12462 - protein, 11 aa, Artificial Sequence
  Description of Artificial Sequence: Synthetic peptide
  XENP018659 vhCDR3
YYGNYGGYFDV

SEQ ID NO: 12463 - protein, 11 aa, Artificial Sequence
  Description of Artificial Sequence: Synthetic peptide
  XENP018659 vlCDR1
RASQSVSNDVA

SEQ ID NO: 12464 - protein, 7 aa, Artificial Sequence
  Description of Artificial Sequence: Synthetic peptide
  XENP018659 vlCDR2
YASHRYT

SEQ ID NO: 12465 - protein, 9 aa, Artificial Sequence
  Description of Artificial Sequence: Synthetic peptide
  XENP018659 vlCDR3
QQDYSSPRT

SEQ ID NO: 12466 - protein, 249 aa, Artificial Sequence
  Description of Artificial Sequence: Synthetic polypeptide
  XENP018660 1G6_H1.160_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTGVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 12467 - protein, 122 aa, Artificial Sequence
  Description of Artificial Sequence: Synthetic polypeptide
  VH of XENP018660
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTGVYYCTRYYGNYGGYFDVWGAGTLVTVSS

SEQ ID NO: 12468 - protein, 107 aa, Artificial Sequence; identical to SEQ ID NO: 10923
  Description of Artificial Sequence: Synthetic polypeptide
  VL of XENP018660

SEQ ID NO: 12469 - protein, 5 aa, Artificial Sequence
  Description of Artificial Sequence: Synthetic peptide
  XENP018660 vhCDR1
NYWMN

SEQ ID NO: 12470 - protein, 19 aa, Artificial Sequence
  Description of Artificial Sequence: Synthetic peptide
  XENP018660 vhCDR2
EIRLKSNNYATHYAEPVKG

SEQ ID NO: 12471 - protein, 11 aa, Artificial Sequence
  Description of Artificial Sequence: Synthetic peptide
  XENP018660 vhCDR3
YYGNYGGYFDV

SEQ ID NO: 12472 - protein, 11 aa, Artificial Sequence
  Description of Artificial Sequence: Synthetic peptide
  XENP018660 vlCDR1
RASQSVSNDVA

SEQ ID NO: 12473 - protein, 7 aa, Artificial Sequence
  Description of Artificial Sequence: Synthetic peptide
  XENP018660 vlCDR2
YASHRYT

SEQ ID NO: 12474 - protein, 9 aa, Artificial Sequence
  Description of Artificial Sequence: Synthetic peptide
  XENP018660 vlCDR3
QQDYSSPRT

SEQ ID NO: 12475 - protein, 249 aa, Artificial Sequence
  Description of Artificial Sequence: Synthetic polypeptide
  XENP018661 1G6_H1.161_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAIYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 12476 - protein, 122 aa, Artificial Sequence
  Description of Artificial Sequence: Synthetic polypeptide
  VH of XENP018661
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAIYYCTRYYGNYGGYFDVWGAGTLVTVSS

SEQ ID NO: 12477 - protein, 107 aa, Artificial Sequence; identical to SEQ ID NO: 10923
  Description of Artificial Sequence: Synthetic polypeptide
  VL of XENP018661

SEQ ID NO: 12478 - protein, 5 aa, Artificial Sequence
  Description of Artificial Sequence: Synthetic peptide
  XENP018661 vhCDR1
NYWMN

SEQ ID NO: 12479 - protein, 19 aa, Artificial Sequence
  Description of Artificial Sequence: Synthetic peptide
  XENP018661 vhCDR2
EIRLKSNNYATHYAEPVKG

SEQ ID NO: 12480 - protein, 11 aa, Artificial Sequence
  Description of Artificial Sequence: Synthetic peptide
  XENP018661 vhCDR3
YYGNYGGYFDV

SEQ ID NO: 12481 - protein, 11 aa, Artificial Sequence
  Description of Artificial Sequence: Synthetic peptide
  XENP018661 vlCDR1
RASQSVSNDVA

SEQ ID NO: 12482 - protein, 7 aa, Artificial Sequence
  Description of Artificial Sequence: Synthetic peptide
  XENP018661 vlCDR2
YASHRYT

SEQ ID NO: 12483 - protein, 9 aa, Artificial Sequence
  Description of Artificial Sequence: Synthetic peptide
  XENP018661 vlCDR3
QQDYSSPRT

SEQ ID NO: 12484 - protein, 249 aa, Artificial Sequence
  Description of Artificial Sequence: Synthetic polypeptide
  XENP018662 1G6_H1.162_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYHCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 12485 - protein, 122 aa, Artificial Sequence
  Description of Artificial Sequence: Synthetic polypeptide
  VH of XENP018662
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYHCTRYYGNYGGYFDVWGAGTLVTVSS

SEQ ID NO: 12486 - protein, 107 aa, Artificial Sequence; identical to SEQ ID NO: 10923
  Description of Artificial Sequence: Synthetic polypeptide
  VL of XENP018662

SEQ ID NO: 12487 - protein, 5 aa, Artificial Sequence
  Description of Artificial Sequence: Synthetic peptide
  XENP018662 vhCDR1
NYWMN

SEQ ID NO: 12488 - protein, 19 aa, Artificial Sequence
  Description of Artificial Sequence: Synthetic peptide
  XENP018662 vhCDR2
EIRLKSNNYATHYAEPVKG

SEQ ID NO: 12489 - protein, 11 aa, Artificial Sequence
  Description of Artificial Sequence: Synthetic peptide
  XENP018662 vhCDR3
YYGNYGGYFDV

SEQ ID NO: 12490 - protein, 11 aa, Artificial Sequence
  Description of Artificial Sequence: Synthetic peptide
  XENP018662 vlCDR1
RASQSVSNDVA

SEQ ID NO: 12491 - protein, 7 aa, Artificial Sequence
  Description of Artificial Sequence: Synthetic peptide
  XENP018662 vlCDR2
YASHRYT

SEQ ID NO: 12492 - protein, 9 aa, Artificial Sequence
  Description of Artificial Sequence: Synthetic peptide
  XENP018662 vlCDR3
QQDYSSPRT

SEQ ID NO: 12493 - protein, 249 aa, Artificial Sequence
  Description of Artificial Sequence: Synthetic polypeptide
  XENP018663 1G6_H1.163_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCARYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 12494 - protein, 122 aa, Artificial Sequence
  Description of Artificial Sequence: Synthetic polypeptide
  VH of XENP018663
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCARYYGNYGGYFDVWGAGTLVTVSS

SEQ ID NO: 12495 - protein, 107 aa, Artificial Sequence; identical to SEQ ID NO: 10923
  Description of Artificial Sequence: Synthetic polypeptide
  VL of XENP018663

SEQ ID NO: 12496 - protein, 5 aa, Artificial Sequence
  Description of Artificial Sequence: Synthetic peptide
  XENP018663 vhCDR1
NYWMN

SEQ ID NO: 12497 - protein, 19 aa, Artificial Sequence
  Description of Artificial Sequence: Synthetic peptide
  XENP018663 vhCDR2
EIRLKSNNYATHYAEPVKG

SEQ ID NO: 12498 - protein, 11 aa, Artificial Sequence
  Description of Artificial Sequence: Synthetic peptide
  XENP018663 vhCDR3
YYGNYGGYFDV

SEQ ID NO: 12499 - protein, 11 aa, Artificial Sequence
  Description of Artificial Sequence: Synthetic peptide
  XENP018663 vlCDR1
RASQSVSNDVA

SEQ ID NO: 12500 - protein, 7 aa, Artificial Sequence
  Description of Artificial Sequence: Synthetic peptide
  XENP018663 vlCDR2
YASHRYT

SEQ ID NO: 12501 - protein, 9 aa, Artificial Sequence
  Description of Artificial Sequence: Synthetic peptide
  XENP018663 vlCDR3
QQDYSSPRT

SEQ ID NO: 12502 - protein, 249 aa, Artificial Sequence
  Description of Artificial Sequence: Synthetic polypeptide
  XENP018664 1G6_H1.164_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCVRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 12503 - protein, 122 aa, Artificial Sequence
  Description of Artificial Sequence: Synthetic polypeptide
  VH of XENP018664
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCVRYYGNYGGYFDVWGAGTLVTVSS

SEQ ID NO: 12504 - protein, 107 aa, Artificial Sequence; identical to SEQ ID NO: 10923
  Description of Artificial Sequence: Synthetic polypeptide
  VL of XENP018664

SEQ ID NO: 12505 - protein, 5 aa, Artificial Sequence
  Description of Artificial Sequence: Synthetic peptide
  XENP018664 vhCDR1
NYWMN

SEQ ID NO: 12506 - protein, 19 aa, Artificial Sequence
  Description of Artificial Sequence: Synthetic peptide
  XENP018664 vhCDR2
EIRLKSNNYATHYAEPVKG

SEQ ID NO: 12507 - protein, 11 aa, Artificial Sequence
  Description of Artificial Sequence: Synthetic peptide
  XENP018664 vhCDR3
YYGNYGGYFDV

SEQ ID NO: 12508 - protein, 11 aa, Artificial Sequence
  Description of Artificial Sequence: Synthetic peptide
  XENP018664 vlCDR1
RASQSVSNDVA

SEQ ID NO: 12509 - protein, 7 aa, Artificial Sequence
  Description of Artificial Sequence: Synthetic peptide
  XENP018664 vlCDR2
YASHRYT

SEQ ID NO: 12510 - protein, 9 aa, Artificial Sequence
  Description of Artificial Sequence: Synthetic peptide
  XENP018664 vlCDR3
QQDYSSPRT

SEQ ID NO: 12511 - protein, 249 aa, Artificial Sequence
  Description of Artificial Sequence: Synthetic polypeptide
  XENP018665 1G6_H1.165_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTTYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 12512 - protein, 122 aa, Artificial Sequence
  Description of Artificial Sequence: Synthetic polypeptide
  VH of XENP018665
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTTYYGNYGGYFDVWGAGTLVTVSS

SEQ ID NO: 12513 - protein, 107 aa, Artificial Sequence; identical to SEQ ID NO: 10923
  Description of Artificial Sequence: Synthetic polypeptide
  VL of XENP018665

SEQ ID NO: 12514 - protein, 5 aa, Artificial Sequence
  Description of Artificial Sequence: Synthetic peptide
  XENP018665 vhCDR1
NYWMN

SEQ ID NO: 12515 - protein, 19 aa, Artificial Sequence
  Description of Artificial Sequence: Synthetic peptide
  XENP018665 vhCDR2
EIRLKSNNYATHYAEPVKG

SEQ ID NO: 12516 - protein, 11 aa, Artificial Sequence
  Description of Artificial Sequence: Synthetic peptide
  XENP018665 vhCDR3
YYGNYGGYFDV

SEQ ID NO: 12517 - protein, 11 aa, Artificial Sequence
  Description of Artificial Sequence: Synthetic peptide
  XENP018665 vlCDR1
RASQSVSNDVA

SEQ ID NO: 12518 - protein, 7 aa, Artificial Sequence
  Description of Artificial Sequence: Synthetic peptide
  XENP018665 vlCDR2
YASHRYT

SEQ ID NO: 12519 - protein, 9 aa, Artificial Sequence
  Description of Artificial Sequence: Synthetic peptide
  XENP018665 vlCDR3
QQDYSSPRT

SEQ ID NO: 12520 - protein, 249 aa, Artificial Sequence
  Description of Artificial Sequence: Synthetic polypeptide
  XENP018666 1G6_H1.166_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTKYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 12521 - protein, 122 aa, Artificial Sequence
  Description of Artificial Sequence: Synthetic polypeptide
  VH of XENP018666
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTKYYGNYGGYFDVWGAGTLVTVSS

SEQ ID NO: 12522 - protein, 107 aa, Artificial Sequence; identical to SEQ ID NO: 10923
  Description of Artificial Sequence: Synthetic polypeptide
  VL of XENP018666

SEQ ID NO: 12523 - protein, 5 aa, Artificial Sequence
  Description of Artificial Sequence: Synthetic peptide
  XENP018666 vhCDR1
NYWMN

SEQ ID NO: 12524 - protein, 19 aa, Artificial Sequence
  Description of Artificial Sequence: Synthetic peptide
  XENP018666 vhCDR2
EIRLKSNNYATHYAEPVKG

SEQ ID NO: 12525 - protein, 11 aa, Artificial Sequence
  Description of Artificial Sequence: Synthetic peptide
  XENP018666 vhCDR3
YYGNYGGYFDV

SEQ ID NO: 12526 - protein, 11 aa, Artificial Sequence
  Description of Artificial Sequence: Synthetic peptide
  XENP018666 vlCDR1
RASQSVSNDVA

SEQ ID NO: 12527 - protein, 7 aa, Artificial Sequence
  Description of Artificial Sequence: Synthetic peptide
  XENP018666 vlCDR2
YASHRYT

SEQ ID NO: 12528 - protein, 9 aa, Artificial Sequence
  Description of Artificial Sequence: Synthetic peptide
  XENP018666 vlCDR3
QQDYSSPRT

SEQ ID NO: 12529 - protein, 249 aa, Artificial Sequence
  Description of Artificial Sequence: Synthetic polypeptide
  XENP018667 1G6_H1.167_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRFYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 12530 - protein, 122 aa, Artificial Sequence
  Description of Artificial Sequence: Synthetic polypeptide
  VH of XENP018667
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRFYGNYGGYFDVWGAGTLVTVSS

SEQ ID NO: 12531 - protein, 107 aa, Artificial Sequence; identical to SEQ ID NO: 10923
  Description of Artificial Sequence: Synthetic polypeptide
  VL of XENP018667

SEQ ID NO: 12532 - protein, 5 aa, Artificial Sequence
  Description of Artificial Sequence: Synthetic peptide
  XENP018667 vhCDR1
NYWMN

SEQ ID NO: 12533 - protein, 19 aa, Artificial Sequence
  Description of Artificial Sequence: Synthetic peptide
  XENP018667 vhCDR2
EIRLKSNNYATHYAEPVKG

SEQ ID NO: 12534 - protein, 11 aa, Artificial Sequence
  Description of Artificial Sequence: Synthetic peptide
  XENP018667 vhCDR3
FYGNYGGYFDV

SEQ ID NO: 12535 - protein, 11 aa, Artificial Sequence
  Description of Artificial Sequence: Synthetic peptide
  XENP018667 vlCDR1
RASQSVSNDVA

SEQ ID NO: 12536 - protein, 7 aa, Artificial Sequence
  Description of Artificial Sequence: Synthetic peptide
  XENP018667 vlCDR2
YASHRYT

SEQ ID NO: 12537 - protein, 9 aa, Artificial Sequence
  Description of Artificial Sequence: Synthetic peptide
  XENP018667 vlCDR3
QQDYSSPRT

SEQ ID NO: 12538 - protein, 249 aa, Artificial Sequence
  Description of Artificial Sequence: Synthetic polypeptide
  XENP018668 1G6_H1.168_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRHYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 12539 - protein, 122 aa, Artificial Sequence
  Description of Artificial Sequence: Synthetic polypeptide
  VH of XENP018668
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRHYGNYGGYFDVWGAGTLVTVSS

SEQ ID NO: 12540 - protein, 107 aa, Artificial Sequence; identical to SEQ ID NO: 10923
  Description of Artificial Sequence: Synthetic polypeptide
  VL of XENP018668

SEQ ID NO: 12541 - protein, 5 aa, Artificial Sequence
  Description of Artificial Sequence: Synthetic peptide
  XENP018668 vhCDR1
NYWMN

SEQ ID NO: 12542 - protein, 19 aa, Artificial Sequence
  Description of Artificial Sequence: Synthetic peptide
  XENP018668 vhCDR2
EIRLKSNNYATHYAEPVKG

SEQ ID NO: 12543 - protein, 11 aa, Artificial Sequence
  Description of Artificial Sequence: Synthetic peptide
  XENP018668 vhCDR3
HYGNYGGYFDV

SEQ ID NO: 12544 - protein, 11 aa, Artificial Sequence
  Description of Artificial Sequence: Synthetic peptide
  XENP018668 vlCDR1
RASQSVSNDVA

SEQ ID NO: 12545 - protein, 7 aa, Artificial Sequence
  Description of Artificial Sequence: Synthetic peptide
  XENP018668 vlCDR2
YASHRYT

SEQ ID NO: 12546 - protein, 9 aa, Artificial Sequence
  Description of Artificial Sequence: Synthetic peptide
  XENP018668 vlCDR3
QQDYSSPRT

SEQ ID NO: 12547 - protein, 249 aa, Artificial Sequence
  Description of Artificial Sequence: Synthetic polypeptide
  XENP018669 1G6_H1.169_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRLYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 12548 - protein, 122 aa, Artificial Sequence
  Description of Artificial Sequence: Synthetic polypeptide
  VH of XENP018669
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRLYGNYGGYFDVWGAGTLVTVSS

SEQ ID NO: 12549 - protein, 107 aa, Artificial Sequence; identical to SEQ ID NO: 10923
  Description of Artificial Sequence: Synthetic polypeptide
  VL of XENP018669

SEQ ID NO: 12550 - protein, 5 aa, Artificial Sequence
  Description of Artificial Sequence: Synthetic peptide
  XENP018669 vhCDR1
NYWMN

SEQ ID NO: 12551 - protein, 19 aa, Artificial Sequence
  Description of Artificial Sequence: Synthetic peptide
  XENP018669 vhCDR2
EIRLKSNNYATHYAEPVKG

SEQ ID NO: 12552 - protein, 11 aa, Artificial Sequence
  Description of Artificial Sequence: Synthetic peptide
  XENP018669 vhCDR3
LYGNYGGYFDV

SEQ ID NO: 12553 - protein, 11 aa, Artificial Sequence
  Description of Artificial Sequence: Synthetic peptide
  XENP018669 vlCDR1
RASQSVSNDVA

SEQ ID NO: 12554 - protein, 7 aa, Artificial Sequence
  Description of Artificial Sequence: Synthetic peptide
  XENP018669 vlCDR2
YASHRYT

SEQ ID NO: 12555 - protein, 9 aa, Artificial Sequence
  Description of Artificial Sequence: Synthetic peptide
  XENP018669 vlCDR3
QQDYSSPRT

SEQ ID NO: 12556 - protein, 249 aa, Artificial Sequence
  Description of Artificial Sequence: Synthetic polypeptide
  XENP018670 1G6_H1.170_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRWYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 12557 - protein, 122 aa, Artificial Sequence
  Description of Artificial Sequence: Synthetic polypeptide
  VH of XENP018670
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRWYGNYGGYFDVWGAGTLVTVSS

SEQ ID NO: 12558 - protein, 107 aa, Artificial Sequence; identical to SEQ ID NO: 10923
  Description of Artificial Sequence: Synthetic polypeptide
  VL of XENP018670

SEQ ID NO: 12559 - protein, 5 aa, Artificial Sequence
  Description of Artificial Sequence: Synthetic peptide
  XENP018670 vhCDR1
NYWMN

SEQ ID NO: 12560 - protein, 19 aa, Artificial Sequence
  Description of Artificial Sequence: Synthetic peptide
  XENP018670 vhCDR2
EIRLKSNNYATHYAEPVKG

SEQ ID NO: 12561 - protein, 11 aa, Artificial Sequence
  Description of Artificial Sequence: Synthetic peptide
  XENP018670 vhCDR3
WYGNYGGYFDV

SEQ ID NO: 12562 - protein, 11 aa, Artificial Sequence
  Description of Artificial Sequence: Synthetic peptide
  XENP018670 vlCDR1
RASQSVSNDVA

SEQ ID NO: 12563 - protein, 7 aa, Artificial Sequence
  Description of Artificial Sequence: Synthetic peptide
  XENP018670 vlCDR2
YASHRYT

SEQ ID NO: 12564 - protein, 9 aa, Artificial Sequence
  Description of Artificial Sequence: Synthetic peptide
  XENP018670 vlCDR3
QQDYSSPRT

SEQ ID NO: 12565 - protein, 249 aa, Artificial Sequence
  Description of Artificial Sequence: Synthetic polypeptide
  XENP018671 1G6_H1.171_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRVYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 12566 - protein, 122 aa, Artificial Sequence
  Description of Artificial Sequence: Synthetic polypeptide
  VH of XENP018671
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRVYGNYGGYFDVWGAGTLVTVSS

SEQ ID NO: 12567 - protein, 107 aa, Artificial Sequence; identical to SEQ ID NO: 10923
  Description of Artificial Sequence: Synthetic polypeptide
  VL of XENP018671

SEQ ID NO: 12568 - protein, 5 aa, Artificial Sequence
  Description of Artificial Sequence: Synthetic peptide
  XENP018671 vhCDR1
NYWMN

SEQ ID NO: 12569 - protein, 19 aa, Artificial Sequence
  Description of Artificial Sequence: Synthetic peptide
  XENP018671 vhCDR2
EIRLKSNNYATHYAEPVKG

SEQ ID NO: 12570 - protein, 11 aa, Artificial Sequence
  Description of Artificial Sequence: Synthetic peptide
  XENP018671 vhCDR3
VYGNYGGYFDV

SEQ ID NO: 12571 - protein, 11 aa, Artificial Sequence
  Description of Artificial Sequence: Synthetic peptide
  XENP018671 vlCDR1
RASQSVSNDVA

SEQ ID NO: 12572 - protein, 7 aa, Artificial Sequence
  Description of Artificial Sequence: Synthetic peptide
  XENP018671 vlCDR2
YASHRYT

SEQ ID NO: 12573 - protein, 9 aa, Artificial Sequence
  Description of Artificial Sequence: Synthetic peptide
  XENP018671 vlCDR3
QQDYSSPRT

SEQ ID NO: 12574 - protein, 249 aa, Artificial Sequence
  Description of Artificial Sequence: Synthetic polypeptide
  XENP018672 1G6_H1.172_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRAYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 12575 - protein, 122 aa, Artificial Sequence
  Description of Artificial Sequence: Synthetic polypeptide
  VH of XENP018672
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRAYGNYGGYFDVWGAGTLVTVSS

SEQ ID NO: 12576 - protein, 107 aa, Artificial Sequence; identical to SEQ ID NO: 10923
  Description of Artificial Sequence: Synthetic polypeptide
  VL of XENP018672

SEQ ID NO: 12577 - protein, 5 aa, Artificial Sequence
  Description of Artificial Sequence: Synthetic peptide
  XENP018672 vhCDR1
NYWMN

SEQ ID NO: 12578 - protein, 19 aa, Artificial Sequence
  Description of Artificial Sequence: Synthetic peptide
  XENP018672 vhCDR2
EIRLKSNNYATHYAEPVKG

SEQ ID NO: 12579 - protein, 11 aa, Artificial Sequence
  Description of Artificial Sequence: Synthetic peptide
  XENP018672 vhCDR3
AYGNYGGYFDV

SEQ ID NO: 12580 - protein, 11 aa, Artificial Sequence
  Description of Artificial Sequence: Synthetic peptide
  XENP018672 vlCDR1
RASQSVSNDVA

SEQ ID NO: 12581 - protein, 7 aa, Artificial Sequence
  Description of Artificial Sequence: Synthetic peptide
  XENP018672 vlCDR2
YASHRYT

SEQ ID NO: 12582 - protein, 9 aa, Artificial Sequence
  Description of Artificial Sequence: Synthetic peptide
  XENP018672 vlCDR3
QQDYSSPRT

SEQ ID NO: 12583 - protein, 249 aa, Artificial Sequence
  Description of Artificial Sequence: Synthetic polypeptide
  XENP018673 1G6_H1.173_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRQYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 12584 - protein, 122 aa, Artificial Sequence
  Description of Artificial Sequence: Synthetic polypeptide
  VH of XENP018673
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRQYGNYGGYFDVWGAGTLVTVSS

SEQ ID NO: 12585 - protein, 107 aa, Artificial Sequence; identical to SEQ ID NO: 10923
  Description of Artificial Sequence: Synthetic polypeptide
  VL of XENP018673

SEQ ID NO: 12586 - protein, 5 aa, Artificial Sequence
  Description of Artificial Sequence: Synthetic peptide
  XENP018673 vhCDR1
NYWMN

SEQ ID NO: 12587 - protein, 19 aa, Artificial Sequence
  Description of Artificial Sequence: Synthetic peptide
  XENP018673 vhCDR2
EIRLKSNNYATHYAEPVKG

SEQ ID NO: 12588 - protein, 11 aa, Artificial Sequence
  Description of Artificial Sequence: Synthetic peptide
  XENP018673 vhCDR3
QYGNYGGYFDV

SEQ ID NO: 12589 - protein, 11 aa, Artificial Sequence
  Description of Artificial Sequence: Synthetic peptide
  XENP018673 vlCDR1
RASQSVSNDVA

SEQ ID NO: 12590 - protein, 7 aa, Artificial Sequence
  Description of Artificial Sequence: Synthetic peptide
  XENP018673 vlCDR2
YASHRYT

SEQ ID NO: 12591 - protein, 9 aa, Artificial Sequence
  Description of Artificial Sequence: Synthetic peptide
  XENP018673 vlCDR3
QQDYSSPRT

SEQ ID NO: 12592 - protein, 249 aa, Artificial Sequence
  Description of Artificial Sequence: Synthetic polypeptide
  XENP018674 1G6_H1.174_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRDYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 12593 - protein, 122 aa, Artificial Sequence
  Description of Artificial Sequence: Synthetic polypeptide
  VH of XENP018674
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRDYGNYGGYFDVWGAGTLVTVSS

SEQ ID NO: 12594 - protein, 107 aa, Artificial Sequence; identical to SEQ ID NO: 10923
  Description of Artificial Sequence: Synthetic polypeptide
  VL of XENP018674

SEQ ID NO: 12595 - protein, 5 aa, Artificial Sequence
  Description of Artificial Sequence: Synthetic peptide
  XENP018674 vhCDR1
NYWMN

SEQ ID NO: 12596 - protein, 19 aa, Artificial Sequence
  Description of Artificial Sequence: Synthetic peptide
  XENP018674 vhCDR2
EIRLKSNNYATHYAEPVKG

SEQ ID NO: 12597 - protein, 11 aa, Artificial Sequence
  Description of Artificial Sequence: Synthetic peptide
  XENP018674 vhCDR3
DYGNYGGYFDV

SEQ ID NO: 12598 - protein, 11 aa, Artificial Sequence
  Description of Artificial Sequence: Synthetic peptide
  XENP018674 vlCDR1
RASQSVSNDVA

SEQ ID NO: 12599 - protein, 7 aa, Artificial Sequence
  Description of Artificial Sequence: Synthetic peptide
  XENP018674 vlCDR2
YASHRYT

SEQ ID NO: 12600 - protein, 9 aa, Artificial Sequence
  Description of Artificial Sequence: Synthetic peptide
  XENP018674 vlCDR3
QQDYSSPRT

SEQ ID NO: 12601 - protein, 249 aa, Artificial Sequence
  Description of Artificial Sequence: Synthetic polypeptide
  XENP018675 1G6_H1.175_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRKYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 12602 - protein, 122 aa, Artificial Sequence
  Description of Artificial Sequence: Synthetic polypeptide
  VH of XENP018675
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRKYGNYGGYFDVWGAGTLVTVSS

SEQ ID NO: 12603 - protein, 107 aa, Artificial Sequence; identical to SEQ ID NO: 10923
  Description of Artificial Sequence: Synthetic polypeptide
  VL of XENP018675

SEQ ID NO: 12604 - protein, 5 aa, Artificial Sequence
  Description of Artificial Sequence: Synthetic peptide
  XENP018675 vhCDR1
NYWMN

SEQ ID NO: 12605 - protein, 19 aa, Artificial Sequence
  Description of Artificial Sequence: Synthetic peptide
  XENP018675 vhCDR2
EIRLKSNNYATHYAEPVKG

SEQ ID NO: 12606 - protein, 11 aa, Artificial Sequence
  Description of Artificial Sequence: Synthetic peptide
  XENP018675 vhCDR3
KYGNYGGYFDV

SEQ ID NO: 12607 - protein, 11 aa, Artificial Sequence
  Description of Artificial Sequence: Synthetic peptide
  XENP018675 vlCDR1
RASQSVSNDVA

SEQ ID NO: 12608 - protein, 7 aa, Artificial Sequence
  Description of Artificial Sequence: Synthetic peptide
  XENP018675 vlCDR2
YASHRYT

SEQ ID NO: 12609 - protein, 9 aa, Artificial Sequence
  Description of Artificial Sequence: Synthetic peptide
  XENP018675 vlCDR3
QQDYSSPRT

SEQ ID NO: 12610 - protein, 249 aa, Artificial Sequence
  Description of Artificial Sequence: Synthetic polypeptide
  XENP018676 1G6_H1.176_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYFGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 12611 - protein, 122 aa, Artificial Sequence
  Description of Artificial Sequence: Synthetic polypeptide
  VH of XENP018676
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYFGNYGGYFDVWGAGTLVTVSS

SEQ ID NO: 12612 - protein, 107 aa, Artificial Sequence; identical to SEQ ID NO: 10923
  Description of Artificial Sequence: Synthetic polypeptide
  VL of XENP018676

SEQ ID NO: 12613 - protein, 5 aa, Artificial Sequence
  Description of Artificial Sequence: Synthetic peptide
  XENP018676 vhCDR1
NYWMN

SEQ ID NO: 12614 - protein, 19 aa, Artificial Sequence
  Description of Artificial Sequence: Synthetic peptide
  XENP018676 vhCDR2
EIRLKSNNYATHYAEPVKG

SEQ ID NO: 12615 - protein, 11 aa, Artificial Sequence
  Description of Artificial Sequence: Synthetic peptide
  XENP018676 vhCDR3
YFGNYGGYFDV

SEQ ID NO: 12616 - protein, 11 aa, Artificial Sequence
  Description of Artificial Sequence: Synthetic peptide
  XENP018676 vlCDR1
RASQSVSNDVA

SEQ ID NO: 12617 - protein, 7 aa, Artificial Sequence
  Description of Artificial Sequence: Synthetic peptide
  XENP018676 vlCDR2
YASHRYT

SEQ ID NO: 12618 - protein, 9 aa, Artificial Sequence
  Description of Artificial Sequence: Synthetic peptide
  XENP018676 vlCDR3
QQDYSSPRT

SEQ ID NO: 12619 - protein, 249 aa, Artificial Sequence
  Description of Artificial Sequence: Synthetic polypeptide
  XENP018677 1G6_H1.177_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYHGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 12620 - protein, 122 aa, Artificial Sequence
  Description of Artificial Sequence: Synthetic polypeptide
  VH of XENP018677
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYHGNYGGYFDVWGAGTLVTVSS

SEQ ID NO: 12621 - protein, 107 aa, Artificial Sequence; identical to SEQ ID NO: 10923
  Description of Artificial Sequence: Synthetic polypeptide
  VL of XENP018677

SEQ ID NO: 12622 - protein, 5 aa, Artificial Sequence
  Description of Artificial Sequence: Synthetic peptide
  XENP018677 vhCDR1
NYWMN

SEQ ID NO: 12623 - protein, 19 aa, Artificial Sequence
  Description of Artificial Sequence: Synthetic peptide
  XENP018677 vhCDR2
EIRLKSNNYATHYAEPVKG

SEQ ID NO: 12624 - protein, 11 aa, Artificial Sequence
  Description of Artificial Sequence: Synthetic peptide
  XENP018677 vhCDR3
YHGNYGGYFDV

SEQ ID NO: 12625 - protein, 11 aa, Artificial Sequence
  Description of Artificial Sequence: Synthetic peptide
  XENP018677 vlCDR1
RASQSVSNDVA

SEQ ID NO: 12626 - protein, 7 aa, Artificial Sequence
  Description of Artificial Sequence: Synthetic peptide
  XENP018677 vlCDR2
YASHRYT

SEQ ID NO: 12627 - protein, 9 aa, Artificial Sequence
  Description of Artificial Sequence: Synthetic peptide
  XENP018677 vlCDR3
QQDYSSPRT

SEQ ID NO: 12628 - protein, 249 aa, Artificial Sequence
  Description of Artificial Sequence: Synthetic polypeptide
  XENP018678 1G6_H1.178_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYLGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 12629 - protein, 122 aa, Artificial Sequence
  Description of Artificial Sequence: Synthetic polypeptide
  VH of XENP018678
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYLGNYGGYFDVWGAGTLVTVSS

SEQ ID NO: 12630 - protein, 107 aa, Artificial Sequence; identical to SEQ ID NO: 10923
  Description of Artificial Sequence: Synthetic polypeptide
  VL of XENP018678

SEQ ID NO: 12631 - protein, 5 aa, Artificial Sequence
  Description of Artificial Sequence: Synthetic peptide
  XENP018678 vhCDR1
NYWMN

SEQ ID NO: 12632 - protein, 19 aa, Artificial Sequence
  Description of Artificial Sequence: Synthetic peptide
  XENP018678 vhCDR2
EIRLKSNNYATHYAEPVKG

SEQ ID NO: 12633 - protein, 11 aa, Artificial Sequence
  Description of Artificial Sequence: Synthetic peptide
  XENP018678 vhCDR3
YLGNYGGYFDV

SEQ ID NO: 12634 - protein, 11 aa, Artificial Sequence
  Description of Artificial Sequence: Synthetic peptide
  XENP018678 vlCDR1
RASQSVSNDVA

SEQ ID NO: 12635 - protein, 7 aa, Artificial Sequence
  Description of Artificial Sequence: Synthetic peptide
  XENP018678 vlCDR2
YASHRYT

SEQ ID NO: 12636 - protein, 9 aa, Artificial Sequence
  Description of Artificial Sequence: Synthetic peptide
  XENP018678 vlCDR3
QQDYSSPRT

SEQ ID NO: 12637 - protein, 249 aa, Artificial Sequence
  Description of Artificial Sequence: Synthetic polypeptide
  XENP018679 1G6_H1.179_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYWGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 12638 - protein, 122 aa, Artificial Sequence
  Description of Artificial Sequence: Synthetic polypeptide
  VH of XENP018679
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYWGNYGGYFDVWGAGTLVTVSS

SEQ ID NO: 12639 - protein, 107 aa, Artificial Sequence; identical to SEQ ID NO: 10923
  Description of Artificial Sequence: Synthetic polypeptide
  VL of XENP018679

SEQ ID NO: 12640 - protein, 5 aa, Artificial Sequence
  Description of Artificial Sequence: Synthetic peptide
  XENP018679 vhCDR1
NYWMN

SEQ ID NO: 12641 - protein, 19 aa, Artificial Sequence
  Description of Artificial Sequence: Synthetic peptide
  XENP018679 vhCDR2
EIRLKSNNYATHYAEPVKG

SEQ ID NO: 12642 - protein, 11 aa, Artificial Sequence
  Description of Artificial Sequence: Synthetic peptide
  XENP018679 vhCDR3
YWGNYGGYFDV

SEQ ID NO: 12643 - protein, 11 aa, Artificial Sequence
  Description of Artificial Sequence: Synthetic peptide
  XENP018679 vlCDR1
RASQSVSNDVA

SEQ ID NO: 12644 - protein, 7 aa, Artificial Sequence
  Description of Artificial Sequence: Synthetic peptide
  XENP018679 vlCDR2
YASHRYT

SEQ ID NO: 12645 - protein, 9 aa, Artificial Sequence
  Description of Artificial Sequence: Synthetic peptide
  XENP018679 vlCDR3
QQDYSSPRT

SEQ ID NO: 12646 - protein, 249 aa, Artificial Sequence
  Description of Artificial Sequence: Synthetic polypeptide
  XENP018680 1G6_H1.180_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYVGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 12647 - protein, 122 aa, Artificial Sequence
  Description of Artificial Sequence: Synthetic polypeptide
  VH of XENP018680
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYVGNYGGYFDVWGAGTLVTVSS

SEQ ID NO: 12648 - protein, 107 aa, Artificial Sequence; identical to SEQ ID NO: 10923
  Description of Artificial Sequence: Synthetic polypeptide
  VL of XENP018680

SEQ ID NO: 12649 - protein, 5 aa, Artificial Sequence
  Description of Artificial Sequence: Synthetic peptide
  XENP018680 vhCDR1
NYWMN

SEQ ID NO: 12650 - protein, 19 aa, Artificial Sequence
  Description of Artificial Sequence: Synthetic peptide
  XENP018680 vhCDR2
EIRLKSNNYATHYAEPVKG

SEQ ID NO: 12651 - protein, 11 aa, Artificial Sequence
  Description of Artificial Sequence: Synthetic peptide
  XENP018680 vhCDR3
YVGNYGGYFDV

SEQ ID NO: 12652 - protein, 11 aa, Artificial Sequence
  Description of Artificial Sequence: Synthetic peptide
  XENP018680 vlCDR1
RASQSVSNDVA

SEQ ID NO: 12653 - protein, 7 aa, Artificial Sequence
  Description of Artificial Sequence: Synthetic peptide
  XENP018680 vlCDR2
YASHRYT

SEQ ID NO: 12654 - protein, 9 aa, Artificial Sequence
  Description of Artificial Sequence: Synthetic peptide
  XENP018680 vlCDR3
QQDYSSPRT

SEQ ID NO: 12655 - protein, 249 aa, Artificial Sequence
  Description of Artificial Sequence: Synthetic polypeptide
  XENP018681 1G6_H1.181_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYAGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 12656 - protein, 122 aa, Artificial Sequence
  Description of Artificial Sequence: Synthetic polypeptide
  VH of XENP018681
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYAGNYGGYFDVWGAGTLVTVSS

SEQ ID NO: 12657 - protein, 107 aa, Artificial Sequence; identical to SEQ ID NO: 10923
  Description of Artificial Sequence: Synthetic polypeptide
  VL of XENP018681

SEQ ID NO: 12658 - protein, 5 aa, Artificial Sequence
  Description of Artificial Sequence: Synthetic peptide
  XENP018681 vhCDR1
NYWMN

SEQ ID NO: 12659 - protein, 19 aa, Artificial Sequence
  Description of Artificial Sequence: Synthetic peptide
  XENP018681 vhCDR2
EIRLKSNNYATHYAEPVKG

SEQ ID NO: 12660 - protein, 11 aa, Artificial Sequence
  Description of Artificial Sequence: Synthetic peptide
  XENP018681 vhCDR3
YAGNYGGYFDV

SEQ ID NO: 12661 - protein, 11 aa, Artificial Sequence
  Description of Artificial Sequence: Synthetic peptide
  XENP018681 vlCDR1
RASQSVSNDVA

SEQ ID NO: 12662 - protein, 7 aa, Artificial Sequence
  Description of Artificial Sequence: Synthetic peptide
  XENP018681 vlCDR2
YASHRYT

SEQ ID NO: 12663 - protein, 9 aa, Artificial Sequence
  Description of Artificial Sequence: Synthetic peptide
  XENP018681 vlCDR3
QQDYSSPRT

SEQ ID NO: 12664 - protein, 249 aa, Artificial Sequence
  Description of Artificial Sequence: Synthetic polypeptide
  XENP018682 1G6_H1.182_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYQGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 12665 - protein, 122 aa, Artificial Sequence
  Description of Artificial Sequence: Synthetic polypeptide
  VH of XENP018682
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYQGNYGGYFDVWGAGTLVTVSS

SEQ ID NO: 12666 - protein, 107 aa, Artificial Sequence; identical to SEQ ID NO: 10923
  Description of Artificial Sequence: Synthetic polypeptide
  VL of XENP018682

SEQ ID NO: 12667 - protein, 5 aa, Artificial Sequence
  Description of Artificial Sequence: Synthetic peptide
  XENP018682 vhCDR1
NYWMN

SEQ ID NO: 12668 - protein, 19 aa, Artificial Sequence
  Description of Artificial Sequence: Synthetic peptide
  XENP018682 vhCDR2
EIRLKSNNYATHYAEPVKG

SEQ ID NO: 12669 - protein, 11 aa, Artificial Sequence
  Description of Artificial Sequence: Synthetic peptide
  XENP018682 vhCDR3
YQGNYGGYFDV

SEQ ID NO: 12670 - protein, 11 aa, Artificial Sequence
  Description of Artificial Sequence: Synthetic peptide
  XENP018682 vlCDR1
RASQSVSNDVA

SEQ ID NO: 12671 - protein, 7 aa, Artificial Sequence
  Description of Artificial Sequence: Synthetic peptide
  XENP018682 vlCDR2
YASHRYT

SEQ ID NO: 12672 - protein, 9 aa, Artificial Sequence
  Description of Artificial Sequence: Synthetic peptide
  XENP018682 vlCDR3
QQDYSSPRT

SEQ ID NO: 12673 - protein, 249 aa, Artificial Sequence
  Description of Artificial Sequence: Synthetic polypeptide
  XENP018683 1G6_H1.183_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYDGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 12674 - protein, 122 aa, Artificial Sequence
  Description of Artificial Sequence: Synthetic polypeptide
  VH of XENP018683
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYDGNYGGYFDVWGAGTLVTVSS

SEQ ID NO: 12675 - protein, 107 aa, Artificial Sequence; identical to SEQ ID NO: 10923
  Description of Artificial Sequence: Synthetic polypeptide
  VL of XENP018683

SEQ ID NO: 12676 - protein, 5 aa, Artificial Sequence
  Description of Artificial Sequence: Synthetic peptide
  XENP018683 vhCDR1
NYWMN

SEQ ID NO: 12677 - protein, 19 aa, Artificial Sequence
  Description of Artificial Sequence: Synthetic peptide
  XENP018683 vhCDR2
EIRLKSNNYATHYAEPVKG

SEQ ID NO: 12678 - protein, 11 aa, Artificial Sequence
  Description of Artificial Sequence: Synthetic peptide
  XENP018683 vhCDR3
YDGNYGGYFDV

SEQ ID NO: 12679 - protein, 11 aa, Artificial Sequence
  Description of Artificial Sequence: Synthetic peptide
  XENP018683 vlCDR1
RASQSVSNDVA

SEQ ID NO: 12680 - protein, 7 aa, Artificial Sequence
  Description of Artificial Sequence: Synthetic peptide
  XENP018683 vlCDR2
YASHRYT

SEQ ID NO: 12681 - protein, 9 aa, Artificial Sequence
  Description of Artificial Sequence: Synthetic peptide
  XENP018683 vlCDR3
QQDYSSPRT

SEQ ID NO: 12682 - protein, 249 aa, Artificial Sequence
  Description of Artificial Sequence: Synthetic polypeptide
  XENP018684 1G6_H1.184_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYKGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 12683 - protein, 122 aa, Artificial Sequence
  Description of Artificial Sequence: Synthetic polypeptide
  VH of XENP018684
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYKGNYGGYFDVWGAGTLVTVSS

SEQ ID NO: 12684 - protein, 107 aa, Artificial Sequence; identical to SEQ ID NO: 10923
  Description of Artificial Sequence: Synthetic polypeptide
  VL of XENP018684

SEQ ID NO: 12685 - protein, 5 aa, Artificial Sequence
  Description of Artificial Sequence: Synthetic peptide
  XENP018684 vhCDR1
NYWMN

SEQ ID NO: 12686 - protein, 19 aa, Artificial Sequence
  Description of Artificial Sequence: Synthetic peptide
  XENP018684 vhCDR2
EIRLKSNNYATHYAEPVKG

SEQ ID NO: 12687 - protein, 11 aa, Artificial Sequence
  Description of Artificial Sequence: Synthetic peptide
  XENP018684 vhCDR3
YKGNYGGYFDV

SEQ ID NO: 12688 - protein, 11 aa, Artificial Sequence
  Description of Artificial Sequence: Synthetic peptide
  XENP018684 vlCDR1
RASQSVSNDVA

SEQ ID NO: 12689 - protein, 7 aa, Artificial Sequence
  Description of Artificial Sequence: Synthetic peptide
  XENP018684 vlCDR2
YASHRYT

SEQ ID NO: 12690 - protein, 9 aa, Artificial Sequence
  Description of Artificial Sequence: Synthetic peptide
  XENP018684 vlCDR3
QQDYSSPRT

SEQ ID NO: 12691 - protein, 249 aa, Artificial Sequence
  Description of Artificial Sequence: Synthetic polypeptide
  XENP018685 1G6_H1.185_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYANYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 12692 - protein, 122 aa, Artificial Sequence
  Description of Artificial Sequence: Synthetic polypeptide
  VH of XENP018685
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYANYGGYFDVWGAGTLVTVSS

SEQ ID NO: 12693 - protein, 107 aa, Artificial Sequence; identical to SEQ ID NO: 10923
  Description of Artificial Sequence: Synthetic polypeptide
  VL of XENP018685

SEQ ID NO: 12694 - protein, 5 aa, Artificial Sequence
  Description of Artificial Sequence: Synthetic peptide
  XENP018685 vhCDR1
NYWMN

SEQ ID NO: 12695 - protein, 19 aa, Artificial Sequence
  Description of Artificial Sequence: Synthetic peptide
  XENP018685 vhCDR2
EIRLKSNNYATHYAEPVKG

SEQ ID NO: 12696 - protein, 11 aa, Artificial Sequence
  Description of Artificial Sequence: Synthetic peptide
  XENP018685 vhCDR3
YYANYGGYFDV

SEQ ID NO: 12697 - protein, 11 aa, Artificial Sequence
  Description of Artificial Sequence: Synthetic peptide
  XENP018685 vlCDR1
RASQSVSNDVA

SEQ ID NO: 12698 - protein, 7 aa, Artificial Sequence
  Description of Artificial Sequence: Synthetic peptide
  XENP018685 vlCDR2
YASHRYT

SEQ ID NO: 12699 - protein, 9 aa, Artificial Sequence
  Description of Artificial Sequence: Synthetic peptide
  XENP018685 vlCDR3
QQDYSSPRT

SEQ ID NO: 12700 - protein, 249 aa, Artificial Sequence
  Description of Artificial Sequence: Synthetic polypeptide
  XENP018686 1G6_H1.186_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYSNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 12701 - protein, 122 aa, Artificial Sequence
  Description of Artificial Sequence: Synthetic polypeptide
  VH of XENP018686
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYSNYGGYFDVWGAGTLVTVSS

SEQ ID NO: 12702 - protein, 107 aa, Artificial Sequence; identical to SEQ ID NO: 10923
  Description of Artificial Sequence: Synthetic polypeptide
  VL of XENP018686

SEQ ID NO: 12703 - protein, 5 aa, Artificial Sequence
  Description of Artificial Sequence: Synthetic peptide
  XENP018686 vhCDR1
NYWMN

SEQ ID NO: 12704 - protein, 19 aa, Artificial Sequence
  Description of Artificial Sequence: Synthetic peptide
  XENP018686 vhCDR2
EIRLKSNNYATHYAEPVKG

SEQ ID NO: 12705 - protein, 11 aa, Artificial Sequence
  Description of Artificial Sequence: Synthetic peptide
  XENP018686 vhCDR3
YYSNYGGYFDV

SEQ ID NO: 12706 - protein, 11 aa, Artificial Sequence
  Description of Artificial Sequence: Synthetic peptide
  XENP018686 vlCDR1
RASQSVSNDVA

SEQ ID NO: 12707 - protein, 7 aa, Artificial Sequence
  Description of Artificial Sequence: Synthetic peptide
  XENP018686 vlCDR2
YASHRYT

SEQ ID NO: 12708 - protein, 9 aa, Artificial Sequence
  Description of Artificial Sequence: Synthetic peptide
  XENP018686 vlCDR3
QQDYSSPRT

SEQ ID NO: 12709 - protein, 249 aa, Artificial Sequence
  Description of Artificial Sequence: Synthetic polypeptide
  XENP018687 1G6_H1.187_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYTNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 12710 - protein, 122 aa, Artificial Sequence
  Description of Artificial Sequence: Synthetic polypeptide
  VH of XENP018687
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYTNYGGYFDVWGAGTLVTVSS

SEQ ID NO: 12711 - protein, 107 aa, Artificial Sequence; identical to SEQ ID NO: 10923
  Description of Artificial Sequence: Synthetic polypeptide
  VL of XENP018687

SEQ ID NO: 12712 - protein, 5 aa, Artificial Sequence
  Description of Artificial Sequence: Synthetic peptide
  XENP018687 vhCDR1
NYWMN

SEQ ID NO: 12713 - protein, 19 aa, Artificial Sequence
  Description of Artificial Sequence: Synthetic peptide
  XENP018687 vhCDR2
EIRLKSNNYATHYAEPVKG

SEQ ID NO: 12714 - protein, 11 aa, Artificial Sequence
  Description of Artificial Sequence: Synthetic peptide
  XENP018687 vhCDR3
YYTNYGGYFDV

SEQ ID NO: 12715 - protein, 11 aa, Artificial Sequence
  Description of Artificial Sequence: Synthetic peptide
  XENP018687 vlCDR1
RASQSVSNDVA

SEQ ID NO: 12716 - protein, 7 aa, Artificial Sequence
  Description of Artificial Sequence: Synthetic peptide
  XENP018687 vlCDR2
YASHRYT

SEQ ID NO: 12717 - protein, 9 aa, Artificial Sequence
  Description of Artificial Sequence: Synthetic peptide
  XENP018687 vlCDR3
QQDYSSPRT

SEQ ID NO: 12718 - protein, 249 aa, Artificial Sequence
  Description of Artificial Sequence: Synthetic polypeptide
  XENP018688 1G6_H1.188_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYQNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 12719 - protein, 122 aa, Artificial Sequence
  Description of Artificial Sequence: Synthetic polypeptide
  VH of XENP018688
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYQNYGGYFDVWGAGTLVTVSS

SEQ ID NO: 12720 - protein, 107 aa, Artificial Sequence; identical to SEQ ID NO: 10923
  Description of Artificial Sequence: Synthetic polypeptide
  VL of XENP018688

SEQ ID NO: 12721 - protein, 5 aa, Artificial Sequence
  Description of Artificial Sequence: Synthetic peptide
  XENP018688 vhCDR1
NYWMN

SEQ ID NO: 12722 - protein, 19 aa, Artificial Sequence
  Description of Artificial Sequence: Synthetic peptide
  XENP018688 vhCDR2
EIRLKSNNYATHYAEPVKG

SEQ ID NO: 12723 - protein, 11 aa, Artificial Sequence
  Description of Artificial Sequence: Synthetic peptide
  XENP018688 vhCDR3
YYQNYGGYFDV

SEQ ID NO: 12724 - protein, 11 aa, Artificial Sequence
  Description of Artificial Sequence: Synthetic peptide
  XENP018688 vlCDR1
RASQSVSNDVA

SEQ ID NO: 12725 - protein, 7 aa, Artificial Sequence
  Description of Artificial Sequence: Synthetic peptide
  XENP018688 vlCDR2
YASHRYT

SEQ ID NO: 12726 - protein, 9 aa, Artificial Sequence
  Description of Artificial Sequence: Synthetic peptide
  XENP018688 vlCDR3
QQDYSSPRT

SEQ ID NO: 12727 - protein, 249 aa, Artificial Sequence
  Description of Artificial Sequence: Synthetic polypeptide
  XENP018689 1G6_H1.189_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYHNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 12728 - protein, 122 aa, Artificial Sequence
  Description of Artificial Sequence: Synthetic polypeptide
  VH of XENP018689
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYHNYGGYFDVWGAGTLVTVSS

SEQ ID NO: 12729 - protein, 107 aa, Artificial Sequence; identical to SEQ ID NO: 10923
  Description of Artificial Sequence: Synthetic polypeptide
  VL of XENP018689

SEQ ID NO: 12730 - protein, 5 aa, Artificial Sequence
  Description of Artificial Sequence: Synthetic peptide
  XENP018689 vhCDR1
NYWMN

SEQ ID NO: 12731 - protein, 19 aa, Artificial Sequence
  Description of Artificial Sequence: Synthetic peptide
  XENP018689 vhCDR2
EIRLKSNNYATHYAEPVKG

SEQ ID NO: 12732 - protein, 11 aa, Artificial Sequence
  Description of Artificial Sequence: Synthetic peptide
  XENP018689 vhCDR3
YYHNYGGYFDV

SEQ ID NO: 12733 - protein, 11 aa, Artificial Sequence
  Description of Artificial Sequence: Synthetic peptide
  XENP018689 vlCDR1
RASQSVSNDVA

SEQ ID NO: 12734 - protein, 7 aa, Artificial Sequence
  Description of Artificial Sequence: Synthetic peptide
  XENP018689 vlCDR2
YASHRYT

SEQ ID NO: 12735 - protein, 9 aa, Artificial Sequence
  Description of Artificial Sequence: Synthetic peptide
  XENP018689 vlCDR3
QQDYSSPRT

SEQ ID NO: 12736 - protein, 249 aa, Artificial Sequence
  Description of Artificial Sequence: Synthetic polypeptide
  XENP018690 1G6_H1.190_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYDNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 12737 - protein, 122 aa, Artificial Sequence
  Description of Artificial Sequence: Synthetic polypeptide
  VH of XENP018690
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYDNYGGYFDVWGAGTLVTVSS

SEQ ID NO: 12738 - protein, 107 aa, Artificial Sequence; identical to SEQ ID NO: 10923
  Description of Artificial Sequence: Synthetic polypeptide
  VL of XENP018690

SEQ ID NO: 12739 - protein, 5 aa, Artificial Sequence
  Description of Artificial Sequence: Synthetic peptide
  XENP018690 vhCDR1
NYWMN

SEQ ID NO: 12740 - protein, 19 aa, Artificial Sequence
  Description of Artificial Sequence: Synthetic peptide
  XENP018690 vhCDR2
EIRLKSNNYATHYAEPVKG

SEQ ID NO: 12741 - protein, 11 aa, Artificial Sequence
  Description of Artificial Sequence: Synthetic peptide
  XENP018690 vhCDR3
YYDNYGGYFDV

SEQ ID NO: 12742 - protein, 11 aa, Artificial Sequence
  Description of Artificial Sequence: Synthetic peptide
  XENP018690 vlCDR1
RASQSVSNDVA

SEQ ID NO: 12743 - protein, 7 aa, Artificial Sequence
  Description of Artificial Sequence: Synthetic peptide
  XENP018690 vlCDR2
YASHRYT

SEQ ID NO: 12744 - protein, 9 aa, Artificial Sequence
  Description of Artificial Sequence: Synthetic peptide
  XENP018690 vlCDR3
QQDYSSPRT

SEQ ID NO: 12745 - protein, 249 aa, Artificial Sequence
  Description of Artificial Sequence: Synthetic polypeptide
  XENP018691 1G6_H1.191_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYKNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 12746 - protein, 122 aa, Artificial Sequence
  Description of Artificial Sequence: Synthetic polypeptide
  VH of XENP018691
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYKNYGGYFDVWGAGTLVTVSS

SEQ ID NO: 12747 - protein, 107 aa, Artificial Sequence; identical to SEQ ID NO: 10923
  Description of Artificial Sequence: Synthetic polypeptide
  VL of XENP018691

SEQ ID NO: 12748 - protein, 5 aa, Artificial Sequence
  Description of Artificial Sequence: Synthetic peptide
  XENP018691 vhCDR1
NYWMN

SEQ ID NO: 12749 - protein, 19 aa, Artificial Sequence
  Description of Artificial Sequence: Synthetic peptide
  XENP018691 vhCDR2
EIRLKSNNYATHYAEPVKG

SEQ ID NO: 12750 - protein, 11 aa, Artificial Sequence
  Description of Artificial Sequence: Synthetic peptide
  XENP018691 vhCDR3
YYKNYGGYFDV

SEQ ID NO: 12751 - protein, 11 aa, Artificial Sequence
  Description of Artificial Sequence: Synthetic peptide
  XENP018691 vlCDR1
RASQSVSNDVA

SEQ ID NO: 12752 - protein, 7 aa, Artificial Sequence
  Description of Artificial Sequence: Synthetic peptide
  XENP018691 vlCDR2
YASHRYT

SEQ ID NO: 12753 - protein, 9 aa, Artificial Sequence
  Description of Artificial Sequence: Synthetic peptide
  XENP018691 vlCDR3
QQDYSSPRT

SEQ ID NO: 12754 - protein, 249 aa, Artificial Sequence
  Description of Artificial Sequence: Synthetic polypeptide
  XENP018692 1G6_H1.192_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYLNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 12755 - protein, 122 aa, Artificial Sequence
  Description of Artificial Sequence: Synthetic polypeptide
  VH of XENP018692
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYLNYGGYFDVWGAGTLVTVSS

SEQ ID NO: 12756 - protein, 107 aa, Artificial Sequence; identical to SEQ ID NO: 10923
  Description of Artificial Sequence: Synthetic polypeptide
  VL of XENP018692

SEQ ID NO: 12757 - protein, 5 aa, Artificial Sequence
  Description of Artificial Sequence: Synthetic peptide
  XENP018692 vhCDR1
NYWMN

SEQ ID NO: 12758 - protein, 19 aa, Artificial Sequence
  Description of Artificial Sequence: Synthetic peptide
  XENP018692 vhCDR2
EIRLKSNNYATHYAEPVKG

SEQ ID NO: 12759 - protein, 11 aa, Artificial Sequence
  Description of Artificial Sequence: Synthetic peptide
  XENP018692 vhCDR3
YYLNYGGYFDV

SEQ ID NO: 12760 - protein, 11 aa, Artificial Sequence
  Description of Artificial Sequence: Synthetic peptide
  XENP018692 vlCDR1
RASQSVSNDVA

SEQ ID NO: 12761 - protein, 7 aa, Artificial Sequence
  Description of Artificial Sequence: Synthetic peptide
  XENP018692 vlCDR2
YASHRYT

SEQ ID NO: 12762 - protein, 9 aa, Artificial Sequence
  Description of Artificial Sequence: Synthetic peptide
  XENP018692 vlCDR3
QQDYSSPRT

SEQ ID NO: 12763 - protein, 249 aa, Artificial Sequence
  Description of Artificial Sequence: Synthetic polypeptide
  XENP018693 1G6_H1.193_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYFNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 12764 - protein, 122 aa, Artificial Sequence
  Description of Artificial Sequence: Synthetic polypeptide
  VH of XENP018693
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYFNYGGYFDVWGAGTLVTVSS

SEQ ID NO: 12765 - protein, 107 aa, Artificial Sequence; identical to SEQ ID NO: 10923
  Description of Artificial Sequence: Synthetic polypeptide
  VL of XENP018693

SEQ ID NO: 12766 - protein, 5 aa, Artificial Sequence
  Description of Artificial Sequence: Synthetic peptide
  XENP018693 vhCDR1
NYWMN

SEQ ID NO: 12767 - protein, 19 aa, Artificial Sequence
  Description of Artificial Sequence: Synthetic peptide
  XENP018693 vhCDR2
EIRLKSNNYATHYAEPVKG

SEQ ID NO: 12768 - protein, 11 aa, Artificial Sequence
  Description of Artificial Sequence: Synthetic peptide
  XENP018693 vhCDR3
YYFNYGGYFDV

SEQ ID NO: 12769 - protein, 11 aa, Artificial Sequence
  Description of Artificial Sequence: Synthetic peptide
  XENP018693 vlCDR1
RASQSVSNDVA

SEQ ID NO: 12770 - protein, 7 aa, Artificial Sequence
  Description of Artificial Sequence: Synthetic peptide
  XENP018693 vlCDR2
YASHRYT

SEQ ID NO: 12771 - protein, 9 aa, Artificial Sequence
  Description of Artificial Sequence: Synthetic peptide
  XENP018693 vlCDR3
QQDYSSPRT

SEQ ID NO: 12772 - protein, 249 aa, Artificial Sequence
  Description of Artificial Sequence: Synthetic polypeptide
  XENP018694 1G6_H1.194_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGDYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 12773 - protein, 122 aa, Artificial Sequence
  Description of Artificial Sequence: Synthetic polypeptide
  VH of XENP018694
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGDYGGYFDVWGAGTLVTVSS

SEQ ID NO: 12774 - protein, 107 aa, Artificial Sequence; identical to SEQ ID NO: 10923
  Description of Artificial Sequence: Synthetic polypeptide
  VL of XENP018694

SEQ ID NO: 12775 - protein, 5 aa, Artificial Sequence
  Description of Artificial Sequence: Synthetic peptide
  XENP018694 vhCDR1
NYWMN

SEQ ID NO: 12776 - protein, 19 aa, Artificial Sequence
  Description of Artificial Sequence: Synthetic peptide
  XENP018694 vhCDR2
EIRLKSNNYATHYAEPVKG

SEQ ID NO: 12777 - protein, 11 aa, Artificial Sequence
  Description of Artificial Sequence: Synthetic peptide
  XENP018694 vhCDR3
YYGDYGGYFDV

SEQ ID NO: 12778 - protein, 11 aa, Artificial Sequence
  Description of Artificial Sequence: Synthetic peptide
  XENP018694 vlCDR1
RASQSVSNDVA

SEQ ID NO: 12779 - protein, 7 aa, Artificial Sequence
  Description of Artificial Sequence: Synthetic peptide
  XENP018694 vlCDR2
YASHRYT

SEQ ID NO: 12780 - protein, 9 aa, Artificial Sequence
  Description of Artificial Sequence: Synthetic peptide
  XENP018694 vlCDR3
QQDYSSPRT

SEQ ID NO: 12781 - protein, 249 aa, Artificial Sequence
  Description of Artificial Sequence: Synthetic polypeptide
  XENP018695 1G6_H1.195_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGHYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 12782 - protein, 122 aa, Artificial Sequence
  Description of Artificial Sequence: Synthetic polypeptide
  VH of XENP018695
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGHYGGYFDVWGAGTLVTVSS

SEQ ID NO: 12783 - protein, 107 aa, Artificial Sequence; identical to SEQ ID NO: 10923
  Description of Artificial Sequence: Synthetic polypeptide
  VL of XENP018695

SEQ ID NO: 12784 - protein, 5 aa, Artificial Sequence
  Description of Artificial Sequence: Synthetic peptide
  XENP018695 vhCDR1
NYWMN

SEQ ID NO: 12785 - protein, 19 aa, Artificial Sequence
  Description of Artificial Sequence: Synthetic peptide
  XENP018695 vhCDR2
EIRLKSNNYATHYAEPVKG

SEQ ID NO: 12786 - protein, 11 aa, Artificial Sequence
  Description of Artificial Sequence: Synthetic peptide
  XENP018695 vhCDR3
YYGHYGGYFDV

SEQ ID NO: 12787 - protein, 11 aa, Artificial Sequence
  Description of Artificial Sequence: Synthetic peptide
  XENP018695 vlCDR1
RASQSVSNDVA

SEQ ID NO: 12788 - protein, 7 aa, Artificial Sequence
  Description of Artificial Sequence: Synthetic peptide
  XENP018695 vlCDR2
YASHRYT

SEQ ID NO: 12789 - protein, 9 aa, Artificial Sequence
  Description of Artificial Sequence: Synthetic peptide
  XENP018695 vlCDR3
QQDYSSPRT

SEQ ID NO: 12790 - protein, 249 aa, Artificial Sequence
  Description of Artificial Sequence: Synthetic polypeptide
  XENP018696 1G6_H1.196_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGEYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 12791 - protein, 122 aa, Artificial Sequence
  Description of Artificial Sequence: Synthetic polypeptide
  VH of XENP018696
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGEYGGYFDVWGAGTLVTVSS

SEQ ID NO: 12792 - protein, 107 aa, Artificial Sequence; identical to SEQ ID NO: 10923
  Description of Artificial Sequence: Synthetic polypeptide
  VL of XENP018696

SEQ ID NO: 12793 - protein, 5 aa, Artificial Sequence
  Description of Artificial Sequence: Synthetic peptide
  XENP018696 vhCDR1
NYWMN

SEQ ID NO: 12794 - protein, 19 aa, Artificial Sequence
  Description of Artificial Sequence: Synthetic peptide
  XENP018696 vhCDR2
EIRLKSNNYATHYAEPVKG

SEQ ID NO: 12795 - protein, 11 aa, Artificial Sequence
  Description of Artificial Sequence: Synthetic peptide
  XENP018696 vhCDR3
YYGEYGGYFDV

SEQ ID NO: 12796 - protein, 11 aa, Artificial Sequence
  Description of Artificial Sequence: Synthetic peptide
  XENP018696 vlCDR1
RASQSVSNDVA

SEQ ID NO: 12797 - protein, 7 aa, Artificial Sequence
  Description of Artificial Sequence: Synthetic peptide
  XENP018696 vlCDR2
YASHRYT

SEQ ID NO: 12798 - protein, 9 aa, Artificial Sequence
  Description of Artificial Sequence: Synthetic peptide
  XENP018696 vlCDR3
QQDYSSPRT

SEQ ID NO: 12799 - protein, 249 aa, Artificial Sequence
  Description of Artificial Sequence: Synthetic polypeptide
  XENP018701 1G6_H1.197_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGSYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 12800 - protein, 122 aa, Artificial Sequence
  Description of Artificial Sequence: Synthetic polypeptide
  VH of XENP018701
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGSYGGYFDVWGAGTLVTVSS

SEQ ID NO: 12801 - protein, 107 aa, Artificial Sequence; identical to SEQ ID NO: 10923
  Description of Artificial Sequence: Synthetic polypeptide
  VL of XENP018701

SEQ ID NO: 12802 - protein, 5 aa, Artificial Sequence
  Description of Artificial Sequence: Synthetic peptide
  XENP018701 vhCDR1
NYWMN

SEQ ID NO: 12803 - protein, 19 aa, Artificial Sequence
  Description of Artificial Sequence: Synthetic peptide
  XENP018701 vhCDR2
EIRLKSNNYATHYAEPVKG

SEQ ID NO: 12804 - protein, 11 aa, Artificial Sequence
  Description of Artificial Sequence: Synthetic peptide
  XENP018701 vhCDR3
YYGSYGGYFDV

SEQ ID NO: 12805 - protein, 11 aa, Artificial Sequence
  Description of Artificial Sequence: Synthetic peptide
  XENP018701 vlCDR1
RASQSVSNDVA

SEQ ID NO: 12806 - protein, 7 aa, Artificial Sequence
  Description of Artificial Sequence: Synthetic peptide
  XENP018701 vlCDR2
YASHRYT

SEQ ID NO: 12807 - protein, 9 aa, Artificial Sequence
  Description of Artificial Sequence: Synthetic peptide
  XENP018701 vlCDR3
QQDYSSPRT

SEQ ID NO: 12808 - protein, 249 aa, Artificial Sequence
  Description of Artificial Sequence: Synthetic polypeptide
  XENP018702 1G6_H1.198_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGRYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 12809 - protein, 122 aa, Artificial Sequence
  Description of Artificial Sequence: Synthetic polypeptide
  VH of XENP018702
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGRYGGYFDVWGAGTLVTVSS

SEQ ID NO: 12810 - protein, 107 aa, Artificial Sequence; identical to SEQ ID NO: 10923
  Description of Artificial Sequence: Synthetic polypeptide
  VL of XENP018702

SEQ ID NO: 12811 - protein, 5 aa, Artificial Sequence
  Description of Artificial Sequence: Synthetic peptide
  XENP018702 vhCDR1
NYWMN

SEQ ID NO: 12812 - protein, 19 aa, Artificial Sequence
  Description of Artificial Sequence: Synthetic peptide
  XENP018702 vhCDR2
EIRLKSNNYATHYAEPVKG

SEQ ID NO: 12813 - protein, 11 aa, Artificial Sequence
  Description of Artificial Sequence: Synthetic peptide
  XENP018702 vhCDR3
YYGRYGGYFDV

SEQ ID NO: 12814 - protein, 11 aa, Artificial Sequence
  Description of Artificial Sequence: Synthetic peptide
  XENP018702 vlCDR1
RASQSVSNDVA

SEQ ID NO: 12815 - protein, 7 aa, Artificial Sequence
  Description of Artificial Sequence: Synthetic peptide
  XENP018702 vlCDR2
YASHRYT

SEQ ID NO: 12816 - protein, 9 aa, Artificial Sequence
  Description of Artificial Sequence: Synthetic peptide
  XENP018702 vlCDR3
QQDYSSPRT

SEQ ID NO: 12817 - protein, 249 aa, Artificial Sequence
  Description of Artificial Sequence: Synthetic polypeptide
  XENP018703 1G6_H1.199_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGLYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 12818 - protein, 122 aa, Artificial Sequence
  Description of Artificial Sequence: Synthetic polypeptide
  VH of XENP018703
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGLYGGYFDVWGAGTLVTVSS

SEQ ID NO: 12819 - protein, 107 aa, Artificial Sequence; identical to SEQ ID NO: 10923
  Description of Artificial Sequence: Synthetic polypeptide
  VL of XENP018703

SEQ ID NO: 12820 - protein, 5 aa, Artificial Sequence
  Description of Artificial Sequence: Synthetic peptide
  XENP018703 vhCDR1
NYWMN

SEQ ID NO: 12821 - protein, 19 aa, Artificial Sequence
  Description of Artificial Sequence: Synthetic peptide
  XENP018703 vhCDR2
EIRLKSNNYATHYAEPVKG

SEQ ID NO: 12822 - protein, 11 aa, Artificial Sequence
  Description of Artificial Sequence: Synthetic peptide
  XENP018703 vhCDR3
YYGLYGGYFDV

SEQ ID NO: 12823 - protein, 11 aa, Artificial Sequence
  Description of Artificial Sequence: Synthetic peptide
  XENP018703 vlCDR1
RASQSVSNDVA

SEQ ID NO: 12824 - protein, 7 aa, Artificial Sequence
  Description of Artificial Sequence: Synthetic peptide
  XENP018703 vlCDR2
YASHRYT

SEQ ID NO: 12825 - protein, 9 aa, Artificial Sequence
  Description of Artificial Sequence: Synthetic peptide
  XENP018703 vlCDR3
QQDYSSPRT

SEQ ID NO: 12826 - protein, 249 aa, Artificial Sequence
  Description of Artificial Sequence: Synthetic polypeptide
  XENP018704 1G6_H1.200_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGTYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 12827 - protein, 122 aa, Artificial Sequence
  Description of Artificial Sequence: Synthetic polypeptide
  VH of XENP018704
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGTYGGYFDVWGAGTLVTVSS

SEQ ID NO: 12828 - protein, 107 aa, Artificial Sequence; identical to SEQ ID NO: 10923
  Description of Artificial Sequence: Synthetic polypeptide
  VL of XENP018704

SEQ ID NO: 12829 - protein, 5 aa, Artificial Sequence
  Description of Artificial Sequence: Synthetic peptide
  XENP018704 vhCDR1
NYWMN

SEQ ID NO: 12830 - protein, 19 aa, Artificial Sequence
  Description of Artificial Sequence: Synthetic peptide
  XENP018704 vhCDR2
EIRLKSNNYATHYAEPVKG

SEQ ID NO: 12831 - protein, 11 aa, Artificial Sequence
  Description of Artificial Sequence: Synthetic peptide
  XENP018704 vhCDR3
YYGTYGGYFDV

SEQ ID NO: 12832 - protein, 11 aa, Artificial Sequence
  Description of Artificial Sequence: Synthetic peptide
  XENP018704 vlCDR1
RASQSVSNDVA

SEQ ID NO: 12833 - protein, 7 aa, Artificial Sequence
  Description of Artificial Sequence: Synthetic peptide
  XENP018704 vlCDR2
YASHRYT

SEQ ID NO: 12834 - protein, 9 aa, Artificial Sequence
  Description of Artificial Sequence: Synthetic peptide
  XENP018704 vlCDR3
QQDYSSPRT

SEQ ID NO: 12835 - protein, 249 aa, Artificial Sequence
  Description of Artificial Sequence: Synthetic polypeptide
  XENP018705 1G6_H1.201_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGGYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 12836 - protein, 122 aa, Artificial Sequence
  Description of Artificial Sequence: Synthetic polypeptide
  VH of XENP018705
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGGYGGYFDVWGAGTLVTVSS

SEQ ID NO: 12837 - protein, 107 aa, Artificial Sequence; identical to SEQ ID NO: 10923
  Description of Artificial Sequence: Synthetic polypeptide
  VL of XENP018705

SEQ ID NO: 12838 - protein, 5 aa, Artificial Sequence
  Description of Artificial Sequence: Synthetic peptide
  XENP018705 vhCDR1
NYWMN

SEQ ID NO: 12839 - protein, 19 aa, Artificial Sequence
  Description of Artificial Sequence: Synthetic peptide
  XENP018705 vhCDR2
EIRLKSNNYATHYAEPVKG

SEQ ID NO: 12840 - protein, 11 aa, Artificial Sequence
  Description of Artificial Sequence: Synthetic peptide
  XENP018705 vhCDR3
YYGGYGGYFDV

SEQ ID NO: 12841 - protein, 11 aa, Artificial Sequence
  Description of Artificial Sequence: Synthetic peptide
  XENP018705 vlCDR1
RASQSVSNDVA

SEQ ID NO: 12842 - protein, 7 aa, Artificial Sequence
  Description of Artificial Sequence: Synthetic peptide
  XENP018705 vlCDR2
YASHRYT

SEQ ID NO: 12843 - protein, 9 aa, Artificial Sequence
  Description of Artificial Sequence: Synthetic peptide
  XENP018705 vlCDR3
QQDYSSPRT

SEQ ID NO: 12844 - protein, 249 aa, Artificial Sequence
  Description of Artificial Sequence: Synthetic polypeptide
  XENP018706 1G6_H1.202_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGFYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 12845 - protein, 122 aa, Artificial Sequence
  Description of Artificial Sequence: Synthetic polypeptide
  VH of XENP018706
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGFYGGYFDVWGAGTLVTVSS

SEQ ID NO: 12846 - protein, 107 aa, Artificial Sequence; identical to SEQ ID NO: 10923
  Description of Artificial Sequence: Synthetic polypeptide
  VL of XENP018706

SEQ ID NO: 12847 - protein, 5 aa, Artificial Sequence
  Description of Artificial Sequence: Synthetic peptide
  XENP018706 vhCDR1
NYWMN

SEQ ID NO: 12848 - protein, 19 aa, Artificial Sequence
  Description of Artificial Sequence: Synthetic peptide
  XENP018706 vhCDR2
EIRLKSNNYATHYAEPVKG

SEQ ID NO: 12849 - protein, 11 aa, Artificial Sequence
  Description of Artificial Sequence: Synthetic peptide
  XENP018706 vhCDR3
YYGFYGGYFDV

SEQ ID NO: 12850 - protein, 11 aa, Artificial Sequence
  Description of Artificial Sequence: Synthetic peptide
  XENP018706 vlCDR1
RASQSVSNDVA

SEQ ID NO: 12851 - protein, 7 aa, Artificial Sequence
  Description of Artificial Sequence: Synthetic peptide
  XENP018706 vlCDR2
YASHRYT

SEQ ID NO: 12852 - protein, 9 aa, Artificial Sequence
  Description of Artificial Sequence: Synthetic peptide
  XENP018706 vlCDR3
QQDYSSPRT

SEQ ID NO: 12853 - protein, 249 aa, Artificial Sequence
  Description of Artificial Sequence: Synthetic polypeptide
  XENP018707 1G6_H1.203_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNFGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 12854 - protein, 122 aa, Artificial Sequence
  Description of Artificial Sequence: Synthetic polypeptide
  VH of XENP018707
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNFGGYFDVWGAGTLVTVSS

SEQ ID NO: 12855 - protein, 107 aa, Artificial Sequence; identical to SEQ ID NO: 10923
  Description of Artificial Sequence: Synthetic polypeptide
  VL of XENP018707

SEQ ID NO: 12856 - protein, 5 aa, Artificial Sequence
  Description of Artificial Sequence: Synthetic peptide
  XENP018707 vhCDR1
NYWMN

SEQ ID NO: 12857 - protein, 19 aa, Artificial Sequence
  Description of Artificial Sequence: Synthetic peptide
  XENP018707 vhCDR2
EIRLKSNNYATHYAEPVKG

SEQ ID NO: 12858 - protein, 11 aa, Artificial Sequence
  Description of Artificial Sequence: Synthetic peptide
  XENP018707 vhCDR3
YYGNFGGYFDV

SEQ ID NO: 12859 - protein, 11 aa, Artificial Sequence
  Description of Artificial Sequence: Synthetic peptide
  XENP018707 vlCDR1
RASQSVSNDVA

SEQ ID NO: 12860 - protein, 7 aa, Artificial Sequence
  Description of Artificial Sequence: Synthetic peptide
  XENP018707 vlCDR2
YASHRYT

SEQ ID NO: 12861 - protein, 9 aa, Artificial Sequence
  Description of Artificial Sequence: Synthetic peptide
  XENP018707 vlCDR3
QQDYSSPRT

SEQ ID NO: 12862 - protein, 249 aa, Artificial Sequence
  Description of Artificial Sequence: Synthetic polypeptide
  XENP018708 1G6_H1.204_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNHGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 12863 - protein, 122 aa, Artificial Sequence
  Description of Artificial Sequence: Synthetic polypeptide
  VH of XENP018708
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNHGGYFDVWGAGTLVTVSS

SEQ ID NO: 12864 - protein, 107 aa, Artificial Sequence; identical to SEQ ID NO: 10923
  Description of Artificial Sequence: Synthetic polypeptide
  VL of XENP018708

SEQ ID NO: 12865 - protein, 5 aa, Artificial Sequence
  Description of Artificial Sequence: Synthetic peptide
  XENP018708 vhCDR1
NYWMN

SEQ ID NO: 12866 - protein, 19 aa, Artificial Sequence
  Description of Artificial Sequence: Synthetic peptide
  XENP018708 vhCDR2
EIRLKSNNYATHYAEPVKG

SEQ ID NO: 12867 - protein, 11 aa, Artificial Sequence
  Description of Artificial Sequence: Synthetic peptide
  XENP018708 vhCDR3
YYGNHGGYFDV

SEQ ID NO: 12868 - protein, 11 aa, Artificial Sequence
  Description of Artificial Sequence: Synthetic peptide
  XENP018708 vlCDR1
RASQSVSNDVA

SEQ ID NO: 12869 - protein, 7 aa, Artificial Sequence
  Description of Artificial Sequence: Synthetic peptide
  XENP018708 vlCDR2
YASHRYT

SEQ ID NO: 12870 - protein, 9 aa, Artificial Sequence
  Description of Artificial Sequence: Synthetic peptide
  XENP018708 vlCDR3
QQDYSSPRT

SEQ ID NO: 12871 - protein, 249 aa, Artificial Sequence
  Description of Artificial Sequence: Synthetic polypeptide
  XENP018709 1G6_H1.205_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNLGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 12872 - protein, 122 aa, Artificial Sequence
  Description of Artificial Sequence: Synthetic polypeptide
  VH of XENP018709
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNLGGYFDVWGAGTLVTVSS

SEQ ID NO: 12873 - protein, 107 aa, Artificial Sequence; identical to SEQ ID NO: 10923
  Description of Artificial Sequence: Synthetic polypeptide
  VL of XENP018709

SEQ ID NO: 12874 - protein, 5 aa, Artificial Sequence
  Description of Artificial Sequence: Synthetic peptide
  XENP018709 vhCDR1
NYWMN

SEQ ID NO: 12875 - protein, 19 aa, Artificial Sequence
  Description of Artificial Sequence: Synthetic peptide
  XENP018709 vhCDR2
EIRLKSNNYATHYAEPVKG

SEQ ID NO: 12876 - protein, 11 aa, Artificial Sequence
  Description of Artificial Sequence: Synthetic peptide
  XENP018709 vhCDR3
YYGNLGGYFDV

SEQ ID NO: 12877 - protein, 11 aa, Artificial Sequence
  Description of Artificial Sequence: Synthetic peptide
  XENP018709 vlCDR1
RASQSVSNDVA

SEQ ID NO: 12878 - protein, 7 aa, Artificial Sequence
  Description of Artificial Sequence: Synthetic peptide
  XENP018709 vlCDR2
YASHRYT

SEQ ID NO: 12879 - protein, 9 aa, Artificial Sequence
  Description of Artificial Sequence: Synthetic peptide
  XENP018709 vlCDR3
QQDYSSPRT

SEQ ID NO: 12880 - protein, 249 aa, Artificial Sequence
  Description of Artificial Sequence: Synthetic polypeptide
  XENP018710 1G6_H1.206_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNWGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 12881 - protein, 122 aa, Artificial Sequence
  Description of Artificial Sequence: Synthetic polypeptide
  VH of XENP018710
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNWGGYFDVWGAGTLVTVSS

SEQ ID NO: 12882 - protein, 107 aa, Artificial Sequence; identical to SEQ ID NO: 10923
  Description of Artificial Sequence: Synthetic polypeptide
  VL of XENP018710

SEQ ID NO: 12883 - protein, 5 aa, Artificial Sequence
  Description of Artificial Sequence: Synthetic peptide
  XENP018710 vhCDR1
NYWMN

SEQ ID NO: 12884 - protein, 19 aa, Artificial Sequence
  Description of Artificial Sequence: Synthetic peptide
  XENP018710 vhCDR2
EIRLKSNNYATHYAEPVKG

SEQ ID NO: 12885 - protein, 11 aa, Artificial Sequence
  Description of Artificial Sequence: Synthetic peptide
  XENP018710 vhCDR3
YYGNWGGYFDV

SEQ ID NO: 12886 - protein, 11 aa, Artificial Sequence
  Description of Artificial Sequence: Synthetic peptide
  XENP018710 vlCDR1
RASQSVSNDVA

SEQ ID NO: 12887 - protein, 7 aa, Artificial Sequence
  Description of Artificial Sequence: Synthetic peptide
  XENP018710 vlCDR2
YASHRYT

SEQ ID NO: 12888 - protein, 9 aa, Artificial Sequence
  Description of Artificial Sequence: Synthetic peptide
  XENP018710 vlCDR3
QQDYSSPRT

SEQ ID NO: 12889 - protein, 249 aa, Artificial Sequence
  Description of Artificial Sequence: Synthetic polypeptide
  XENP018711 1G6_H1.207_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNVGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 12890 - protein, 122 aa, Artificial Sequence
  Description of Artificial Sequence: Synthetic polypeptide
  VH of XENP018711
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNVGGYFDVWGAGTLVTVSS

SEQ ID NO: 12891 - protein, 107 aa, Artificial Sequence; identical to SEQ ID NO: 10923
  Description of Artificial Sequence: Synthetic polypeptide
  VL of XENP018711

SEQ ID NO: 12892 - protein, 5 aa, Artificial Sequence
  Description of Artificial Sequence: Synthetic peptide
  XENP018711 vhCDR1
NYWMN

SEQ ID NO: 12893 - protein, 19 aa, Artificial Sequence
  Description of Artificial Sequence: Synthetic peptide
  XENP018711 vhCDR2
EIRLKSNNYATHYAEPVKG

SEQ ID NO: 12894 - protein, 11 aa, Artificial Sequence
  Description of Artificial Sequence: Synthetic peptide
  XENP018711 vhCDR3
YYGNVGGYFDV

SEQ ID NO: 12895 - protein, 11 aa, Artificial Sequence
  Description of Artificial Sequence: Synthetic peptide
  XENP018711 vlCDR1
RASQSVSNDVA

SEQ ID NO: 12896 - protein, 7 aa, Artificial Sequence
  Description of Artificial Sequence: Synthetic peptide
  XENP018711 vlCDR2
YASHRYT

SEQ ID NO: 12897 - protein, 9 aa, Artificial Sequence
  Description of Artificial Sequence: Synthetic peptide
  XENP018711 vlCDR3
QQDYSSPRT

SEQ ID NO: 12898 - protein, 249 aa, Artificial Sequence
  Description of Artificial Sequence: Synthetic polypeptide
  XENP018712 1G6_H1.208_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNAGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 12899 - protein, 122 aa, Artificial Sequence
  Description of Artificial Sequence: Synthetic polypeptide
  VH of XENP018712
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNAGGYFDVWGAGTLVTVSS

SEQ ID NO: 12900 - protein, 107 aa, Artificial Sequence; identical to SEQ ID NO: 10923
  Description of Artificial Sequence: Synthetic polypeptide
  VL of XENP018712

SEQ ID NO: 12901 - protein, 5 aa, Artificial Sequence
  Description of Artificial Sequence: Synthetic peptide
  XENP018712 vhCDR1
NYWMN

SEQ ID NO: 12902 - protein, 19 aa, Artificial Sequence
  Description of Artificial Sequence: Synthetic peptide
  XENP018712 vhCDR2
EIRLKSNNYATHYAEPVKG

SEQ ID NO: 12903 - protein, 11 aa, Artificial Sequence
  Description of Artificial Sequence: Synthetic peptide
  XENP018712 vhCDR3
YYGNAGGYFDV

SEQ ID NO: 12904 - protein, 11 aa, Artificial Sequence
  Description of Artificial Sequence: Synthetic peptide
  XENP018712 vlCDR1
RASQSVSNDVA

SEQ ID NO: 12905 - protein, 7 aa, Artificial Sequence
  Description of Artificial Sequence: Synthetic peptide
  XENP018712 vlCDR2
YASHRYT

SEQ ID NO: 12906 - protein, 9 aa, Artificial Sequence
  Description of Artificial Sequence: Synthetic peptide
  XENP018712 vlCDR3
QQDYSSPRT

SEQ ID NO: 12907 - protein, 249 aa, Artificial Sequence
  Description of Artificial Sequence: Synthetic polypeptide
  XENP018713 1G6_H1.209_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNQGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 12908 - protein, 122 aa, Artificial Sequence
  Description of Artificial Sequence: Synthetic polypeptide
  VH of XENP018713
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNQGGYFDVWGAGTLVTVSS

SEQ ID NO: 12909 - protein, 107 aa, Artificial Sequence; identical to SEQ ID NO: 10923
  Description of Artificial Sequence: Synthetic polypeptide
  VL of XENP018713

SEQ ID NO: 12910 - protein, 5 aa, Artificial Sequence
  Description of Artificial Sequence: Synthetic peptide
  XENP018713 vhCDR1
NYWMN

SEQ ID NO: 12911 - protein, 19 aa, Artificial Sequence
  Description of Artificial Sequence: Synthetic peptide
  XENP018713 vhCDR2
EIRLKSNNYATHYAEPVKG

SEQ ID NO: 12912 - protein, 11 aa, Artificial Sequence
  Description of Artificial Sequence: Synthetic peptide
  XENP018713 vhCDR3
YYGNQGGYFDV

SEQ ID NO: 12913 - protein, 11 aa, Artificial Sequence
  Description of Artificial Sequence: Synthetic peptide
  XENP018713 vlCDR1
RASQSVSNDVA

SEQ ID NO: 12914 - protein, 7 aa, Artificial Sequence
  Description of Artificial Sequence: Synthetic peptide
  XENP018713 vlCDR2
YASHRYT

SEQ ID NO: 12915 - protein, 9 aa, Artificial Sequence
  Description of Artificial Sequence: Synthetic peptide
  XENP018713 vlCDR3
QQDYSSPRT

SEQ ID NO: 12916 - protein, 249 aa, Artificial Sequence
  Description of Artificial Sequence: Synthetic polypeptide
  XENP018714 1G6_H1.210_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNEGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 12917 - protein, 122 aa, Artificial Sequence
  Description of Artificial Sequence: Synthetic polypeptide
  VH of XENP018714
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNEGGYFDVWGAGTLVTVSS

SEQ ID NO: 12918 - protein, 107 aa, Artificial Sequence; identical to SEQ ID NO: 10923
  Description of Artificial Sequence: Synthetic polypeptide
  VL of XENP018714

SEQ ID NO: 12919 - protein, 5 aa, Artificial Sequence
  Description of Artificial Sequence: Synthetic peptide
  XENP018714 vhCDR1
NYWMN

SEQ ID NO: 12920 - protein, 19 aa, Artificial Sequence
  Description of Artificial Sequence: Synthetic peptide
  XENP018714 vhCDR2
EIRLKSNNYATHYAEPVKG

SEQ ID NO: 12921 - protein, 11 aa, Artificial Sequence
  Description of Artificial Sequence: Synthetic peptide
  XENP018714 vhCDR3
YYGNEGGYFDV

SEQ ID NO: 12922 - protein, 11 aa, Artificial Sequence
  Description of Artificial Sequence: Synthetic peptide
  XENP018714 vlCDR1
RASQSVSNDVA

SEQ ID NO: 12923 - protein, 7 aa, Artificial Sequence
  Description of Artificial Sequence: Synthetic peptide
  XENP018714 vlCDR2
YASHRYT

SEQ ID NO: 12924 - protein, 9 aa, Artificial Sequence
  Description of Artificial Sequence: Synthetic peptide
  XENP018714 vlCDR3
QQDYSSPRT

SEQ ID NO: 12925 - protein, 249 aa, Artificial Sequence
  Description of Artificial Sequence: Synthetic polypeptide
  XENP018715 1G6_H1.211_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNKGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 12926 - protein, 122 aa, Artificial Sequence
  Description of Artificial Sequence: Synthetic polypeptide
  VH of XENP018715
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNKGGYFDVWGAGTLVTVSS

SEQ ID NO: 12927 - protein, 107 aa, Artificial Sequence; identical to SEQ ID NO: 10923
  Description of Artificial Sequence: Synthetic polypeptide
  VL of XENP018715

SEQ ID NO: 12928 - protein, 5 aa, Artificial Sequence
  Description of Artificial Sequence: Synthetic peptide
  XENP018715 vhCDR1
NYWMN

SEQ ID NO: 12929 - protein, 19 aa, Artificial Sequence
  Description of Artificial Sequence: Synthetic peptide
  XENP018715 vhCDR2
EIRLKSNNYATHYAEPVKG

SEQ ID NO: 12930 - protein, 11 aa, Artificial Sequence
  Description of Artificial Sequence: Synthetic peptide
  XENP018715 vhCDR3
YYGNKGGYFDV

SEQ ID NO: 12931 - protein, 11 aa, Artificial Sequence
  Description of Artificial Sequence: Synthetic peptide
  XENP018715 vlCDR1
RASQSVSNDVA

SEQ ID NO: 12932 - protein, 7 aa, Artificial Sequence
  Description of Artificial Sequence: Synthetic peptide
  XENP018715 vlCDR2
YASHRYT

SEQ ID NO: 12933 - protein, 9 aa, Artificial Sequence
  Description of Artificial Sequence: Synthetic peptide
  XENP018715 vlCDR3
QQDYSSPRT

SEQ ID NO: 12934 - protein, 249 aa, Artificial Sequence
  Description of Artificial Sequence: Synthetic polypeptide
  XENP018716 1G6_H1.212_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYAGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 12935 - protein, 122 aa, Artificial Sequence
  Description of Artificial Sequence: Synthetic polypeptide
  VH of XENP018716
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYAGYFDVWGAGTLVTVSS

SEQ ID NO: 12936 - protein, 107 aa, Artificial Sequence; identical to SEQ ID NO: 10923
  Description of Artificial Sequence: Synthetic polypeptide
  VL of XENP018716

SEQ ID NO: 12937 - protein, 5 aa, Artificial Sequence
  Description of Artificial Sequence: Synthetic peptide
  XENP018716 vhCDR1
NYWMN

SEQ ID NO: 12938 - protein, 19 aa, Artificial Sequence
  Description of Artificial Sequence: Synthetic peptide
  XENP018716 vhCDR2
EIRLKSNNYATHYAEPVKG

SEQ ID NO: 12939 - protein, 11 aa, Artificial Sequence
  Description of Artificial Sequence: Synthetic peptide
  XENP018716 vhCDR3
YYGNYAGYFDV

SEQ ID NO: 12940 - protein, 11 aa, Artificial Sequence
  Description of Artificial Sequence: Synthetic peptide
  XENP018716 vlCDR1
RASQSVSNDVA

SEQ ID NO: 12941 - protein, 7 aa, Artificial Sequence
  Description of Artificial Sequence: Synthetic peptide
  XENP018716 vlCDR2
YASHRYT

SEQ ID NO: 12942 - protein, 9 aa, Artificial Sequence
  Description of Artificial Sequence: Synthetic peptide
  XENP018716 vlCDR3
QQDYSSPRT

SEQ ID NO: 12943 - protein, 249 aa, Artificial Sequence
  Description of Artificial Sequence: Synthetic polypeptide
  XENP018717 1G6_H1.213_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYQGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 12944 - protein, 122 aa, Artificial Sequence
  Description of Artificial Sequence: Synthetic polypeptide
  VH of XENP018717
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYQGYFDVWGAGTLVTVSS

SEQ ID NO: 12945 - protein, 107 aa, Artificial Sequence; identical to SEQ ID NO: 10923
  Description of Artificial Sequence: Synthetic polypeptide
  VL of XENP018717

SEQ ID NO: 12946 - protein, 5 aa, Artificial Sequence
  Description of Artificial Sequence: Synthetic peptide
  XENP018717 vhCDR1
NYWMN

SEQ ID NO: 12947 - protein, 19 aa, Artificial Sequence
  Description of Artificial Sequence: Synthetic peptide
  XENP018717 vhCDR2
EIRLKSNNYATHYAEPVKG

SEQ ID NO: 12948 - protein, 11 aa, Artificial Sequence
  Description of Artificial Sequence: Synthetic peptide
  XENP018717 vhCDR3
YYGNYQGYFDV

SEQ ID NO: 12949 - protein, 11 aa, Artificial Sequence
  Description of Artificial Sequence: Synthetic peptide
  XENP018717 vlCDR1
RASQSVSNDVA

SEQ ID NO: 12950 - protein, 7 aa, Artificial Sequence
  Description of Artificial Sequence: Synthetic peptide
  XENP018717 vlCDR2
YASHRYT

SEQ ID NO: 12951 - protein, 9 aa, Artificial Sequence
  Description of Artificial Sequence: Synthetic peptide
  XENP018717 vlCDR3
QQDYSSPRT

SEQ ID NO: 12952 - protein, 249 aa, Artificial Sequence
  Description of Artificial Sequence: Synthetic polypeptide
  XENP018718 1G6_H1.214_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYHGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 12953 - protein, 122 aa, Artificial Sequence
  Description of Artificial Sequence: Synthetic polypeptide
  VH of XENP018718
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYHGYFDVWGAGTLVTVSS

SEQ ID NO: 12954 - protein, 107 aa, Artificial Sequence; identical to SEQ ID NO: 10923
  Description of Artificial Sequence: Synthetic polypeptide
  VL of XENP018718

SEQ ID NO: 12955 - protein, 5 aa, Artificial Sequence
  Description of Artificial Sequence: Synthetic peptide
  XENP018718 vhCDR1
NYWMN

SEQ ID NO: 12956 - protein, 19 aa, Artificial Sequence
  Description of Artificial Sequence: Synthetic peptide
  XENP018718 vhCDR2
EIRLKSNNYATHYAEPVKG

SEQ ID NO: 12957 - protein, 11 aa, Artificial Sequence
  Description of Artificial Sequence: Synthetic peptide
  XENP018718 vhCDR3
YYGNYHGYFDV

SEQ ID NO: 12958 - protein, 11 aa, Artificial Sequence
  Description of Artificial Sequence: Synthetic peptide
  XENP018718 vlCDR1
RASQSVSNDVA

SEQ ID NO: 12959 - protein, 7 aa, Artificial Sequence
  Description of Artificial Sequence: Synthetic peptide
  XENP018718 vlCDR2
YASHRYT

SEQ ID NO: 12960 - protein, 9 aa, Artificial Sequence
  Description of Artificial Sequence: Synthetic peptide
  XENP018718 vlCDR3
QQDYSSPRT

SEQ ID NO: 12961 - protein, 249 aa, Artificial Sequence
  Description of Artificial Sequence: Synthetic polypeptide
  XENP018719 1G6_H1.215_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYDGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 12962 - protein, 122 aa, Artificial Sequence
  Description of Artificial Sequence: Synthetic polypeptide
  VH of XENP018719
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYDGYFDVWGAGTLVTVSS

SEQ ID NO: 12963 - protein, 107 aa, Artificial Sequence; identical to SEQ ID NO: 10923
  Description of Artificial Sequence: Synthetic polypeptide
  VL of XENP018719

SEQ ID NO: 12964 - protein, 5 aa, Artificial Sequence
  Description of Artificial Sequence: Synthetic peptide
  XENP018719 vhCDR1
NYWMN

SEQ ID NO: 12965 - protein, 19 aa, Artificial Sequence
  Description of Artificial Sequence: Synthetic peptide
  XENP018719 vhCDR2
EIRLKSNNYATHYAEPVKG

SEQ ID NO: 12966 - protein, 11 aa, Artificial Sequence
  Description of Artificial Sequence: Synthetic peptide
  XENP018719 vhCDR3
YYGNYDGYFDV

SEQ ID NO: 12967 - protein, 11 aa, Artificial Sequence
  Description of Artificial Sequence: Synthetic peptide
  XENP018719 vlCDR1
RASQSVSNDVA

SEQ ID NO: 12968 - protein, 7 aa, Artificial Sequence
  Description of Artificial Sequence: Synthetic peptide
  XENP018719 vlCDR2
YASHRYT

SEQ ID NO: 12969 - protein, 9 aa, Artificial Sequence
  Description of Artificial Sequence: Synthetic peptide
  XENP018719 vlCDR3
QQDYSSPRT

SEQ ID NO: 12970 - protein, 249 aa, Artificial Sequence
  Description of Artificial Sequence: Synthetic polypeptide
  XENP018720 1G6_H1.216_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYKGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 12971 - protein, 122 aa, Artificial Sequence
  Description of Artificial Sequence: Synthetic polypeptide
  VH of XENP018720
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYKGYFDVWGAGTLVTVSS

SEQ ID NO: 12972 - protein, 107 aa, Artificial Sequence; identical to SEQ ID NO: 10923
  Description of Artificial Sequence: Synthetic polypeptide
  VL of XENP018720

SEQ ID NO: 12973 - protein, 5 aa, Artificial Sequence
  Description of Artificial Sequence: Synthetic peptide
  XENP018720 vhCDR1
NYWMN

SEQ ID NO: 12974 - protein, 19 aa, Artificial Sequence
  Description of Artificial Sequence: Synthetic peptide
  XENP018720 vhCDR2
EIRLKSNNYATHYAEPVKG

SEQ ID NO: 12975 - protein, 11 aa, Artificial Sequence
  Description of Artificial Sequence: Synthetic peptide
  XENP018720 vhCDR3
YYGNYKGYFDV

SEQ ID NO: 12976 - protein, 11 aa, Artificial Sequence
  Description of Artificial Sequence: Synthetic peptide
  XENP018720 vlCDR1
RASQSVSNDVA

SEQ ID NO: 12977 - protein, 7 aa, Artificial Sequence
  Description of Artificial Sequence: Synthetic peptide
  XENP018720 vlCDR2
YASHRYT

SEQ ID NO: 12978 - protein, 9 aa, Artificial Sequence
  Description of Artificial Sequence: Synthetic peptide
  XENP018720 vlCDR3
QQDYSSPRT

SEQ ID NO: 12979 - protein, 249 aa, Artificial Sequence
  Description of Artificial Sequence: Synthetic polypeptide
  XENP018721 1G6_H1.217_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYLGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 12980 - protein, 122 aa, Artificial Sequence
  Description of Artificial Sequence: Synthetic polypeptide
  VH of XENP018721
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYLGYFDVWGAGTLVTVSS

SEQ ID NO: 12981 - protein, 107 aa, Artificial Sequence; identical to SEQ ID NO: 10923
  Description of Artificial Sequence: Synthetic polypeptide
  VL of XENP018721

SEQ ID NO: 12982 - protein, 5 aa, Artificial Sequence
  Description of Artificial Sequence: Synthetic peptide
  XENP018721 vhCDR1
NYWMN

SEQ ID NO: 12983 - protein, 19 aa, Artificial Sequence
  Description of Artificial Sequence: Synthetic peptide
  XENP018721 vhCDR2
EIRLKSNNYATHYAEPVKG

SEQ ID NO: 12984 - protein, 11 aa, Artificial Sequence
  Description of Artificial Sequence: Synthetic peptide
  XENP018721 vhCDR3
YYGNYLGYFDV

SEQ ID NO: 12985 - protein, 11 aa, Artificial Sequence
  Description of Artificial Sequence: Synthetic peptide
  XENP018721 vlCDR1
RASQSVSNDVA

SEQ ID NO: 12986 - protein, 7 aa, Artificial Sequence
  Description of Artificial Sequence: Synthetic peptide
  XENP018721 vlCDR2
YASHRYT

SEQ ID NO: 12987 - protein, 9 aa, Artificial Sequence
  Description of Artificial Sequence: Synthetic peptide
  XENP018721 vlCDR3
QQDYSSPRT

SEQ ID NO: 12988 - protein, 249 aa, Artificial Sequence
  Description of Artificial Sequence: Synthetic polypeptide
  XENP018722 1G6_H1.218_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYFGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 12989 - protein, 122 aa, Artificial Sequence
  Description of Artificial Sequence: Synthetic polypeptide
  VH of XENP018722
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYFGYFDVWGAGTLVTVSS

SEQ ID NO: 12990 - protein, 107 aa, Artificial Sequence; identical to SEQ ID NO: 10923
  Description of Artificial Sequence: Synthetic polypeptide
  VL of XENP018722

SEQ ID NO: 12991 - protein, 5 aa, Artificial Sequence
  Description of Artificial Sequence: Synthetic peptide
  XENP018722 vhCDR1
NYWMN

SEQ ID NO: 12992 - protein, 19 aa, Artificial Sequence
  Description of Artificial Sequence: Synthetic peptide
  XENP018722 vhCDR2
EIRLKSNNYATHYAEPVKG

SEQ ID NO: 12993 - protein, 11 aa, Artificial Sequence
  Description of Artificial Sequence: Synthetic peptide
  XENP018722 vhCDR3
YYGNYFGYFDV

SEQ ID NO: 12994 - protein, 11 aa, Artificial Sequence
  Description of Artificial Sequence: Synthetic peptide
  XENP018722 vlCDR1
RASQSVSNDVA

SEQ ID NO: 12995 - protein, 7 aa, Artificial Sequence
  Description of Artificial Sequence: Synthetic peptide
  XENP018722 vlCDR2
YASHRYT

SEQ ID NO: 12996 - protein, 9 aa, Artificial Sequence
  Description of Artificial Sequence: Synthetic peptide
  XENP018722 vlCDR3
QQDYSSPRT

SEQ ID NO: 12997 - protein, 249 aa, Artificial Sequence
  Description of Artificial Sequence: Synthetic polypeptide
  XENP018723 1G6_H1.219_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGAYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 12998 - protein, 122 aa, Artificial Sequence
  Description of Artificial Sequence: Synthetic polypeptide
  VH of XENP018723
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGAYFDVWGAGTLVTVSS

SEQ ID NO: 12999 - protein, 107 aa, Artificial Sequence; identical to SEQ ID NO: 10923
  Description of Artificial Sequence: Synthetic polypeptide
  VL of XENP018723

SEQ ID NO: 13000 - protein, 5 aa, Artificial Sequence
  Description of Artificial Sequence: Synthetic peptide
  XENP018723 vhCDR1
NYWMN

SEQ ID NO: 13001 - protein, 19 aa, Artificial Sequence
  Description of Artificial Sequence: Synthetic peptide
  XENP018723 vhCDR2
EIRLKSNNYATHYAEPVKG

SEQ ID NO: 13002 - protein, 11 aa, Artificial Sequence
  Description of Artificial Sequence: Synthetic peptide
  XENP018723 vhCDR3
YYGNYGAYFDV

SEQ ID NO: 13003 - protein, 11 aa, Artificial Sequence
  Description of Artificial Sequence: Synthetic peptide
  XENP018723 vlCDR1
RASQSVSNDVA

SEQ ID NO: 13004 - protein, 7 aa, Artificial Sequence
  Description of Artificial Sequence: Synthetic peptide
  XENP018723 vlCDR2
YASHRYT

SEQ ID NO: 13005 - protein, 9 aa, Artificial Sequence
  Description of Artificial Sequence: Synthetic peptide
  XENP018723 vlCDR3
QQDYSSPRT

SEQ ID NO: 13006 - protein, 249 aa, Artificial Sequence
  Description of Artificial Sequence: Synthetic polypeptide
  XENP018724 1G6_H1.220_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGSYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 13007 - protein, 122 aa, Artificial Sequence
  Description of Artificial Sequence: Synthetic polypeptide
  VH of XENP018724
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGSYFDVWGAGTLVTVSS

SEQ ID NO: 13008 - protein, 107 aa, Artificial Sequence; identical to SEQ ID NO: 10923
  Description of Artificial Sequence: Synthetic polypeptide
  VL of XENP018724

SEQ ID NO: 13009 - protein, 5 aa, Artificial Sequence
  Description of Artificial Sequence: Synthetic peptide
  XENP018724 vhCDR1
NYWMN

SEQ ID NO: 13010 - protein, 19 aa, Artificial Sequence
  Description of Artificial Sequence: Synthetic peptide
  XENP018724 vhCDR2
EIRLKSNNYATHYAEPVKG

SEQ ID NO: 13011 - protein, 11 aa, Artificial Sequence
  Description of Artificial Sequence: Synthetic peptide
  XENP018724 vhCDR3
YYGNYGSYFDV

SEQ ID NO: 13012 - protein, 11 aa, Artificial Sequence
  Description of Artificial Sequence: Synthetic peptide
  XENP018724 vlCDR1
RASQSVSNDVA

SEQ ID NO: 13013 - protein, 7 aa, Artificial Sequence
  Description of Artificial Sequence: Synthetic peptide
  XENP018724 vlCDR2
YASHRYT

SEQ ID NO: 13014 - protein, 9 aa, Artificial Sequence
  Description of Artificial Sequence: Synthetic peptide
  XENP018724 vlCDR3
QQDYSSPRT

SEQ ID NO: 13015 - protein, 249 aa, Artificial Sequence
  Description of Artificial Sequence: Synthetic polypeptide
  XENP018725 1G6_H1.221_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGTYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 13016 - protein, 122 aa, Artificial Sequence
  Description of Artificial Sequence: Synthetic polypeptide
  VH of XENP018725
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGTYFDVWGAGTLVTVSS

SEQ ID NO: 13017 - protein, 107 aa, Artificial Sequence; identical to SEQ ID NO: 10923
  Description of Artificial Sequence: Synthetic polypeptide
  VL of XENP018725

SEQ ID NO: 13018 - protein, 5 aa, Artificial Sequence
  Description of Artificial Sequence: Synthetic peptide
  XENP018725 vhCDR1
NYWMN

SEQ ID NO: 13019 - protein, 19 aa, Artificial Sequence
  Description of Artificial Sequence: Synthetic peptide
  XENP018725 vhCDR2
EIRLKSNNYATHYAEPVKG

SEQ ID NO: 13020 - protein, 11 aa, Artificial Sequence
  Description of Artificial Sequence: Synthetic peptide
  XENP018725 vhCDR3
YYGNYGTYFDV

SEQ ID NO: 13021 - protein, 11 aa, Artificial Sequence
  Description of Artificial Sequence: Synthetic peptide
  XENP018725 vlCDR1
RASQSVSNDVA

SEQ ID NO: 13022 - protein, 7 aa, Artificial Sequence
  Description of Artificial Sequence: Synthetic peptide
  XENP018725 vlCDR2
YASHRYT

SEQ ID NO: 13023 - protein, 9 aa, Artificial Sequence
  Description of Artificial Sequence: Synthetic peptide
  XENP018725 vlCDR3
QQDYSSPRT

SEQ ID NO: 13024 - protein, 249 aa, Artificial Sequence
  Description of Artificial Sequence: Synthetic polypeptide
  XENP018726 1G6_H1.222_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGNYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 13025 - protein, 122 aa, Artificial Sequence
  Description of Artificial Sequence: Synthetic polypeptide
  VH of XENP018726
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGNYFDVWGAGTLVTVSS

SEQ ID NO: 13026 - protein, 107 aa, Artificial Sequence; identical to SEQ ID NO: 10923
  Description of Artificial Sequence: Synthetic polypeptide
  VL of XENP018726

SEQ ID NO: 13027 - protein, 5 aa, Artificial Sequence
  Description of Artificial Sequence: Synthetic peptide
  XENP018726 vhCDR1
NYWMN

SEQ ID NO: 13028 - protein, 19 aa, Artificial Sequence
  Description of Artificial Sequence: Synthetic peptide
  XENP018726 vhCDR2
EIRLKSNNYATHYAEPVKG

SEQ ID NO: 13029 - protein, 11 aa, Artificial Sequence
  Description of Artificial Sequence: Synthetic peptide
  XENP018726 vhCDR3
YYGNYGNYFDV

SEQ ID NO: 13030 - protein, 11 aa, Artificial Sequence
  Description of Artificial Sequence: Synthetic peptide
  XENP018726 vlCDR1
RASQSVSNDVA

SEQ ID NO: 13031 - protein, 7 aa, Artificial Sequence
  Description of Artificial Sequence: Synthetic peptide
  XENP018726 vlCDR2
YASHRYT

SEQ ID NO: 13032 - protein, 9 aa, Artificial Sequence
  Description of Artificial Sequence: Synthetic peptide
  XENP018726 vlCDR3
QQDYSSPRT

SEQ ID NO: 13033 - protein, 249 aa, Artificial Sequence
  Description of Artificial Sequence: Synthetic polypeptide
  XENP018727 1G6_H1.223_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGHYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 13034 - protein, 122 aa, Artificial Sequence
  Description of Artificial Sequence: Synthetic polypeptide
  VH of XENP018727
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGHYFDVWGAGTLVTVSS

SEQ ID NO: 13035 - protein, 107 aa, Artificial Sequence; identical to SEQ ID NO: 10923
  Description of Artificial Sequence: Synthetic polypeptide
  VL of XENP018727

SEQ ID NO: 13036 - protein, 5 aa, Artificial Sequence
  Description of Artificial Sequence: Synthetic peptide
  XENP018727 vhCDR1
NYWMN

SEQ ID NO: 13037 - protein, 19 aa, Artificial Sequence
  Description of Artificial Sequence: Synthetic peptide
  XENP018727 vhCDR2
EIRLKSNNYATHYAEPVKG

SEQ ID NO: 13038 - protein, 11 aa, Artificial Sequence
  Description of Artificial Sequence: Synthetic peptide
  XENP018727 vhCDR3
YYGNYGHYFDV

SEQ ID NO: 13039 - protein, 11 aa, Artificial Sequence
  Description of Artificial Sequence: Synthetic peptide
  XENP018727 vlCDR1
RASQSVSNDVA

SEQ ID NO: 13040 - protein, 7 aa, Artificial Sequence
  Description of Artificial Sequence: Synthetic peptide
  XENP018727 vlCDR2
YASHRYT

SEQ ID NO: 13041 - protein, 9 aa, Artificial Sequence
  Description of Artificial Sequence: Synthetic peptide
  XENP018727 vlCDR3
QQDYSSPRT

SEQ ID NO: 13042 - protein, 249 aa, Artificial Sequence
  Description of Artificial Sequence: Synthetic polypeptide
  XENP018728 1G6_H1.224_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGDYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 13043 - protein, 122 aa, Artificial Sequence
  Description of Artificial Sequence: Synthetic polypeptide
  VH of XENP018728
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGDYFDVWGAGTLVTVSS

SEQ ID NO: 13044 - protein, 107 aa, Artificial Sequence; identical to SEQ ID NO: 10923
  Description of Artificial Sequence: Synthetic polypeptide
  VL of XENP018728

SEQ ID NO: 13045 - protein, 5 aa, Artificial Sequence
  Description of Artificial Sequence: Synthetic peptide
  XENP018728 vhCDR1
NYWMN

SEQ ID NO: 13046 - protein, 19 aa, Artificial Sequence
  Description of Artificial Sequence: Synthetic peptide
  XENP018728 vhCDR2
EIRLKSNNYATHYAEPVKG

SEQ ID NO: 13047 - protein, 11 aa, Artificial Sequence
  Description of Artificial Sequence: Synthetic peptide
  XENP018728 vhCDR3
YYGNYGDYFDV

SEQ ID NO: 13048 - protein, 11 aa, Artificial Sequence
  Description of Artificial Sequence: Synthetic peptide
  XENP018728 vlCDR1
RASQSVSNDVA

SEQ ID NO: 13049 - protein, 7 aa, Artificial Sequence
  Description of Artificial Sequence: Synthetic peptide
  XENP018728 vlCDR2
YASHRYT

SEQ ID NO: 13050 - protein, 9 aa, Artificial Sequence
  Description of Artificial Sequence: Synthetic peptide
  XENP018728 vlCDR3
QQDYSSPRT

SEQ ID NO: 13051 - protein, 249 aa, Artificial Sequence
  Description of Artificial Sequence: Synthetic polypeptide
  XENP018729 1G6_H1.225_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGKYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 13052 - protein, 122 aa, Artificial Sequence
  Description of Artificial Sequence: Synthetic polypeptide
  VH of XENP018729
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGKYFDVWGAGTLVTVSS

SEQ ID NO: 13053 - protein, 107 aa, Artificial Sequence; identical to SEQ ID NO: 10923
  Description of Artificial Sequence: Synthetic polypeptide
  VL of XENP018729

SEQ ID NO: 13054 - protein, 5 aa, Artificial Sequence
  Description of Artificial Sequence: Synthetic peptide
  XENP018729 vhCDR1
NYWMN

SEQ ID NO: 13055 - protein, 19 aa, Artificial Sequence
  Description of Artificial Sequence: Synthetic peptide
  XENP018729 vhCDR2
EIRLKSNNYATHYAEPVKG

SEQ ID NO: 13056 - protein, 11 aa, Artificial Sequence
  Description of Artificial Sequence: Synthetic peptide
  XENP018729 vhCDR3
YYGNYGKYFDV

SEQ ID NO: 13057 - protein, 11 aa, Artificial Sequence
  Description of Artificial Sequence: Synthetic peptide
  XENP018729 vlCDR1
RASQSVSNDVA

SEQ ID NO: 13058 - protein, 7 aa, Artificial Sequence
  Description of Artificial Sequence: Synthetic peptide
  XENP018729 vlCDR2
YASHRYT

SEQ ID NO: 13059 - protein, 9 aa, Artificial Sequence
  Description of Artificial Sequence: Synthetic peptide
  XENP018729 vlCDR3
QQDYSSPRT

SEQ ID NO: 13060 - protein, 249 aa, Artificial Sequence
  Description of Artificial Sequence: Synthetic polypeptide
  XENP018730 1G6_H1.226_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGLYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 13061 - protein, 122 aa, Artificial Sequence
  Description of Artificial Sequence: Synthetic polypeptide
  VH of XENP018730
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGLYFDVWGAGTLVTVSS

SEQ ID NO: 13062 - protein, 107 aa, Artificial Sequence; identical to SEQ ID NO: 10923
  Description of Artificial Sequence: Synthetic polypeptide
  VL of XENP018730

SEQ ID NO: 13063 - protein, 5 aa, Artificial Sequence
  Description of Artificial Sequence: Synthetic peptide
  XENP018730 vhCDR1
NYWMN

SEQ ID NO: 13064 - protein, 19 aa, Artificial Sequence
  Description of Artificial Sequence: Synthetic peptide
  XENP018730 vhCDR2
EIRLKSNNYATHYAEPVKG

SEQ ID NO: 13065 - protein, 11 aa, Artificial Sequence
  Description of Artificial Sequence: Synthetic peptide
  XENP018730 vhCDR3
YYGNYGLYFDV

SEQ ID NO: 13066 - protein, 11 aa, Artificial Sequence
  Description of Artificial Sequence: Synthetic peptide
  XENP018730 vlCDR1
RASQSVSNDVA

SEQ ID NO: 13067 - protein, 7 aa, Artificial Sequence
  Description of Artificial Sequence: Synthetic peptide
  XENP018730 vlCDR2
YASHRYT

SEQ ID NO: 13068 - protein, 9 aa, Artificial Sequence
  Description of Artificial Sequence: Synthetic peptide
  XENP018730 vlCDR3
QQDYSSPRT

SEQ ID NO: 13069 - protein, 249 aa, Artificial Sequence
  Description of Artificial Sequence: Synthetic polypeptide
  XENP018731 1G6_H1.227_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGFYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 13070 - protein, 122 aa, Artificial Sequence
  Description of Artificial Sequence: Synthetic polypeptide
  VH of XENP018731
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGFYFDVWGAGTLVTVSS

SEQ ID NO: 13071 - protein, 107 aa, Artificial Sequence; identical to SEQ ID NO: 10923
  Description of Artificial Sequence: Synthetic polypeptide
  VL of XENP018731

SEQ ID NO: 13072 - protein, 5 aa, Artificial Sequence
  Description of Artificial Sequence: Synthetic peptide
  XENP018731 vhCDR1
NYWMN

SEQ ID NO: 13073 - protein, 19 aa, Artificial Sequence
  Description of Artificial Sequence: Synthetic peptide
  XENP018731 vhCDR2
EIRLKSNNYATHYAEPVKG

SEQ ID NO: 13074 - protein, 11 aa, Artificial Sequence
  Description of Artificial Sequence: Synthetic peptide
  XENP018731 vhCDR3
YYGNYGFYFDV

SEQ ID NO: 13075 - protein, 11 aa, Artificial Sequence
  Description of Artificial Sequence: Synthetic peptide
  XENP018731 vlCDR1
RASQSVSNDVA

SEQ ID NO: 13076 - protein, 7 aa, Artificial Sequence
  Description of Artificial Sequence: Synthetic peptide
  XENP018731 vlCDR2
YASHRYT

SEQ ID NO: 13077 - protein, 9 aa, Artificial Sequence
  Description of Artificial Sequence: Synthetic peptide
  XENP018731 vlCDR3
QQDYSSPRT

SEQ ID NO: 13078 - protein, 249 aa, Artificial Sequence
  Description of Artificial Sequence: Synthetic polypeptide
  XENP018732 1G6_H1.228_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGFFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 13079 - protein, 122 aa, Artificial Sequence
  Description of Artificial Sequence: Synthetic polypeptide
  VH of XENP018732
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGFFDVWGAGTLVTVSS

SEQ ID NO: 13080 - protein, 107 aa, Artificial Sequence; identical to SEQ ID NO: 10923
  Description of Artificial Sequence: Synthetic polypeptide
  VL of XENP018732

SEQ ID NO: 13081 - protein, 5 aa, Artificial Sequence
  Description of Artificial Sequence: Synthetic peptide
  XENP018732 vhCDR1
NYWMN

SEQ ID NO: 13082 - protein, 19 aa, Artificial Sequence
  Description of Artificial Sequence: Synthetic peptide
  XENP018732 vhCDR2
EIRLKSNNYATHYAEPVKG

SEQ ID NO: 13083 - protein, 11 aa, Artificial Sequence
  Description of Artificial Sequence: Synthetic peptide
  XENP018732 vhCDR3
YYGNYGGFFDV

SEQ ID NO: 13084 - protein, 11 aa, Artificial Sequence
  Description of Artificial Sequence: Synthetic peptide
  XENP018732 vlCDR1
RASQSVSNDVA

SEQ ID NO: 13085 - protein, 7 aa, Artificial Sequence
  Description of Artificial Sequence: Synthetic peptide
  XENP018732 vlCDR2
YASHRYT

SEQ ID NO: 13086 - protein, 9 aa, Artificial Sequence
  Description of Artificial Sequence: Synthetic peptide
  XENP018732 vlCDR3
QQDYSSPRT

SEQ ID NO: 13087 - protein, 249 aa, Artificial Sequence
  Description of Artificial Sequence: Synthetic polypeptide
  XENP018733 1G6_H1.229_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGHFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 13088 - protein, 122 aa, Artificial Sequence
  Description of Artificial Sequence: Synthetic polypeptide
  VH of XENP018733
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGHFDVWGAGTLVTVSS

SEQ ID NO: 13089 - protein, 107 aa, Artificial Sequence; identical to SEQ ID NO: 10923
  Description of Artificial Sequence: Synthetic polypeptide
  VL of XENP018733

SEQ ID NO: 13090 - protein, 5 aa, Artificial Sequence
  Description of Artificial Sequence: Synthetic peptide
  XENP018733 vhCDR1
NYWMN

SEQ ID NO: 13091 - protein, 19 aa, Artificial Sequence
  Description of Artificial Sequence: Synthetic peptide
  XENP018733 vhCDR2
EIRLKSNNYATHYAEPVKG

SEQ ID NO: 13092 - protein, 11 aa, Artificial Sequence
  Description of Artificial Sequence: Synthetic peptide
  XENP018733 vhCDR3
YYGNYGGHFDV

SEQ ID NO: 13093 - protein, 11 aa, Artificial Sequence
  Description of Artificial Sequence: Synthetic peptide
  XENP018733 vlCDR1
RASQSVSNDVA

SEQ ID NO: 13094 - protein, 7 aa, Artificial Sequence
  Description of Artificial Sequence: Synthetic peptide
  XENP018733 vlCDR2
YASHRYT

SEQ ID NO: 13095 - protein, 9 aa, Artificial Sequence
  Description of Artificial Sequence: Synthetic peptide
  XENP018733 vlCDR3
QQDYSSPRT

SEQ ID NO: 13096 - protein, 249 aa, Artificial Sequence
  Description of Artificial Sequence: Synthetic polypeptide
  XENP018734 1G6_H1.230_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGLFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 13097 - protein, 122 aa, Artificial Sequence
  Description of Artificial Sequence: Synthetic polypeptide
  VH of XENP018734
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGLFDVWGAGTLVTVSS

SEQ ID NO: 13098 - protein, 107 aa, Artificial Sequence; identical to SEQ ID NO: 10923
  Description of Artificial Sequence: Synthetic polypeptide
  VL of XENP018734

SEQ ID NO: 13099 - protein, 5 aa, Artificial Sequence
  Description of Artificial Sequence: Synthetic peptide
  XENP018734 vhCDR1
NYWMN

SEQ ID NO: 13100 - protein, 19 aa, Artificial Sequence
  Description of Artificial Sequence: Synthetic peptide
  XENP018734 vhCDR2
EIRLKSNNYATHYAEPVKG

SEQ ID NO: 13101 - protein, 11 aa, Artificial Sequence
  Description of Artificial Sequence: Synthetic peptide
  XENP018734 vhCDR3
YYGNYGGLFDV

SEQ ID NO: 13102 - protein, 11 aa, Artificial Sequence
  Description of Artificial Sequence: Synthetic peptide
  XENP018734 vlCDR1
RASQSVSNDVA

SEQ ID NO: 13103 - protein, 7 aa, Artificial Sequence
  Description of Artificial Sequence: Synthetic peptide
  XENP018734 vlCDR2
YASHRYT

SEQ ID NO: 13104 - protein, 9 aa, Artificial Sequence
  Description of Artificial Sequence: Synthetic peptide
  XENP018734 vlCDR3
QQDYSSPRT

SEQ ID NO: 13105 - protein, 249 aa, Artificial Sequence
  Description of Artificial Sequence: Synthetic polypeptide
  XENP018735 1G6_H1.231_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGWFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 13106 - protein, 122 aa, Artificial Sequence
  Description of Artificial Sequence: Synthetic polypeptide
  VH of XENP018735
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGWFDVWGAGTLVTVSS

SEQ ID NO: 13107 - protein, 107 aa, Artificial Sequence; identical to SEQ ID NO: 10923
  Description of Artificial Sequence: Synthetic polypeptide
  VL of XENP018735

SEQ ID NO: 13108 - protein, 5 aa, Artificial Sequence
  Description of Artificial Sequence: Synthetic peptide
  XENP018735 vhCDR1
NYWMN

SEQ ID NO: 13109 - protein, 19 aa, Artificial Sequence
  Description of Artificial Sequence: Synthetic peptide
  XENP018735 vhCDR2
EIRLKSNNYATHYAEPVKG

SEQ ID NO: 13110 - protein, 11 aa, Artificial Sequence
  Description of Artificial Sequence: Synthetic peptide
  XENP018735 vhCDR3
YYGNYGGWFDV

SEQ ID NO: 13111 - protein, 11 aa, Artificial Sequence
  Description of Artificial Sequence: Synthetic peptide
  XENP018735 vlCDR1
RASQSVSNDVA

SEQ ID NO: 13112 - protein, 7 aa, Artificial Sequence
  Description of Artificial Sequence: Synthetic peptide
  XENP018735 vlCDR2
YASHRYT

SEQ ID NO: 13113 - protein, 9 aa, Artificial Sequence
  Description of Artificial Sequence: Synthetic peptide
  XENP018735 vlCDR3
QQDYSSPRT

SEQ ID NO: 13114 - protein, 249 aa, Artificial Sequence
  Description of Artificial Sequence: Synthetic polypeptide
  XENP018736 1G6_H1.232_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGVFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 13115 - protein, 122 aa, Artificial Sequence
  Description of Artificial Sequence: Synthetic polypeptide
  VH of XENP018736
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGVFDVWGAGTLVTVSS

SEQ ID NO: 13116 - protein, 107 aa, Artificial Sequence; identical to SEQ ID NO: 10923
  Description of Artificial Sequence: Synthetic polypeptide
  VL of XENP018736

SEQ ID NO: 13117 - protein, 5 aa, Artificial Sequence
  Description of Artificial Sequence: Synthetic peptide
  XENP018736 vhCDR1
NYWMN

SEQ ID NO: 13118 - protein, 19 aa, Artificial Sequence
  Description of Artificial Sequence: Synthetic peptide
  XENP018736 vhCDR2
EIRLKSNNYATHYAEPVKG

SEQ ID NO: 13119 - protein, 11 aa, Artificial Sequence
  Description of Artificial Sequence: Synthetic peptide
  XENP018736 vhCDR3
YYGNYGGVFDV

SEQ ID NO: 13120 - protein, 11 aa, Artificial Sequence
  Description of Artificial Sequence: Synthetic peptide
  XENP018736 vlCDR1
RASQSVSNDVA

SEQ ID NO: 13121 - protein, 7 aa, Artificial Sequence
  Description of Artificial Sequence: Synthetic peptide
  XENP018736 vlCDR2
YASHRYT

SEQ ID NO: 13122 - protein, 9 aa, Artificial Sequence
  Description of Artificial Sequence: Synthetic peptide
  XENP018736 vlCDR3
QQDYSSPRT

SEQ ID NO: 13123 - protein, 249 aa, Artificial Sequence
  Description of Artificial Sequence: Synthetic polypeptide
  XENP018737 1G6_H1.233_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGAFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 13124 - protein, 122 aa, Artificial Sequence
  Description of Artificial Sequence: Synthetic polypeptide
  VH of XENP018737
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGAFDVWGAGTLVTVSS

SEQ ID NO: 13125 - protein, 107 aa, Artificial Sequence; identical to SEQ ID NO: 10923
  Description of Artificial Sequence: Synthetic polypeptide
  VL of XENP018737

SEQ ID NO: 13126 - protein, 5 aa, Artificial Sequence
  Description of Artificial Sequence: Synthetic peptide
  XENP018737 vhCDR1
NYWMN

SEQ ID NO: 13127 - protein, 19 aa, Artificial Sequence
  Description of Artificial Sequence: Synthetic peptide
  XENP018737 vhCDR2
EIRLKSNNYATHYAEPVKG

SEQ ID NO: 13128 - protein, 11 aa, Artificial Sequence
  Description of Artificial Sequence: Synthetic peptide
  XENP018737 vhCDR3
YYGNYGGAFDV

SEQ ID NO: 13129 - protein, 11 aa, Artificial Sequence
  Description of Artificial Sequence: Synthetic peptide
  XENP018737 vlCDR1
RASQSVSNDVA

SEQ ID NO: 13130 - protein, 7 aa, Artificial Sequence
  Description of Artificial Sequence: Synthetic peptide
  XENP018737 vlCDR2
YASHRYT

SEQ ID NO: 13131 - protein, 9 aa, Artificial Sequence
  Description of Artificial Sequence: Synthetic peptide
  XENP018737 vlCDR3
QQDYSSPRT

SEQ ID NO: 13132 - protein, 249 aa, Artificial Sequence
  Description of Artificial Sequence: Synthetic polypeptide
  XENP018738 1G6_H1.234_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGQFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 13133 - protein, 122 aa, Artificial Sequence
  Description of Artificial Sequence: Synthetic polypeptide
  VH of XENP018738
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGQFDVWGAGTLVTVSS

SEQ ID NO: 13134 - protein, 107 aa, Artificial Sequence; identical to SEQ ID NO: 10923
  Description of Artificial Sequence: Synthetic polypeptide
  VL of XENP018738

SEQ ID NO: 13135 - protein, 5 aa, Artificial Sequence
  Description of Artificial Sequence: Synthetic peptide
  XENP018738 vhCDR1
NYWMN

SEQ ID NO: 13136 - protein, 19 aa, Artificial Sequence
  Description of Artificial Sequence: Synthetic peptide
  XENP018738 vhCDR2
EIRLKSNNYATHYAEPVKG

SEQ ID NO: 13137 - protein, 11 aa, Artificial Sequence
  Description of Artificial Sequence: Synthetic peptide
  XENP018738 vhCDR3
YYGNYGGQFDV

SEQ ID NO: 13138 - protein, 11 aa, Artificial Sequence
  Description of Artificial Sequence: Synthetic peptide
  XENP018738 vlCDR1
RASQSVSNDVA

SEQ ID NO: 13139 - protein, 7 aa, Artificial Sequence
  Description of Artificial Sequence: Synthetic peptide
  XENP018738 vlCDR2
YASHRYT

SEQ ID NO: 13140 - protein, 9 aa, Artificial Sequence
  Description of Artificial Sequence: Synthetic peptide
  XENP018738 vlCDR3
QQDYSSPRT

SEQ ID NO: 13141 - protein, 249 aa, Artificial Sequence
  Description of Artificial Sequence: Synthetic polypeptide
  XENP018739 1G6_H1.235_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGDFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 13142 - protein, 122 aa, Artificial Sequence
  Description of Artificial Sequence: Synthetic polypeptide
  VH of XENP018739
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGDFDVWGAGTLVTVSS

SEQ ID NO: 13143 - protein, 107 aa, Artificial Sequence; identical to SEQ ID NO: 10923
  Description of Artificial Sequence: Synthetic polypeptide
  VL of XENP018739

SEQ ID NO: 13144 - protein, 5 aa, Artificial Sequence
  Description of Artificial Sequence: Synthetic peptide
  XENP018739 vhCDR1
NYWMN

SEQ ID NO: 13145 - protein, 19 aa, Artificial Sequence
  Description of Artificial Sequence: Synthetic peptide
  XENP018739 vhCDR2
EIRLKSNNYATHYAEPVKG

SEQ ID NO: 13146 - protein, 11 aa, Artificial Sequence
  Description of Artificial Sequence: Synthetic peptide
  XENP018739 vhCDR3
YYGNYGGDFDV

SEQ ID NO: 13147 - protein, 11 aa, Artificial Sequence
  Description of Artificial Sequence: Synthetic peptide
  XENP018739 vlCDR1
RASQSVSNDVA

SEQ ID NO: 13148 - protein, 7 aa, Artificial Sequence
  Description of Artificial Sequence: Synthetic peptide
  XENP018739 vlCDR2
YASHRYT

SEQ ID NO: 13149 - protein, 9 aa, Artificial Sequence
  Description of Artificial Sequence: Synthetic peptide
  XENP018739 vlCDR3
QQDYSSPRT

SEQ ID NO: 13150 - protein, 249 aa, Artificial Sequence
  Description of Artificial Sequence: Synthetic polypeptide
  XENP018740 1G6_H1.236_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGKFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 13151 - protein, 122 aa, Artificial Sequence
  Description of Artificial Sequence: Synthetic polypeptide
  VH of XENP018740
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGKFDVWGAGTLVTVSS

SEQ ID NO: 13152 - protein, 107 aa, Artificial Sequence; identical to SEQ ID NO: 10923
  Description of Artificial Sequence: Synthetic polypeptide
  VL of XENP018740

SEQ ID NO: 13153 - protein, 5 aa, Artificial Sequence
  Description of Artificial Sequence: Synthetic peptide
  XENP018740 vhCDR1
NYWMN

SEQ ID NO: 13154 - protein, 19 aa, Artificial Sequence
  Description of Artificial Sequence: Synthetic peptide
  XENP018740 vhCDR2
EIRLKSNNYATHYAEPVKG

SEQ ID NO: 13155 - protein, 11 aa, Artificial Sequence
  Description of Artificial Sequence: Synthetic peptide
  XENP018740 vhCDR3
YYGNYGGKFDV

SEQ ID NO: 13156 - protein, 11 aa, Artificial Sequence
  Description of Artificial Sequence: Synthetic peptide
  XENP018740 vlCDR1
RASQSVSNDVA

SEQ ID NO: 13157 - protein, 7 aa, Artificial Sequence
  Description of Artificial Sequence: Synthetic peptide
  XENP018740 vlCDR2
YASHRYT

SEQ ID NO: 13158 - protein, 9 aa, Artificial Sequence
  Description of Artificial Sequence: Synthetic peptide
  XENP018740 vlCDR3
QQDYSSPRT

SEQ ID NO: 13159 - protein, 249 aa, Artificial Sequence
  Description of Artificial Sequence: Synthetic polypeptide
  XENP018741 1G6_H1.237_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDYWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 13160 - protein, 122 aa, Artificial Sequence
  Description of Artificial Sequence: Synthetic polypeptide
  VH of XENP018741
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDYWGAGTLVTVSS

SEQ ID NO: 13161 - protein, 107 aa, Artificial Sequence; identical to SEQ ID NO: 10923
  Description of Artificial Sequence: Synthetic polypeptide
  VL of XENP018741

SEQ ID NO: 13162 - protein, 5 aa, Artificial Sequence
  Description of Artificial Sequence: Synthetic peptide
  XENP018741 vhCDR1
NYWMN

SEQ ID NO: 13163 - protein, 19 aa, Artificial Sequence
  Description of Artificial Sequence: Synthetic peptide
  XENP018741 vhCDR2
EIRLKSNNYATHYAEPVKG

SEQ ID NO: 13164 - protein, 11 aa, Artificial Sequence
  Description of Artificial Sequence: Synthetic peptide
  XENP018741 vhCDR3
YYGNYGGYFDY

SEQ ID NO: 13165 - protein, 11 aa, Artificial Sequence
  Description of Artificial Sequence: Synthetic peptide
  XENP018741 vlCDR1
RASQSVSNDVA

SEQ ID NO: 13166 - protein, 7 aa, Artificial Sequence
  Description of Artificial Sequence: Synthetic peptide
  XENP018741 vlCDR2
YASHRYT

SEQ ID NO: 13167 - protein, 9 aa, Artificial Sequence
  Description of Artificial Sequence: Synthetic peptide
  XENP018741 vlCDR3
QQDYSSPRT

SEQ ID NO: 13168 - protein, 249 aa, Artificial Sequence
  Description of Artificial Sequence: Synthetic polypeptide
  XENP018742 1G6_H1.238_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGQGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 13169 - protein, 122 aa, Artificial Sequence
  Description of Artificial Sequence: Synthetic polypeptide
  VH of XENP018742
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGQGTLVTVSS

SEQ ID NO: 13170 - protein, 107 aa, Artificial Sequence; identical to SEQ ID NO: 10923
  Description of Artificial Sequence: Synthetic polypeptide
  VL of XENP018742

SEQ ID NO: 13171 - protein, 5 aa, Artificial Sequence
  Description of Artificial Sequence: Synthetic peptide
  XENP018742 vhCDR1
NYWMN

SEQ ID NO: 13172 - protein, 19 aa, Artificial Sequence
  Description of Artificial Sequence: Synthetic peptide
  XENP018742 vhCDR2
EIRLKSNNYATHYAEPVKG

SEQ ID NO: 13173 - protein, 11 aa, Artificial Sequence
  Description of Artificial Sequence: Synthetic peptide
  XENP018742 vhCDR3
YYGNYGGYFDV

SEQ ID NO: 13174 - protein, 11 aa, Artificial Sequence
  Description of Artificial Sequence: Synthetic peptide
  XENP018742 vlCDR1
RASQSVSNDVA

SEQ ID NO: 13175 - protein, 7 aa, Artificial Sequence
  Description of Artificial Sequence: Synthetic peptide
  XENP018742 vlCDR2
YASHRYT

SEQ ID NO: 13176 - protein, 9 aa, Artificial Sequence
  Description of Artificial Sequence: Synthetic peptide
  XENP018742 vlCDR3
QQDYSSPRT

SEQ ID NO: 13177 - protein, 249 aa, Artificial Sequence
  Description of Artificial Sequence: Synthetic polypeptide
  XENP018743 1G6_H1_L1.1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSEIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 13178 - protein, 122 aa, Artificial Sequence; identical to SEQ ID NO: 10922
  Description of Artificial Sequence: Synthetic polypeptide
  VH of XENP018743

SEQ ID NO: 13179 - protein, 107 aa, Artificial Sequence
  Description of Artificial Sequence: Synthetic polypeptide
  VL of XENP018743
EIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 13180 - protein, 5 aa, Artificial Sequence
  Description of Artificial Sequence: Synthetic peptide
  XENP018743 vhCDR1
NYWMN

SEQ ID NO: 13181 - protein, 19 aa, Artificial Sequence
  Description of Artificial Sequence: Synthetic peptide
  XENP018743 vhCDR2
EIRLKSNNYATHYAEPVKG

SEQ ID NO: 13182 - protein, 11 aa, Artificial Sequence
  Description of Artificial Sequence: Synthetic peptide
  XENP018743 vhCDR3
YYGNYGGYFDV

SEQ ID NO: 13183 - protein, 11 aa, Artificial Sequence
  Description of Artificial Sequence: Synthetic peptide
  XENP018743 vlCDR1
RASQSVSNDVA

SEQ ID NO: 13184 - protein, 7 aa, Artificial Sequence
  Description of Artificial Sequence: Synthetic peptide
  XENP018743 vlCDR2
YASHRYT

SEQ ID NO: 13185 - protein, 9 aa, Artificial Sequence
  Description of Artificial Sequence: Synthetic peptide
  XENP018743 vlCDR3
QQDYSSPRT

SEQ ID NO: 13186 - protein, 249 aa, Artificial Sequence
  Description of Artificial Sequence: Synthetic polypeptide
  XENP018744 1G6_H1_L1.2_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSDIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 13187 - protein, 122 aa, Artificial Sequence; identical to SEQ ID NO: 10922
  Description of Artificial Sequence: Synthetic polypeptide
  VH of XENP018744

SEQ ID NO: 13188 - protein, 107 aa, Artificial Sequence
  Description of Artificial Sequence: Synthetic polypeptide
  VL of XENP018744
DIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 13189 - protein, 5 aa, Artificial Sequence
  Description of Artificial Sequence: Synthetic peptide
  XENP018744 vhCDR1
NYWMN

SEQ ID NO: 13190 - protein, 19 aa, Artificial Sequence
  Description of Artificial Sequence: Synthetic peptide
  XENP018744 vhCDR2
EIRLKSNNYATHYAEPVKG

SEQ ID NO: 13191 - protein, 11 aa, Artificial Sequence
  Description of Artificial Sequence: Synthetic peptide
  XENP018744 vhCDR3
YYGNYGGYFDV

SEQ ID NO: 13192 - protein, 11 aa, Artificial Sequence
  Description of Artificial Sequence: Synthetic peptide
  XENP018744 vlCDR1
RASQSVSNDVA

SEQ ID NO: 13193 - protein, 7 aa, Artificial Sequence
  Description of Artificial Sequence: Synthetic peptide
  XENP018744 vlCDR2
YASHRYT

SEQ ID NO: 13194 - protein, 9 aa, Artificial Sequence
  Description of Artificial Sequence: Synthetic peptide
  XENP018744 vlCDR3
QQDYSSPRT

SEQ ID NO: 13195 - protein, 249 aa, Artificial Sequence
  Description of Artificial Sequence: Synthetic polypeptide
  XENP018745 1G6_H1_L1.3_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSVVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 13196 - protein, 122 aa, Artificial Sequence; identical to SEQ ID NO: 10922
  Description of Artificial Sequence: Synthetic polypeptide
  VH of XENP018745

SEQ ID NO: 13197 - protein, 107 aa, Artificial Sequence
  Description of Artificial Sequence: Synthetic polypeptide
  VL of XENP018745
SVVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 13198 - protein, 5 aa, Artificial Sequence
  Description of Artificial Sequence: Synthetic peptide
  XENP018745 vhCDR1
NYWMN

SEQ ID NO: 13199 - protein, 19 aa, Artificial Sequence
  Description of Artificial Sequence: Synthetic peptide
  XENP018745 vhCDR2
EIRLKSNNYATHYAEPVKG

SEQ ID NO: 13200 - protein, 11 aa, Artificial Sequence
  Description of Artificial Sequence: Synthetic peptide
  XENP018745 vhCDR3
YYGNYGGYFDV

SEQ ID NO: 13201 - protein, 11 aa, Artificial Sequence
  Description of Artificial Sequence: Synthetic peptide
  XENP018745 vlCDR1
RASQSVSNDVA

SEQ ID NO: 13202 - protein, 7 aa, Artificial Sequence
  Description of Artificial Sequence: Synthetic peptide
  XENP018745 vlCDR2
YASHRYT

SEQ ID NO: 13203 - protein, 9 aa, Artificial Sequence
  Description of Artificial Sequence: Synthetic peptide
  XENP018745 vlCDR3
QQDYSSPRT

SEQ ID NO: 13204 - protein, 249 aa, Artificial Sequence
  Description of Artificial Sequence: Synthetic polypeptide
  XENP018746 1G6_H1_L1.4_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVLTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 13205 - protein, 122 aa, Artificial Sequence; identical to SEQ ID NO: 10922
  Description of Artificial Sequence: Synthetic polypeptide
  VH of XENP018746

SEQ ID NO: 13206 - protein, 107 aa, Artificial Sequence
  Description of Artificial Sequence: Synthetic polypeptide
  VL of XENP018746
SIVLTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 13207 - protein, 5 aa, Artificial Sequence
  Description of Artificial Sequence: Synthetic peptide
  XENP018746 vhCDR1
NYWMN

SEQ ID NO: 13208 - protein, 19 aa, Artificial Sequence
  Description of Artificial Sequence: Synthetic peptide
  XENP018746 vhCDR2
EIRLKSNNYATHYAEPVKG

SEQ ID NO: 13209 - protein, 11 aa, Artificial Sequence
  Description of Artificial Sequence: Synthetic peptide
  XENP018746 vhCDR3
YYGNYGGYFDV

SEQ ID NO: 13210 - protein, 11 aa, Artificial Sequence
  Description of Artificial Sequence: Synthetic peptide
  XENP018746 vlCDR1
RASQSVSNDVA

SEQ ID NO: 13211 - protein, 7 aa, Artificial Sequence
  Description of Artificial Sequence: Synthetic peptide
  XENP018746 vlCDR2
YASHRYT

SEQ ID NO: 13212 - protein, 9 aa, Artificial Sequence
  Description of Artificial Sequence: Synthetic peptide
  XENP018746 vlCDR3
QQDYSSPRT

SEQ ID NO: 13213 - protein, 249 aa, Artificial Sequence
  Description of Artificial Sequence: Synthetic polypeptide
  XENP018747 1G6_H1_L1.5_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQTPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 13214 - protein, 122 aa, Artificial Sequence; identical to SEQ ID NO: 10922
  Description of Artificial Sequence: Synthetic polypeptide
  VH of XENP018747

SEQ ID NO: 13215 - protein, 107 aa, Artificial Sequence
  Description of Artificial Sequence: Synthetic polypeptide
  VL of XENP018747
SIVMTQTPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 13216 - protein, 5 aa, Artificial Sequence
  Description of Artificial Sequence: Synthetic peptide
  XENP018747 vhCDR1
NYWMN

SEQ ID NO: 13217 - protein, 19 aa, Artificial Sequence
  Description of Artificial Sequence: Synthetic peptide
  XENP018747 vhCDR2
EIRLKSNNYATHYAEPVKG

SEQ ID NO: 13218 - protein, 11 aa, Artificial Sequence
  Description of Artificial Sequence: Synthetic peptide
  XENP018747 vhCDR3
YYGNYGGYFDV

SEQ ID NO: 13219 - protein, 11 aa, Artificial Sequence
  Description of Artificial Sequence: Synthetic peptide
  XENP018747 vlCDR1
RASQSVSNDVA

SEQ ID NO: 13220 - protein, 7 aa, Artificial Sequence
  Description of Artificial Sequence: Synthetic peptide
  XENP018747 vlCDR2
YASHRYT

SEQ ID NO: 13221 - protein, 9 aa, Artificial Sequence
  Description of Artificial Sequence: Synthetic peptide
  XENP018747 vlCDR3
QQDYSSPRT

SEQ ID NO: 13222 - protein, 249 aa, Artificial Sequence
  Description of Artificial Sequence: Synthetic polypeptide
  XENP018748 1G6_H1_L1.6_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPKTLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 13223 - protein, 122 aa, Artificial Sequence; identical to SEQ ID NO: 10922
  Description of Artificial Sequence: Synthetic polypeptide
  VH of XENP018748

SEQ ID NO: 13224 - protein, 107 aa, Artificial Sequence
  Description of Artificial Sequence: Synthetic polypeptide
  VL of XENP018748
SIVMTQSPKTLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 13225 - protein, 5 aa, Artificial Sequence
  Description of Artificial Sequence: Synthetic peptide
  XENP018748 vhCDR1
NYWMN

SEQ ID NO: 13226 - protein, 19 aa, Artificial Sequence
  Description of Artificial Sequence: Synthetic peptide
  XENP018748 vhCDR2
EIRLKSNNYATHYAEPVKG

SEQ ID NO: 13227 - protein, 11 aa, Artificial Sequence
  Description of Artificial Sequence: Synthetic peptide
  XENP018748 vhCDR3
YYGNYGGYFDV

SEQ ID NO: 13228 - protein, 11 aa, Artificial Sequence
  Description of Artificial Sequence: Synthetic peptide
  XENP018748 vlCDR1
RASQSVSNDVA

SEQ ID NO: 13229 - protein, 7 aa, Artificial Sequence
  Description of Artificial Sequence: Synthetic peptide
  XENP018748 vlCDR2
YASHRYT

SEQ ID NO: 13230 - protein, 9 aa, Artificial Sequence
  Description of Artificial Sequence: Synthetic peptide
  XENP018748 vlCDR3
QQDYSSPRT

SEQ ID NO: 13231 - protein, 249 aa, Artificial Sequence
  Description of Artificial Sequence: Synthetic polypeptide
  XENP018749 1G6_H1_L1.7_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPASLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 13232 - protein, 122 aa, Artificial Sequence; identical to SEQ ID NO: 10922
  Description of Artificial Sequence: Synthetic polypeptide
  VH of XENP018749

SEQ ID NO: 13233 - protein, 107 aa, Artificial Sequence
  Description of Artificial Sequence: Synthetic polypeptide
  VL of XENP018749
SIVMTQSPASLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 13234 - protein, 5 aa, Artificial Sequence
  Description of Artificial Sequence: Synthetic peptide
  XENP018749 vhCDR1
NYWMN

SEQ ID NO: 13235 - protein, 19 aa, Artificial Sequence
  Description of Artificial Sequence: Synthetic peptide
  XENP018749 vhCDR2
EIRLKSNNYATHYAEPVKG

SEQ ID NO: 13236 - protein, 11 aa, Artificial Sequence
  Description of Artificial Sequence: Synthetic peptide
  XENP018749 vhCDR3
YYGNYGGYFDV

SEQ ID NO: 13237 - protein, 11 aa, Artificial Sequence
  Description of Artificial Sequence: Synthetic peptide
  XENP018749 vlCDR1
RASQSVSNDVA

SEQ ID NO: 13238 - protein, 7 aa, Artificial Sequence
  Description of Artificial Sequence: Synthetic peptide
  XENP018749 vlCDR2
YASHRYT

SEQ ID NO: 13239 - protein, 9 aa, Artificial Sequence
  Description of Artificial Sequence: Synthetic peptide
  XENP018749 vlCDR3
QQDYSSPRT

SEQ ID NO: 13240 - protein, 249 aa, Artificial Sequence
  Description of Artificial Sequence: Synthetic polypeptide
  XENP018750 1G6_H1_L1.8_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPAFLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 13241 - protein, 122 aa, Artificial Sequence; identical to SEQ ID NO: 10922
  Description of Artificial Sequence: Synthetic polypeptide
  VH of XENP018750

SEQ ID NO: 13242 - protein, 107 aa, Artificial Sequence
  Description of Artificial Sequence: Synthetic polypeptide
  VL of XENP018750
SIVMTQSPAFLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 13243 - protein, 5 aa, Artificial Sequence
  Description of Artificial Sequence: Synthetic peptide
  XENP018750 vhCDR1
NYWMN

SEQ ID NO: 13244 - protein, 19 aa, Artificial Sequence
  Description of Artificial Sequence: Synthetic peptide
  XENP018750 vhCDR2
EIRLKSNNYATHYAEPVKG

SEQ ID NO: 13245 - protein, 11 aa, Artificial Sequence
  Description of Artificial Sequence: Synthetic peptide
  XENP018750 vhCDR3
YYGNYGGYFDV

SEQ ID NO: 13246 - protein, 11 aa, Artificial Sequence
  Description of Artificial Sequence: Synthetic peptide
  XENP018750 vlCDR1
RASQSVSNDVA

SEQ ID NO: 13247 - protein, 7 aa, Artificial Sequence
  Description of Artificial Sequence: Synthetic peptide
  XENP018750 vlCDR2
YASHRYT

SEQ ID NO: 13248 - protein, 9 aa, Artificial Sequence
  Description of Artificial Sequence: Synthetic peptide
  XENP018750 vlCDR3
QQDYSSPRT

SEQ ID NO: 13249 - protein, 249 aa, Artificial Sequence
  Description of Artificial Sequence: Synthetic polypeptide
  XENP018751 1G6_H1_L1.9_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLLVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 13250 - protein, 122 aa, Artificial Sequence; identical to SEQ ID NO: 10922
  Description of Artificial Sequence: Synthetic polypeptide
  VH of XENP018751

SEQ ID NO: 13251 - protein, 107 aa, Artificial Sequence
  Description of Artificial Sequence: Synthetic polypeptide
  VL of XENP018751
SIVMTQSPATLLVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 13252 - protein, 5 aa, Artificial Sequence
  Description of Artificial Sequence: Synthetic peptide
  XENP018751 vhCDR1
NYWMN

SEQ ID NO: 13253 - protein, 19 aa, Artificial Sequence
  Description of Artificial Sequence: Synthetic peptide
  XENP018751 vhCDR2
EIRLKSNNYATHYAEPVKG

SEQ ID NO: 13254 - protein, 11 aa, Artificial Sequence
  Description of Artificial Sequence: Synthetic peptide
  XENP018751 vhCDR3
YYGNYGGYFDV

SEQ ID NO: 13255 - protein, 11 aa, Artificial Sequence
  Description of Artificial Sequence: Synthetic peptide
  XENP018751 vlCDR1
RASQSVSNDVA

SEQ ID NO: 13256 - protein, 7 aa, Artificial Sequence
  Description of Artificial Sequence: Synthetic peptide
  XENP018751 vlCDR2
YASHRYT

SEQ ID NO: 13257 - protein, 9 aa, Artificial Sequence
  Description of Artificial Sequence: Synthetic peptide
  XENP018751 vlCDR3
QQDYSSPRT

SEQ ID NO: 13258 - protein, 249 aa, Artificial Sequence
  Description of Artificial Sequence: Synthetic polypeptide
  XENP018752 1G6_H1_L1.10_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSAGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 13259 - protein, 122 aa, Artificial Sequence; identical to SEQ ID NO: 10922
  Description of Artificial Sequence: Synthetic polypeptide
  VH of XENP018752

SEQ ID NO: 13260 - protein, 107 aa, Artificial Sequence
  Description of Artificial Sequence: Synthetic polypeptide
  VL of XENP018752
SIVMTQSPATLSVSAGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 13261 - protein, 5 aa, Artificial Sequence
  Description of Artificial Sequence: Synthetic peptide
  XENP018752 vhCDR1
NYWMN

SEQ ID NO: 13262 - protein, 19 aa, Artificial Sequence
  Description of Artificial Sequence: Synthetic peptide
  XENP018752 vhCDR2
EIRLKSNNYATHYAEPVKG

SEQ ID NO: 13263 - protein, 11 aa, Artificial Sequence
  Description of Artificial Sequence: Synthetic peptide
  XENP018752 vhCDR3
YYGNYGGYFDV

SEQ ID NO: 13264 - protein, 11 aa, Artificial Sequence
  Description of Artificial Sequence: Synthetic peptide
  XENP018752 vlCDR1
RASQSVSNDVA

SEQ ID NO: 13265 - protein, 7 aa, Artificial Sequence
  Description of Artificial Sequence: Synthetic peptide
  XENP018752 vlCDR2
YASHRYT

SEQ ID NO: 13266 - protein, 9 aa, Artificial Sequence
  Description of Artificial Sequence: Synthetic peptide
  XENP018752 vlCDR3
QQDYSSPRT

SEQ ID NO: 13267 - protein, 249 aa, Artificial Sequence
  Description of Artificial Sequence: Synthetic polypeptide
  XENP018753 1G6_H1_L1.11_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGDRATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 13268 - protein, 122 aa, Artificial Sequence; identical to SEQ ID NO: 10922
  Description of Artificial Sequence: Synthetic polypeptide
  VH of XENP018753

SEQ ID NO: 13269 - protein, 107 aa, Artificial Sequence
  Description of Artificial Sequence: Synthetic polypeptide
  VL of XENP018753
SIVMTQSPATLSVSPGDRATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 13270 - protein, 5 aa, Artificial Sequence
  Description of Artificial Sequence: Synthetic peptide
  XENP018753 vhCDR1
NYWMN

SEQ ID NO: 13271 - protein, 19 aa, Artificial Sequence
  Description of Artificial Sequence: Synthetic peptide
  XENP018753 vhCDR2
EIRLKSNNYATHYAEPVKG

SEQ ID NO: 13272 - protein, 11 aa, Artificial Sequence
  Description of Artificial Sequence: Synthetic peptide
  XENP018753 vhCDR3
YYGNYGGYFDV

SEQ ID NO: 13273 - protein, 11 aa, Artificial Sequence
  Description of Artificial Sequence: Synthetic peptide
  XENP018753 vlCDR1
RASQSVSNDVA

SEQ ID NO: 13274 - protein, 7 aa, Artificial Sequence
  Description of Artificial Sequence: Synthetic peptide
  XENP018753 vlCDR2
YASHRYT

SEQ ID NO: 13275 - protein, 9 aa, Artificial Sequence
  Description of Artificial Sequence: Synthetic peptide
  XENP018753 vlCDR3
QQDYSSPRT

SEQ ID NO: 13276 - protein, 249 aa, Artificial Sequence
  Description of Artificial Sequence: Synthetic polypeptide
  XENP018754 1G6_H1_L1.12_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERVTLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 13277 - protein, 122 aa, Artificial Sequence; identical to SEQ ID NO: 10922
  Description of Artificial Sequence: Synthetic polypeptide
  VH of XENP018754

SEQ ID NO: 13278 - protein, 107 aa, Artificial Sequence
  Description of Artificial Sequence: Synthetic polypeptide
  VL of XENP018754
SIVMTQSPATLSVSPGERVTLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 13279 - protein, 5 aa, Artificial Sequence
  Description of Artificial Sequence: Synthetic peptide
  XENP018754 vhCDR1
NYWMN

SEQ ID NO: 13280 - protein, 19 aa, Artificial Sequence
  Description of Artificial Sequence: Synthetic peptide
  XENP018754 vhCDR2
EIRLKSNNYATHYAEPVKG

SEQ ID NO: 13281 - protein, 11 aa, Artificial Sequence
  Description of Artificial Sequence: Synthetic peptide
  XENP018754 vhCDR3
YYGNYGGYFDV

SEQ ID NO: 13282 - protein, 11 aa, Artificial Sequence
  Description of Artificial Sequence: Synthetic peptide
  XENP018754 vlCDR1
RASQSVSNDVA

SEQ ID NO: 13283 - protein, 7 aa, Artificial Sequence
  Description of Artificial Sequence: Synthetic peptide
  XENP018754 vlCDR2
YASHRYT

SEQ ID NO: 13284 - protein, 9 aa, Artificial Sequence
  Description of Artificial Sequence: Synthetic peptide
  XENP018754 vlCDR3
QQDYSSPRT

SEQ ID NO: 13285 - protein, 249 aa, Artificial Sequence
  Description of Artificial Sequence: Synthetic polypeptide
  XENP018755 1G6_H1_L1.13_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATISCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 13286 - protein, 122 aa, Artificial Sequence; identical to SEQ ID NO: 10922
  Description of Artificial Sequence: Synthetic polypeptide
  VH of XENP018755

SEQ ID NO: 13287 - protein, 107 aa, Artificial Sequence
  Description of Artificial Sequence: Synthetic polypeptide
  VL of XENP018755
SIVMTQSPATLSVSPGERATISCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 13288 - protein, 5 aa, Artificial Sequence
  Description of Artificial Sequence: Synthetic peptide
  XENP018755 vhCDR1
NYWMN

SEQ ID NO: 13289 - protein, 19 aa, Artificial Sequence
  Description of Artificial Sequence: Synthetic peptide
  XENP018755 vhCDR2
EIRLKSNNYATHYAEPVKG

SEQ ID NO: 13290 - protein, 11 aa, Artificial Sequence
  Description of Artificial Sequence: Synthetic peptide
  XENP018755 vhCDR3
YYGNYGGYFDV

SEQ ID NO: 13291 - protein, 11 aa, Artificial Sequence
  Description of Artificial Sequence: Synthetic peptide
  XENP018755 vlCDR1
RASQSVSNDVA

SEQ ID NO: 13292 - protein, 7 aa, Artificial Sequence
  Description of Artificial Sequence: Synthetic peptide
  XENP018755 vlCDR2
YASHRYT

SEQ ID NO: 13293 - protein, 9 aa, Artificial Sequence
  Description of Artificial Sequence: Synthetic peptide
  XENP018755 vlCDR3
QQDYSSPRT

SEQ ID NO: 13294 - protein, 249 aa, Artificial Sequence
  Description of Artificial Sequence: Synthetic polypeptide
  XENP018756 1G6_H1_L1.14_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLTCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 13295 - protein, 122 aa, Artificial Sequence; identical to SEQ ID NO: 10922
  Description of Artificial Sequence: Synthetic polypeptide
  VH of XENP018756

SEQ ID NO: 13296 - protein, 107 aa, Artificial Sequence
  Description of Artificial Sequence: Synthetic polypeptide
  VL of XENP018756
SIVMTQSPATLSVSPGERATLTCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 13297 - protein, 5 aa, Artificial Sequence
  Description of Artificial Sequence: Synthetic peptide
  XENP018756 vhCDR1
NYWMN

SEQ ID NO: 13298 - protein, 19 aa, Artificial Sequence
  Description of Artificial Sequence: Synthetic peptide
  XENP018756 vhCDR2
EIRLKSNNYATHYAEPVKG

SEQ ID NO: 13299 - protein, 11 aa, Artificial Sequence
  Description of Artificial Sequence: Synthetic peptide
  XENP018756 vhCDR3
YYGNYGGYFDV

SEQ ID NO: 13300 - protein, 11 aa, Artificial Sequence
  Description of Artificial Sequence: Synthetic peptide
  XENP018756 vlCDR1
RASQSVSNDVA

SEQ ID NO: 13301 - protein, 7 aa, Artificial Sequence
  Description of Artificial Sequence: Synthetic peptide
  XENP018756 vlCDR2
YASHRYT

SEQ ID NO: 13302 - protein, 9 aa, Artificial Sequence
  Description of Artificial Sequence: Synthetic peptide
  XENP018756 vlCDR3
QQDYSSPRT

SEQ ID NO: 13303 - protein, 249 aa, Artificial Sequence
  Description of Artificial Sequence: Synthetic polypeptide
  XENP018757 1G6_H1_L1.15_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCKASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 13304 - protein, 122 aa, Artificial Sequence; identical to SEQ ID NO: 10922
  Description of Artificial Sequence: Synthetic polypeptide
  VH of XENP018757

SEQ ID NO: 13305 - protein, 107 aa, Artificial Sequence
  Description of Artificial Sequence: Synthetic polypeptide
  VL of XENP018757
SIVMTQSPATLSVSPGERATLSCKASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 13306 - protein, 5 aa, Artificial Sequence
  Description of Artificial Sequence: Synthetic peptide
  XENP018757 vhCDR1
NYWMN

SEQ ID NO: 13307 - protein, 19 aa, Artificial Sequence
  Description of Artificial Sequence: Synthetic peptide
  XENP018757 vhCDR2
EIRLKSNNYATHYAEPVKG

SEQ ID NO: 13308 - protein, 11 aa, Artificial Sequence
  Description of Artificial Sequence: Synthetic peptide
  XENP018757 vhCDR3
YYGNYGGYFDV

SEQ ID NO: 13309 - protein, 11 aa, Artificial Sequence
  Description of Artificial Sequence: Synthetic peptide
  XENP018757 vlCDR1
KASQSVSNDVA

SEQ ID NO: 13310 - protein, 7 aa, Artificial Sequence
  Description of Artificial Sequence: Synthetic peptide
  XENP018757 vlCDR2
YASHRYT

SEQ ID NO: 13311 - protein, 9 aa, Artificial Sequence
  Description of Artificial Sequence: Synthetic peptide
  XENP018757 vlCDR3
QQDYSSPRT

SEQ ID NO: 13312 - protein, 249 aa, Artificial Sequence
  Description of Artificial Sequence: Synthetic polypeptide
  XENP018758 1G6_H1_L1.16_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQDVSNDVAWYQQKPGQSPRLLINYASHRYTGVPDRFTGSGYGTEFTLTISSLQSEDFAVYFCQQDYSSPRTFGGGTKVEIK

SEQ ID NO: 13313 - protein, 122 aa, Artificial Sequence; identical to SEQ ID NO: 10922
  Description of Artificial Sequence: Synthetic polypeptide
  VH of XENP018758

SEQ ID NO: 13314 - protein, 107 aa, Artificial Sequence
  Description of Artificial Sequence: Synthetic polypeptide
  VL of XENP018758
SIVMTQSPATLSVSPGERATLSCRASQDVSNDVAWYQQKPGQSPRLLINYASHRYTGVPDRFTGSGYGTEFTLTISSLQSEDFAVYFCQQDYSSPRTFGGGTKVEIK

SEQ ID NO: 13315 - protein, 5 aa, Artificial Sequence
  Description of Artificial Sequence: Synthetic peptide
  XENP018758 vhCDR1
NYWMN

SEQ ID NO: 13316 - protein, 19 aa, Artificial Sequence
  Description of Artificial Sequence: Synthetic peptide
  XENP018758 vhCDR2
EIRLKSNNYATHYAEPVKG

SEQ ID NO: 13317 - protein, 11 aa, Artificial Sequence
  Description of Artificial Sequence: Synthetic peptide
  XENP018758 vhCDR3
YYGNYGGYFDV

SEQ ID NO: 13318 - protein, 11 aa, Artificial Sequence
  Description of Artificial Sequence: Synthetic peptide
  XENP018758 vlCDR1
RASQDVSNDVA

SEQ ID NO: 13319 - protein, 7 aa, Artificial Sequence
  Description of Artificial Sequence: Synthetic peptide
  XENP018758 vlCDR2
YASHRYT

SEQ ID NO: 13320 - protein, 9 aa, Artificial Sequence
  Description of Artificial Sequence: Synthetic peptide
  XENP018758 vlCDR3
QQDYSSPRT

SEQ ID NO: 13321 - protein, 249 aa, Artificial Sequence
  Description of Artificial Sequence: Synthetic polypeptide
  XENP018759 1G6_H1_L1.17_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQGVSNDVAWYQQKPGQSPRLLINYASHRYTGVPDRFTGSGYGTEFTLTISSLQSEDFAVYFCQQDYSSPRTFGGGTKVEIK

SEQ ID NO: 13322 - protein, 122 aa, Artificial Sequence; identical to SEQ ID NO: 10922
  Description of Artificial Sequence: Synthetic polypeptide
  VH of XENP018759

SEQ ID NO: 13323 - protein, 107 aa, Artificial Sequence
  Description of Artificial Sequence: Synthetic polypeptide
  VL of XENP018759
SIVMTQSPATLSVSPGERATLSCRASQGVSNDVAWYQQKPGQSPRLLINYASHRYTGVPDRFTGSGYGTEFTLTISSLQSEDFAVYFCQQDYSSPRTFGGGTKVEIK

SEQ ID NO: 13324 - protein, 5 aa, Artificial Sequence
  Description of Artificial Sequence: Synthetic peptide
  XENP018759 vhCDR1
NYWMN

SEQ ID NO: 13325 - protein, 19 aa, Artificial Sequence
  Description of Artificial Sequence: Synthetic peptide
  XENP018759 vhCDR2
EIRLKSNNYATHYAEPVKG

SEQ ID NO: 13326 - protein, 11 aa, Artificial Sequence
  Description of Artificial Sequence: Synthetic peptide
  XENP018759 vhCDR3
YYGNYGGYFDV

SEQ ID NO: 13327 - protein, 11 aa, Artificial Sequence
  Description of Artificial Sequence: Synthetic peptide
  XENP018759 vlCDR1
RASQGVSNDVA

SEQ ID NO: 13328 - protein, 7 aa, Artificial Sequence
  Description of Artificial Sequence: Synthetic peptide
  XENP018759 vlCDR2
YASHRYT

SEQ ID NO: 13329 - protein, 9 aa, Artificial Sequence
  Description of Artificial Sequence: Synthetic peptide
  XENP018759 vlCDR3
QQDYSSPRT

SEQ ID NO: 13330 - protein, 249 aa, Artificial Sequence
  Description of Artificial Sequence: Synthetic polypeptide
  XENP018760 1G6_H1_L1.18_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSISNDVAWYQQKPGQSPRLLINYASHRYTGVPDRFTGSGYGTEFTLTISSLQSEDFAVYFCQQDYSSPRTFGGGTKVEIK

SEQ ID NO: 13331 - protein, 122 aa, Artificial Sequence; identical to SEQ ID NO: 10922
  Description of Artificial Sequence: Synthetic polypeptide
  VH of XENP018760

SEQ ID NO: 13332 - protein, 107 aa, Artificial Sequence
  Description of Artificial Sequence: Synthetic polypeptide
  VL of XENP018760
SIVMTQSPATLSVSPGERATLSCRASQSISNDVAWYQQKPGQSPRLLINYASHRYTGVPDRFTGSGYGTEFTLTISSLQSEDFAVYFCQQDYSSPRTFGGGTKVEIK

SEQ ID NO: 13333 - protein, 5 aa, Artificial Sequence
  Description of Artificial Sequence: Synthetic peptide
  XENP018760 vhCDR1
NYWMN

SEQ ID NO: 13334 - protein, 19 aa, Artificial Sequence
  Description of Artificial Sequence: Synthetic peptide
  XENP018760 vhCDR2
EIRLKSNNYATHYAEPVKG

SEQ ID NO: 13335 - protein, 11 aa, Artificial Sequence
  Description of Artificial Sequence: Synthetic peptide
  XENP018760 vhCDR3
YYGNYGGYFDV

SEQ ID NO: 13336 - protein, 11 aa, Artificial Sequence
  Description of Artificial Sequence: Synthetic peptide
  XENP018760 vlCDR1
RASQSISNDVA

SEQ ID NO: 13337 - protein, 7 aa, Artificial Sequence
  Description of Artificial Sequence: Synthetic peptide
  XENP018760 vlCDR2
YASHRYT

SEQ ID NO: 13338 - protein, 9 aa, Artificial Sequence
  Description of Artificial Sequence: Synthetic peptide
  XENP018760 vlCDR3
QQDYSSPRT

SEQ ID NO: 13339 - protein, 249 aa, Artificial Sequence
  Description of Artificial Sequence: Synthetic polypeptide
  XENP018761 1G6_H1_L1.19_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSLSNDVAWYQQKPGQSPRLLINYASHRYTGVPDRFTGSGYGTEFTLTISSLQSEDFAVYFCQQDYSSPRTFGGGTKVEIK

SEQ ID NO: 13340 - protein, 122 aa, Artificial Sequence; identical to SEQ ID NO: 10922
  Description of Artificial Sequence: Synthetic polypeptide
  VH of XENP018761

SEQ ID NO: 13341 - protein, 107 aa, Artificial Sequence
  Description of Artificial Sequence: Synthetic polypeptide
  VL of XENP018761
SIVMTQSPATLSVSPGERATLSCRASQSLSNDVAWYQQKPGQSPRLLINYASHRYTGVPDRFTGSGYGTEFTLTISSLQSEDFAVYFCQQDYSSPRTFGGGTKVEIK

SEQ ID NO: 13342 - protein, 5 aa, Artificial Sequence
  Description of Artificial Sequence: Synthetic peptide
  XENP018761 vhCDR1
NYWMN

SEQ ID NO: 13343 - protein, 19 aa, Artificial Sequence
  Description of Artificial Sequence: Synthetic peptide
  XENP018761 vhCDR2
EIRLKSNNYATHYAEPVKG

SEQ ID NO: 13344 - protein, 11 aa, Artificial Sequence
  Description of Artificial Sequence: Synthetic peptide
  XENP018761 vhCDR3
YYGNYGGYFDV

SEQ ID NO: 13345 - protein, 11 aa, Artificial Sequence
  Description of Artificial Sequence: Synthetic peptide
  XENP018761 vlCDR1
RASQSLSNDVA

SEQ ID NO: 13346 - protein, 7 aa, Artificial Sequence
  Description of Artificial Sequence: Synthetic peptide
  XENP018761 vlCDR2
YASHRYT

SEQ ID NO: 13347 - protein, 9 aa, Artificial Sequence
  Description of Artificial Sequence: Synthetic peptide
  XENP018761 vlCDR3
QQDYSSPRT

SEQ ID NO: 13348 - protein, 249 aa, Artificial Sequence
  Description of Artificial Sequence: Synthetic polypeptide
  XENP018762 1G6_H1_L1.20_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVTNDVAWYQQKPGQSPRLLINYASHRYTGVPDRFTGSGYGTEFTLTISSLQSEDFAVYFCQQDYSSPRTFGGGTKVEIK

SEQ ID NO: 13349 - protein, 122 aa, Artificial Sequence; identical to SEQ ID NO: 10922
  Description of Artificial Sequence: Synthetic polypeptide
  VH of XENP018762

SEQ ID NO: 13350 - protein, 107 aa, Artificial Sequence
  Description of Artificial Sequence: Synthetic polypeptide
  VL of XENP018762
SIVMTQSPATLSVSPGERATLSCRASQSVTNDVAWYQQKPGQSPRLLINYASHRYTGVPDRFTGSGYGTEFTLTISSLQSEDFAVYFCQQDYSSPRTFGGGTKVEIK

SEQ ID NO: 13351 - protein, 5 aa, Artificial Sequence
  Description of Artificial Sequence: Synthetic peptide
  XENP018762 vhCDR1
NYWMN

SEQ ID NO: 13352 - protein, 19 aa, Artificial Sequence
  Description of Artificial Sequence: Synthetic peptide
  XENP018762 vhCDR2
EIRLKSNNYATHYAEPVKG

SEQ ID NO: 13353 - protein, 11 aa, Artificial Sequence
  Description of Artificial Sequence: Synthetic peptide
  XENP018762 vhCDR3
YYGNYGGYFDV

SEQ ID NO: 13354 - protein, 11 aa, Artificial Sequence
  Description of Artificial Sequence: Synthetic peptide
  XENP018762 vlCDR1
RASQSVTNDVA

SEQ ID NO: 13355 - protein, 7 aa, Artificial Sequence
  Description of Artificial Sequence: Synthetic peptide
  XENP018762 vlCDR2
YASHRYT

SEQ ID NO: 13356 - protein, 9 aa, Artificial Sequence
  Description of Artificial Sequence: Synthetic peptide
  XENP018762 vlCDR3
QQDYSSPRT

SEQ ID NO: 13357 - protein, 249 aa, Artificial Sequence
  Description of Artificial Sequence: Synthetic polypeptide
  XENP018763 1G6_H1_L1.21_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVANDVAWYQQKPGQSPRLLINYASHRYTGVPDRFTGSGYGTEFTLTISSLQSEDFAVYFCQQDYSSPRTFGGGTKVEIK

SEQ ID NO: 13358 - protein, 122 aa, Artificial Sequence; identical to SEQ ID NO: 10922
  Description of Artificial Sequence: Synthetic polypeptide
  VH of XENP018763

SEQ ID NO: 13359 - protein, 107 aa, Artificial Sequence
  Description of Artificial Sequence: Synthetic polypeptide
  VL of XENP018763
SIVMTQSPATLSVSPGERATLSCRASQSVANDVAWYQQKPGQSPRLLINYASHRYTGVPDRFTGSGYGTEFTLTISSLQSEDFAVYFCQQDYSSPRTFGGGTKVEIK

SEQ ID NO: 13360 - protein, 5 aa, Artificial Sequence
  Description of Artificial Sequence: Synthetic peptide
  XENP018763 vhCDR1
NYWMN

SEQ ID NO: 13361 - protein, 19 aa, Artificial Sequence
  Description of Artificial Sequence: Synthetic peptide
  XENP018763 vhCDR2
EIRLKSNNYATHYAEPVKG

SEQ ID NO: 13362 - protein, 11 aa, Artificial Sequence
  Description of Artificial Sequence: Synthetic peptide
  XENP018763 vhCDR3
YYGNYGGYFDV

SEQ ID NO: 13363 - protein, 11 aa, Artificial Sequence
  Description of Artificial Sequence: Synthetic peptide
  XENP018763 vlCDR1
RASQSVANDVA

SEQ ID NO: 13364 - protein, 7 aa, Artificial Sequence
  Description of Artificial Sequence: Synthetic peptide
  XENP018763 vlCDR2
YASHRYT

SEQ ID NO: 13365 - protein, 9 aa, Artificial Sequence
  Description of Artificial Sequence: Synthetic peptide
  XENP018763 vlCDR3
QQDYSSPRT

SEQ ID NO: 13366 - protein, 249 aa, Artificial Sequence
  Description of Artificial Sequence: Synthetic polypeptide
  XENP018764 1G6_H1_L1.22_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVQNDVAWYQQKPGQSPRLLINYASHRYTGVPDRFTGSGYGTEFTLTISSLQSEDFAVYFCQQDYSSPRTFGGGTKVEIK

SEQ ID NO: 13367 - protein, 122 aa, Artificial Sequence; identical to SEQ ID NO: 10922
  Description of Artificial Sequence: Synthetic polypeptide
  VH of XENP018764

SEQ ID NO: 13368 - protein, 107 aa, Artificial Sequence
  Description of Artificial Sequence: Synthetic polypeptide
  VL of XENP018764
SIVMTQSPATLSVSPGERATLSCRASQSVQNDVAWYQQKPGQSPRLLINYASHRYTGVPDRFTGSGYGTEFTLTISSLQSEDFAVYFCQQDYSSPRTFGGGTKVEIK

SEQ ID NO: 13369 - protein, 5 aa, Artificial Sequence
  Description of Artificial Sequence: Synthetic peptide
  XENP018764 vhCDR1
NYWMN

SEQ ID NO: 13370 - protein, 19 aa, Artificial Sequence
  Description of Artificial Sequence: Synthetic peptide
  XENP018764 vhCDR2
EIRLKSNNYATHYAEPVKG

SEQ ID NO: 13371 - protein, 11 aa, Artificial Sequence
  Description of Artificial Sequence: Synthetic peptide
  XENP018764 vhCDR3
YYGNYGGYFDV

SEQ ID NO: 13372 - protein, 11 aa, Artificial Sequence
  Description of Artificial Sequence: Synthetic peptide
  XENP018764 vlCDR1
RASQSVQNDVA

SEQ ID NO: 13373 - protein, 7 aa, Artificial Sequence
  Description of Artificial Sequence: Synthetic peptide
  XENP018764 vlCDR2
YASHRYT

SEQ ID NO: 13374 - protein, 9 aa, Artificial Sequence
  Description of Artificial Sequence: Synthetic peptide
  XENP018764 vlCDR3
QQDYSSPRT

SEQ ID NO: 13375 - protein, 249 aa, Artificial Sequence
  Description of Artificial Sequence: Synthetic polypeptide
  XENP018765 1G6_H1_L1.23_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVGNDVAWYQQKPGQSPRLLINYASHRYTGVPDRFTGSGYGTEFTLTISSLQSEDFAVYFCQQDYSSPRTFGGGTKVEIK

SEQ ID NO: 13376 - protein, 122 aa, Artificial Sequence; identical to SEQ ID NO: 10922
  Description of Artificial Sequence: Synthetic polypeptide
  VH of XENP018765

SEQ ID NO: 13377 - protein, 107 aa, Artificial Sequence
  Description of Artificial Sequence: Synthetic polypeptide
  VL of XENP018765
SIVMTQSPATLSVSPGERATLSCRASQSVGNDVAWYQQKPGQSPRLLINYASHRYTGVPDRFTGSGYGTEFTLTISSLQSEDFAVYFCQQDYSSPRTFGGGTKVEIK

SEQ ID NO: 13378 - protein, 5 aa, Artificial Sequence
  Description of Artificial Sequence: Synthetic peptide
  XENP018765 vhCDR1
NYWMN

SEQ ID NO: 13379 - protein, 19 aa, Artificial Sequence
  Description of Artificial Sequence: Synthetic peptide
  XENP018765 vhCDR2
EIRLKSNNYATHYAEPVKG

SEQ ID NO: 13380 - protein, 11 aa, Artificial Sequence
  Description of Artificial Sequence: Synthetic peptide
  XENP018765 vhCDR3
YYGNYGGYFDV

SEQ ID NO: 13381 - protein, 11 aa, Artificial Sequence
  Description of Artificial Sequence: Synthetic peptide
  XENP018765 vlCDR1
RASQSVGNDVA

SEQ ID NO: 13382 - protein, 7 aa, Artificial Sequence
  Description of Artificial Sequence: Synthetic peptide
  XENP018765 vlCDR2
YASHRYT

SEQ ID NO: 13383 - protein, 9 aa, Artificial Sequence
  Description of Artificial Sequence: Synthetic peptide
  XENP018765 vlCDR3
QQDYSSPRT

SEQ ID NO: 13384 - protein, 249 aa, Artificial Sequence
  Description of Artificial Sequence: Synthetic polypeptide
  XENP018766 1G6_H1_L1.24_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVVNDVAWYQQKPGQSPRLLINYASHRYTGVPDRFTGSGYGTEFTLTISSLQSEDFAVYFCQQDYSSPRTFGGGTKVEIK

SEQ ID NO: 13385 - protein, 122 aa, Artificial Sequence; identical to SEQ ID NO: 10922
  Description of Artificial Sequence: Synthetic polypeptide
  VH of XENP018766

SEQ ID NO: 13386 - protein, 107 aa, Artificial Sequence
  Description of Artificial Sequence: Synthetic polypeptide
  VL of XENP018766
SIVMTQSPATLSVSPGERATLSCRASQSVVNDVAWYQQKPGQSPRLLINYASHRYTGVPDRFTGSGYGTEFTLTISSLQSEDFAVYFCQQDYSSPRTFGGGTKVEIK

SEQ ID NO: 13387 - protein, 5 aa, Artificial Sequence
  Description of Artificial Sequence: Synthetic peptide
  XENP018766 vhCDR1
NYWMN

SEQ ID NO: 13388 - protein, 19 aa, Artificial Sequence
  Description of Artificial Sequence: Synthetic peptide
  XENP018766 vhCDR2
EIRLKSNNYATHYAEPVKG

SEQ ID NO: 13389 - protein, 11 aa, Artificial Sequence
  Description of Artificial Sequence: Synthetic peptide
  XENP018766 vhCDR3
YYGNYGGYFDV

SEQ ID NO: 13390 - protein, 11 aa, Artificial Sequence
  Description of Artificial Sequence: Synthetic peptide
  XENP018766 vlCDR1
RASQSVVNDVA

SEQ ID NO: 13391 - protein, 7 aa, Artificial Sequence
  Description of Artificial Sequence: Synthetic peptide
  XENP018766 vlCDR2
YASHRYT

SEQ ID NO: 13392 - protein, 9 aa, Artificial Sequence
  Description of Artificial Sequence: Synthetic peptide
  XENP018766 vlCDR3
QQDYSSPRT

SEQ ID NO: 13393 - protein, 249 aa, Artificial Sequence
  Description of Artificial Sequence: Synthetic polypeptide
  XENP018767 1G6_H1_L1.25_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVHNDVAWYQQKPGQSPRLLINYASHRYTGVPDRFTGSGYGTEFTLTISSLQSEDFAVYFCQQDYSSPRTFGGGTKVEIK

SEQ ID NO: 13394 - protein, 122 aa, Artificial Sequence; identical to SEQ ID NO: 10922
  Description of Artificial Sequence: Synthetic polypeptide
  VH of XENP018767

SEQ ID NO: 13395 - protein, 107 aa, Artificial Sequence
  Description of Artificial Sequence: Synthetic polypeptide
  VL of XENP018767
SIVMTQSPATLSVSPGERATLSCRASQSVHNDVAWYQQKPGQSPRLLINYASHRYTGVPDRFTGSGYGTEFTLTISSLQSEDFAVYFCQQDYSSPRTFGGGTKVEIK

SEQ ID NO: 13396 - protein, 5 aa, Artificial Sequence
  Description of Artificial Sequence: Synthetic peptide
  XENP018767 vhCDR1
NYWMN

SEQ ID NO: 13397 - protein, 19 aa, Artificial Sequence
  Description of Artificial Sequence: Synthetic peptide
  XENP018767 vhCDR2
EIRLKSNNYATHYAEPVKG

SEQ ID NO: 13398 - protein, 11 aa, Artificial Sequence
  Description of Artificial Sequence: Synthetic peptide
  XENP018767 vhCDR3
YYGNYGGYFDV

SEQ ID NO: 13399 - protein, 11 aa, Artificial Sequence
  Description of Artificial Sequence: Synthetic peptide
  XENP018767 vlCDR1
RASQSVHNDVA

SEQ ID NO: 13400 - protein, 7 aa, Artificial Sequence
  Description of Artificial Sequence: Synthetic peptide
  XENP018767 vlCDR2
YASHRYT

SEQ ID NO: 13401 - protein, 9 aa, Artificial Sequence
  Description of Artificial Sequence: Synthetic peptide
  XENP018767 vlCDR3
QQDYSSPRT

SEQ ID NO: 13402 - protein, 249 aa, Artificial Sequence
  Description of Artificial Sequence: Synthetic polypeptide
  XENP018768 1G6_H1_L1.26_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVDNDVAWYQQKPGQSPRLLINYASHRYTGVPDRFTGSGYGTEFTLTISSLQSEDFAVYFCQQDYSSPRTFGGGTKVEIK

SEQ ID NO: 13403 - protein, 122 aa, Artificial Sequence; identical to SEQ ID NO: 10922
  Description of Artificial Sequence: Synthetic polypeptide
  VH of XENP018768

SEQ ID NO: 13404 - protein, 107 aa, Artificial Sequence
  Description of Artificial Sequence: Synthetic polypeptide
  VL of XENP018768
SIVMTQSPATLSVSPGERATLSCRASQSVDNDVAWYQQKPGQSPRLLINYASHRYTGVPDRFTGSGYGTEFTLTISSLQSEDFAVYFCQQDYSSPRTFGGGTKVEIK

SEQ ID NO: 13405 - protein, 5 aa, Artificial Sequence
  Description of Artificial Sequence: Synthetic peptide
  XENP018768 vhCDR1
NYWMN

SEQ ID NO: 13406 - protein, 19 aa, Artificial Sequence
  Description of Artificial Sequence: Synthetic peptide
  XENP018768 vhCDR2
EIRLKSNNYATHYAEPVKG

SEQ ID NO: 13407 - protein, 11 aa, Artificial Sequence
  Description of Artificial Sequence: Synthetic peptide
  XENP018768 vhCDR3
YYGNYGGYFDV

SEQ ID NO: 13408 - protein, 11 aa, Artificial Sequence
  Description of Artificial Sequence: Synthetic peptide
  XENP018768 vlCDR1
RASQSVDNDVA

SEQ ID NO: 13409 - protein, 7 aa, Artificial Sequence
  Description of Artificial Sequence: Synthetic peptide
  XENP018768 vlCDR2
YASHRYT

SEQ ID NO: 13410 - protein, 9 aa, Artificial Sequence
  Description of Artificial Sequence: Synthetic peptide
  XENP018768 vlCDR3
QQDYSSPRT

SEQ ID NO: 13411 - protein, 249 aa, Artificial Sequence
  Description of Artificial Sequence: Synthetic polypeptide
  XENP018769 1G6_H1_L1.27_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVKNDVAWYQQKPGQSPRLLINYASHRYTGVPDRFTGSGYGTEFTLTISSLQSEDFAVYFCQQDYSSPRTFGGGTKVEIK

SEQ ID NO: 13412 - protein, 122 aa, Artificial Sequence; identical to SEQ ID NO: 10922
  Description of Artificial Sequence: Synthetic polypeptide
  VH of XENP018769

SEQ ID NO: 13413 - protein, 107 aa, Artificial Sequence
  Description of Artificial Sequence: Synthetic polypeptide
  VL of XENP018769
SIVMTQSPATLSVSPGERATLSCRASQSVKNDVAWYQQKPGQSPRLLINYASHRYTGVPDRFTGSGYGTEFTLTISSLQSEDFAVYFCQQDYSSPRTFGGGTKVEIK

SEQ ID NO: 13414 - protein, 5 aa, Artificial Sequence
  Description of Artificial Sequence: Synthetic peptide
  XENP018769 vhCDR1
NYWMN

SEQ ID NO: 13415 - protein, 19 aa, Artificial Sequence
  Description of Artificial Sequence: Synthetic peptide
  XENP018769 vhCDR2
EIRLKSNNYATHYAEPVKG

SEQ ID NO: 13416 - protein, 11 aa, Artificial Sequence
  Description of Artificial Sequence: Synthetic peptide
  XENP018769 vhCDR3
YYGNYGGYFDV

SEQ ID NO: 13417 - protein, 11 aa, Artificial Sequence
  Description of Artificial Sequence: Synthetic peptide
  XENP018769 vlCDR1
RASQSVKNDVA

SEQ ID NO: 13418 - protein, 7 aa, Artificial Sequence
  Description of Artificial Sequence: Synthetic peptide
  XENP018769 vlCDR2
YASHRYT

SEQ ID NO: 13419 - protein, 9 aa, Artificial Sequence
  Description of Artificial Sequence: Synthetic peptide
  XENP018769 vlCDR3
QQDYSSPRT

SEQ ID NO: 13420 - protein, 249 aa, Artificial Sequence
  Description of Artificial Sequence: Synthetic polypeptide
  XENP018770 1G6_H1_L1.28_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVYNDVAWYQQKPGQSPRLLINYASHRYTGVPDRFTGSGYGTEFTLTISSLQSEDFAVYFCQQDYSSPRTFGGGTKVEIK

SEQ ID NO: 13421 - protein, 122 aa, Artificial Sequence; identical to SEQ ID NO: 10922
  Description of Artificial Sequence: Synthetic polypeptide
  VH of XENP018770

SEQ ID NO: 13422 - protein, 107 aa, Artificial Sequence
  Description of Artificial Sequence: Synthetic polypeptide
  VL of XENP018770
SIVMTQSPATLSVSPGERATLSCRASQSVYNDVAWYQQKPGQSPRLLINYASHRYTGVPDRFTGSGYGTEFTLTISSLQSEDFAVYFCQQDYSSPRTFGGGTKVEIK

SEQ ID NO: 13423 - protein, 5 aa, Artificial Sequence
  Description of Artificial Sequence: Synthetic peptide
  XENP018770 vhCDR1
NYWMN

SEQ ID NO: 13424 - protein, 19 aa, Artificial Sequence
  Description of Artificial Sequence: Synthetic peptide
  XENP018770 vhCDR2
EIRLKSNNYATHYAEPVKG

SEQ ID NO: 13425 - protein, 11 aa, Artificial Sequence
  Description of Artificial Sequence: Synthetic peptide
  XENP018770 vhCDR3
YYGNYGGYFDV

SEQ ID NO: 13426 - protein, 11 aa, Artificial Sequence
  Description of Artificial Sequence: Synthetic peptide
  XENP018770 vlCDR1
RASQSVYNDVA

SEQ ID NO: 13427 - protein, 7 aa, Artificial Sequence
  Description of Artificial Sequence: Synthetic peptide
  XENP018770 vlCDR2
YASHRYT

SEQ ID NO: 13428 - protein, 9 aa, Artificial Sequence
  Description of Artificial Sequence: Synthetic peptide
  XENP018770 vlCDR3
QQDYSSPRT

SEQ ID NO: 13429 - protein, 249 aa, Artificial Sequence
  Description of Artificial Sequence: Synthetic polypeptide
  XENP018771 1G6_H1_L1.29_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSDDVAWYQQKPGQSPRLLINYASHRYTGVPDRFTGSGYGTEFTLTISSLQSEDFAVYFCQQDYSSPRTFGGGTKVEIK

SEQ ID NO: 13430 - protein, 122 aa, Artificial Sequence; identical to SEQ ID NO: 10922
  Description of Artificial Sequence: Synthetic polypeptide
  VH of XENP018771

SEQ ID NO: 13431 - protein, 107 aa, Artificial Sequence
  Description of Artificial Sequence: Synthetic polypeptide
  VL of XENP018771
SIVMTQSPATLSVSPGERATLSCRASQSVSDDVAWYQQKPGQSPRLLINYASHRYTGVPDRFTGSGYGTEFTLTISSLQSEDFAVYFCQQDYSSPRTFGGGTKVEIK

SEQ ID NO: 13432 - protein, 5 aa, Artificial Sequence
  Description of Artificial Sequence: Synthetic peptide
  XENP018771 vhCDR1
NYWMN

SEQ ID NO: 13433 - protein, 19 aa, Artificial Sequence
  Description of Artificial Sequence: Synthetic peptide
  XENP018771 vhCDR2
EIRLKSNNYATHYAEPVKG

SEQ ID NO: 13434 - protein, 11 aa, Artificial Sequence
  Description of Artificial Sequence: Synthetic peptide
  XENP018771 vhCDR3
YYGNYGGYFDV

SEQ ID NO: 13435 - protein, 11 aa, Artificial Sequence
  Description of Artificial Sequence: Synthetic peptide
  XENP018771 vlCDR1
RASQSVSDDVA

SEQ ID NO: 13436 - protein, 7 aa, Artificial Sequence
  Description of Artificial Sequence: Synthetic peptide
  XENP018771 vlCDR2
YASHRYT

SEQ ID NO: 13437 - protein, 9 aa, Artificial Sequence
  Description of Artificial Sequence: Synthetic peptide
  XENP018771 vlCDR3
QQDYSSPRT

SEQ ID NO: 13438 - protein, 249 aa, Artificial Sequence
  Description of Artificial Sequence: Synthetic polypeptide
  XENP018772 1G6_H1_L1.30_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSHDVAWYQQKPGQSPRLLINYASHRYTGVPDRFTGSGYGTEFTLTISSLQSEDFAVYFCQQDYSSPRTFGGGTKVEIK

SEQ ID NO: 13439 - protein, 122 aa, Artificial Sequence; identical to SEQ ID NO: 10922
  Description of Artificial Sequence: Synthetic polypeptide
  VH of XENP018772

SEQ ID NO: 13440 - protein, 107 aa, Artificial Sequence
  Description of Artificial Sequence: Synthetic polypeptide
  VL of XENP018772
SIVMTQSPATLSVSPGERATLSCRASQSVSHDVAWYQQKPGQSPRLLINYASHRYTGVPDRFTGSGYGTEFTLTISSLQSEDFAVYFCQQDYSSPRTFGGGTKVEIK

SEQ ID NO: 13441 - protein, 5 aa, Artificial Sequence
  Description of Artificial Sequence: Synthetic peptide
  XENP018772 vhCDR1
NYWMN

SEQ ID NO: 13442 - protein, 19 aa, Artificial Sequence
  Description of Artificial Sequence: Synthetic peptide
  XENP018772 vhCDR2
EIRLKSNNYATHYAEPVKG

SEQ ID NO: 13443 - protein, 11 aa, Artificial Sequence
  Description of Artificial Sequence: Synthetic peptide
  XENP018772 vhCDR3
YYGNYGGYFDV

SEQ ID NO: 13444 - protein, 11 aa, Artificial Sequence
  Description of Artificial Sequence: Synthetic peptide
  XENP018772 vlCDR1
RASQSVSHDVA

SEQ ID NO: 13445 - protein, 7 aa, Artificial Sequence
  Description of Artificial Sequence: Synthetic peptide
  XENP018772 vlCDR2
YASHRYT

SEQ ID NO: 13446 - protein, 9 aa, Artificial Sequence
  Description of Artificial Sequence: Synthetic peptide
  XENP018772 vlCDR3
QQDYSSPRT

SEQ ID NO: 13447 - protein, 249 aa, Artificial Sequence
  Description of Artificial Sequence: Synthetic polypeptide
  XENP018773 1G6_H1_L1.31_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSEDVAWYQQKPGQSPRLLINYASHRYTGVPDRFTGSGYGTEFTLTISSLQSEDFAVYFCQQDYSSPRTFGGGTKVEIK

SEQ ID NO: 13448 - protein, 122 aa, Artificial Sequence; identical to SEQ ID NO: 10922
  Description of Artificial Sequence: Synthetic polypeptide
  VH of XENP018773

SEQ ID NO: 13449 - protein, 107 aa, Artificial Sequence
  Description of Artificial Sequence: Synthetic polypeptide
  VL of XENP018773
SIVMTQSPATLSVSPGERATLSCRASQSVSEDVAWYQQKPGQSPRLLINYASHRYTGVPDRFTGSGYGTEFTLTISSLQSEDFAVYFCQQDYSSPRTFGGGTKVEIK

SEQ ID NO: 13450 - protein, 5 aa, Artificial Sequence
  Description of Artificial Sequence: Synthetic peptide
  XENP018773 vhCDR1
NYWMN

SEQ ID NO: 13451 - protein, 19 aa, Artificial Sequence
  Description of Artificial Sequence: Synthetic peptide
  XENP018773 vhCDR2
EIRLKSNNYATHYAEPVKG

SEQ ID NO: 13452 - protein, 11 aa, Artificial Sequence
  Description of Artificial Sequence: Synthetic peptide
  XENP018773 vhCDR3
YYGNYGGYFDV

SEQ ID NO: 13453 - protein, 11 aa, Artificial Sequence
  Description of Artificial Sequence: Synthetic peptide
  XENP018773 vlCDR1
RASQSVSEDVA

SEQ ID NO: 13454 - protein, 7 aa, Artificial Sequence
  Description of Artificial Sequence: Synthetic peptide
  XENP018773 vlCDR2
YASHRYT

SEQ ID NO: 13455 - protein, 9 aa, Artificial Sequence
  Description of Artificial Sequence: Synthetic peptide
  XENP018773 vlCDR3
QQDYSSPRT

SEQ ID NO: 13456 - protein, 249 aa, Artificial Sequence
  Description of Artificial Sequence: Synthetic polypeptide
  XENP018774 1G6_H1_L1.32_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSSDVAWYQQKPGQSPRLLINYASHRYTGVPDRFTGSGYGTEFTLTISSLQSEDFAVYFCQQDYSSPRTFGGGTKVEIK

SEQ ID NO: 13457 - protein, 122 aa, Artificial Sequence; identical to SEQ ID NO: 10922
  Description of Artificial Sequence: Synthetic polypeptide
  VH of XENP018774

SEQ ID NO: 13458 - protein, 107 aa, Artificial Sequence
  Description of Artificial Sequence: Synthetic polypeptide
  VL of XENP018774
SIVMTQSPATLSVSPGERATLSCRASQSVSSDVAWYQQKPGQSPRLLINYASHRYTGVPDRFTGSGYGTEFTLTISSLQSEDFAVYFCQQDYSSPRTFGGGTKVEIK

SEQ ID NO: 13459 - protein, 5 aa, Artificial Sequence
  Description of Artificial Sequence: Synthetic peptide
  XENP018774 vhCDR1
NYWMN

SEQ ID NO: 13460 - protein, 19 aa, Artificial Sequence
  Description of Artificial Sequence: Synthetic peptide
  XENP018774 vhCDR2
EIRLKSNNYATHYAEPVKG

SEQ ID NO: 13461 - protein, 11 aa, Artificial Sequence
  Description of Artificial Sequence: Synthetic peptide
  XENP018774 vhCDR3
YYGNYGGYFDV

SEQ ID NO: 13462 - protein, 11 aa, Artificial Sequence
  Description of Artificial Sequence: Synthetic peptide
  XENP018774 vlCDR1
RASQSVSSDVA

SEQ ID NO: 13463 - protein, 7 aa, Artificial Sequence
  Description of Artificial Sequence: Synthetic peptide
  XENP018774 vlCDR2
YASHRYT

SEQ ID NO: 13464 - protein, 9 aa, Artificial Sequence
  Description of Artificial Sequence: Synthetic peptide
  XENP018774 vlCDR3
QQDYSSPRT

SEQ ID NO: 13465 - protein, 249 aa, Artificial Sequence
  Description of Artificial Sequence: Synthetic polypeptide
  XENP018775 1G6_H1_L1.33_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSRDVAWYQQKPGQSPRLLINYASHRYTGVPDRFTGSGYGTEFTLTISSLQSEDFAVYFCQQDYSSPRTFGGGTKVEIK

SEQ ID NO: 13466 - protein, 122 aa, Artificial Sequence; identical to SEQ ID NO: 10922
  Description of Artificial Sequence: Synthetic polypeptide
  VH of XENP018775

SEQ ID NO: 13467 - protein, 107 aa, Artificial Sequence
  Description of Artificial Sequence: Synthetic polypeptide
  VL of XENP018775
SIVMTQSPATLSVSPGERATLSCRASQSVSRDVAWYQQKPGQSPRLLINYASHRYTGVPDRFTGSGYGTEFTLTISSLQSEDFAVYFCQQDYSSPRTFGGGTKVEIK

SEQ ID NO: 13468 - protein, 5 aa, Artificial Sequence
  Description of Artificial Sequence: Synthetic peptide
  XENP018775 vhCDR1
NYWMN

SEQ ID NO: 13469 - protein, 19 aa, Artificial Sequence
  Description of Artificial Sequence: Synthetic peptide
  XENP018775 vhCDR2
EIRLKSNNYATHYAEPVKG

SEQ ID NO: 13470 - protein, 11 aa, Artificial Sequence
  Description of Artificial Sequence: Synthetic peptide
  XENP018775 vhCDR3
YYGNYGGYFDV

SEQ ID NO: 13471 - protein, 11 aa, Artificial Sequence
  Description of Artificial Sequence: Synthetic peptide
  XENP018775 vlCDR1
RASQSVSRDVA

SEQ ID NO: 13472 - protein, 7 aa, Artificial Sequence
  Description of Artificial Sequence: Synthetic peptide
  XENP018775 vlCDR2
YASHRYT

SEQ ID NO: 13473 - protein, 9 aa, Artificial Sequence
  Description of Artificial Sequence: Synthetic peptide
  XENP018775 vlCDR3
QQDYSSPRT

SEQ ID NO: 13474 - protein, 249 aa, Artificial Sequence
  Description of Artificial Sequence: Synthetic polypeptide
  XENP018776 1G6_H1_L1.34_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSLDVAWYQQKPGQSPRLLINYASHRYTGVPDRFTGSGYGTEFTLTISSLQSEDFAVYFCQQDYSSPRTFGGGTKVEIK

SEQ ID NO: 13475 - protein, 122 aa, Artificial Sequence; identical to SEQ ID NO: 10922
  Description of Artificial Sequence: Synthetic polypeptide
  VH of XENP018776

SEQ ID NO: 13476 - protein, 107 aa, Artificial Sequence
  Description of Artificial Sequence: Synthetic polypeptide
  VL of XENP018776
SIVMTQSPATLSVSPGERATLSCRASQSVSLDVAWYQQKPGQSPRLLINYASHRYTGVPDRFTGSGYGTEFTLTISSLQSEDFAVYFCQQDYSSPRTFGGGTKVEIK

SEQ ID NO: 13477 - protein, 5 aa, Artificial Sequence
  Description of Artificial Sequence: Synthetic peptide
  XENP018776 vhCDR1
NYWMN

SEQ ID NO: 13478 - protein, 19 aa, Artificial Sequence
  Description of Artificial Sequence: Synthetic peptide
  XENP018776 vhCDR2
EIRLKSNNYATHYAEPVKG

SEQ ID NO: 13479 - protein, 11 aa, Artificial Sequence
  Description of Artificial Sequence: Synthetic peptide
  XENP018776 vhCDR3
YYGNYGGYFDV

SEQ ID NO: 13480 - protein, 11 aa, Artificial Sequence
  Description of Artificial Sequence: Synthetic peptide
  XENP018776 vlCDR1
RASQSVSLDVA

SEQ ID NO: 13481 - protein, 7 aa, Artificial Sequence
  Description of Artificial Sequence: Synthetic peptide
  XENP018776 vlCDR2
YASHRYT

SEQ ID NO: 13482 - protein, 9 aa, Artificial Sequence
  Description of Artificial Sequence: Synthetic peptide
  XENP018776 vlCDR3
QQDYSSPRT

SEQ ID NO: 13483 - protein, 249 aa, Artificial Sequence
  Description of Artificial Sequence: Synthetic polypeptide
  XENP018777 1G6_H1_L1.35_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSTDVAWYQQKPGQSPRLLINYASHRYTGVPDRFTGSGYGTEFTLTISSLQSEDFAVYFCQQDYSSPRTFGGGTKVEIK

SEQ ID NO: 13484 - protein, 122 aa, Artificial Sequence; identical to SEQ ID NO: 10922
  Description of Artificial Sequence: Synthetic polypeptide
  VH of XENP018777

SEQ ID NO: 13485 - protein, 107 aa, Artificial Sequence
  Description of Artificial Sequence: Synthetic polypeptide
  VL of XENP018777
SIVMTQSPATLSVSPGERATLSCRASQSVSTDVAWYQQKPGQSPRLLINYASHRYTGVPDRFTGSGYGTEFTLTISSLQSEDFAVYFCQQDYSSPRTFGGGTKVEIK

SEQ ID NO: 13486 - protein, 5 aa, Artificial Sequence
  Description of Artificial Sequence: Synthetic peptide
  XENP018777 vhCDR1
NYWMN

SEQ ID NO: 13487 - protein, 19 aa, Artificial Sequence
  Description of Artificial Sequence: Synthetic peptide
  XENP018777 vhCDR2
EIRLKSNNYATHYAEPVKG

SEQ ID NO: 13488 - protein, 11 aa, Artificial Sequence
  Description of Artificial Sequence: Synthetic peptide
  XENP018777 vhCDR3
YYGNYGGYFDV

SEQ ID NO: 13489 - protein, 11 aa, Artificial Sequence
  Description of Artificial Sequence: Synthetic peptide
  XENP018777 vlCDR1
RASQSVSTDVA

SEQ ID NO: 13490 - protein, 7 aa, Artificial Sequence
  Description of Artificial Sequence: Synthetic peptide
  XENP018777 vlCDR2
YASHRYT

SEQ ID NO: 13491 - protein, 9 aa, Artificial Sequence
  Description of Artificial Sequence: Synthetic peptide
  XENP018777 vlCDR3
QQDYSSPRT

SEQ ID NO: 13492 - protein, 249 aa, Artificial Sequence
  Description of Artificial Sequence: Synthetic polypeptide
  XENP018778 1G6_H1_L1.36_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSGDVAWYQQKPGQSPRLLINYASHRYTGVPDRFTGSGYGTEFTLTISSLQSEDFAVYFCQQDYSSPRTFGGGTKVEIK

SEQ ID NO: 13493 - protein, 122 aa, Artificial Sequence; identical to SEQ ID NO: 10922
  Description of Artificial Sequence: Synthetic polypeptide
  VH of XENP018778

SEQ ID NO: 13494 - protein, 107 aa, Artificial Sequence
  Description of Artificial Sequence: Synthetic polypeptide
  VL of XENP018778
SIVMTQSPATLSVSPGERATLSCRASQSVSGDVAWYQQKPGQSPRLLINYASHRYTGVPDRFTGSGYGTEFTLTISSLQSEDFAVYFCQQDYSSPRTFGGGTKVEIK

SEQ ID NO: 13495 - protein, 5 aa, Artificial Sequence
  Description of Artificial Sequence: Synthetic peptide
  XENP018778 vhCDR1
NYWMN

SEQ ID NO: 13496 - protein, 19 aa, Artificial Sequence
  Description of Artificial Sequence: Synthetic peptide
  XENP018778 vhCDR2
EIRLKSNNYATHYAEPVKG

SEQ ID NO: 13497 - protein, 11 aa, Artificial Sequence
  Description of Artificial Sequence: Synthetic peptide
  XENP018778 vhCDR3
YYGNYGGYFDV

SEQ ID NO: 13498 - protein, 11 aa, Artificial Sequence
  Description of Artificial Sequence: Synthetic peptide
  XENP018778 vlCDR1
RASQSVSGDVA

SEQ ID NO: 13499 - protein, 7 aa, Artificial Sequence
  Description of Artificial Sequence: Synthetic peptide
  XENP018778 vlCDR2
YASHRYT

SEQ ID NO: 13500 - protein, 9 aa, Artificial Sequence
  Description of Artificial Sequence: Synthetic peptide
  XENP018778 vlCDR3
QQDYSSPRT

SEQ ID NO: 13501 - protein, 249 aa, Artificial Sequence
  Description of Artificial Sequence: Synthetic polypeptide
  XENP018779 1G6_H1_L1.37_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSYDVAWYQQKPGQSPRLLINYASHRYTGVPDRFTGSGYGTEFTLTISSLQSEDFAVYFCQQDYSSPRTFGGGTKVEIK

SEQ ID NO: 13502 - protein, 122 aa, Artificial Sequence; identical to SEQ ID NO: 10922
  Description of Artificial Sequence: Synthetic polypeptide
  VH of XENP018779

SEQ ID NO: 13503 - protein, 107 aa, Artificial Sequence
  Description of Artificial Sequence: Synthetic polypeptide
  VL of XENP018779
SIVMTQSPATLSVSPGERATLSCRASQSVSYDVAWYQQKPGQSPRLLINYASHRYTGVPDRFTGSGYGTEFTLTISSLQSEDFAVYFCQQDYSSPRTFGGGTKVEIK

SEQ ID NO: 13504 - protein, 5 aa, Artificial Sequence
  Description of Artificial Sequence: Synthetic peptide
  XENP018779 vhCDR1
NYWMN

SEQ ID NO: 13505 - protein, 19 aa, Artificial Sequence
  Description of Artificial Sequence: Synthetic peptide
  XENP018779 vhCDR2
EIRLKSNNYATHYAEPVKG

SEQ ID NO: 13506 - protein, 11 aa, Artificial Sequence
  Description of Artificial Sequence: Synthetic peptide
  XENP018779 vhCDR3
YYGNYGGYFDV

SEQ ID NO: 13507 - protein, 11 aa, Artificial Sequence
  Description of Artificial Sequence: Synthetic peptide
  XENP018779 vlCDR1
RASQSVSYDVA

SEQ ID NO: 13508 - protein, 7 aa, Artificial Sequence
  Description of Artificial Sequence: Synthetic peptide
  XENP018779 vlCDR2
YASHRYT

SEQ ID NO: 13509 - protein, 9 aa, Artificial Sequence
  Description of Artificial Sequence: Synthetic peptide
  XENP018779 vlCDR3
QQDYSSPRT

SEQ ID NO: 13510 - protein, 249 aa, Artificial Sequence
  Description of Artificial Sequence: Synthetic polypeptide
  XENP018780 1G6_H1_L1.38_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNNVAWYQQKPGQSPRLLINYASHRYTGVPDRFTGSGYGTEFTLTISSLQSEDFAVYFCQQDYSSPRTFGGGTKVEIK

SEQ ID NO: 13511 - protein, 122 aa, Artificial Sequence; identical to SEQ ID NO: 10922
  Description of Artificial Sequence: Synthetic polypeptide
  VH of XENP018780

SEQ ID NO: 13512 - protein, 107 aa, Artificial Sequence
  Description of Artificial Sequence: Synthetic polypeptide
  VL of XENP018780
SIVMTQSPATLSVSPGERATLSCRASQSVSNNVAWYQQKPGQSPRLLINYASHRYTGVPDRFTGSGYGTEFTLTISSLQSEDFAVYFCQQDYSSPRTFGGGTKVEIK

SEQ ID NO: 13513 - protein, 5 aa, Artificial Sequence
  Description of Artificial Sequence: Synthetic peptide
  XENP018780 vhCDR1
NYWMN

SEQ ID NO: 13514 - protein, 19 aa, Artificial Sequence
  Description of Artificial Sequence: Synthetic peptide
  XENP018780 vhCDR2
EIRLKSNNYATHYAEPVKG

SEQ ID NO: 13515 - protein, 11 aa, Artificial Sequence
  Description of Artificial Sequence: Synthetic peptide
  XENP018780 vhCDR3
YYGNYGGYFDV

SEQ ID NO: 13516 - protein, 11 aa, Artificial Sequence
  Description of Artificial Sequence: Synthetic peptide
  XENP018780 vlCDR1
RASQSVSNNVA

SEQ ID NO: 13517 - protein, 7 aa, Artificial Sequence
  Description of Artificial Sequence: Synthetic peptide
  XENP018780 vlCDR2
YASHRYT

SEQ ID NO: 13518 - protein, 9 aa, Artificial Sequence
  Description of Artificial Sequence: Synthetic peptide
  XENP018780 vlCDR3
QQDYSSPRT

SEQ ID NO: 13519 - protein, 249 aa, Artificial Sequence
  Description of Artificial Sequence: Synthetic polypeptide
  XENP018781 1G6_H1_L1.39_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNEVAWYQQKPGQSPRLLINYASHRYTGVPDRFTGSGYGTEFTLTISSLQSEDFAVYFCQQDYSSPRTFGGGTKVEIK

SEQ ID NO: 13520 - protein, 122 aa, Artificial Sequence; identical to SEQ ID NO: 10922
  Description of Artificial Sequence: Synthetic polypeptide
  VH of XENP018781

SEQ ID NO: 13521 - protein, 107 aa, Artificial Sequence
  Description of Artificial Sequence: Synthetic polypeptide
  VL of XENP018781
SIVMTQSPATLSVSPGERATLSCRASQSVSNEVAWYQQKPGQSPRLLINYASHRYTGVPDRFTGSGYGTEFTLTISSLQSEDFAVYFCQQDYSSPRTFGGGTKVEIK

SEQ ID NO: 13522 - protein, 5 aa, Artificial Sequence
  Description of Artificial Sequence: Synthetic peptide
  XENP018781 vhCDR1
NYWMN

SEQ ID NO: 13523 - protein, 19 aa, Artificial Sequence
  Description of Artificial Sequence: Synthetic peptide
  XENP018781 vhCDR2
EIRLKSNNYATHYAEPVKG

SEQ ID NO: 13524 - protein, 11 aa, Artificial Sequence
  Description of Artificial Sequence: Synthetic peptide
  XENP018781 vhCDR3
YYGNYGGYFDV

SEQ ID NO: 13525 - protein, 11 aa, Artificial Sequence
  Description of Artificial Sequence: Synthetic peptide
  XENP018781 vlCDR1
RASQSVSNEVA

SEQ ID NO: 13526 - protein, 7 aa, Artificial Sequence
  Description of Artificial Sequence: Synthetic peptide
  XENP018781 vlCDR2
YASHRYT

SEQ ID NO: 13527 - protein, 9 aa, Artificial Sequence
  Description of Artificial Sequence: Synthetic peptide
  XENP018781 vlCDR3
QQDYSSPRT

SEQ ID NO: 13528 - protein, 249 aa, Artificial Sequence
  Description of Artificial Sequence: Synthetic polypeptide
  XENP018782 1G6_H1_L1.40_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNHVAWYQQKPGQSPRLLINYASHRYTGVPDRFTGSGYGTEFTLTISSLQSEDFAVYFCQQDYSSPRTFGGGTKVEIK

SEQ ID NO: 13529 - protein, 122 aa, Artificial Sequence; identical to SEQ ID NO: 10922
  Description of Artificial Sequence: Synthetic polypeptide
  VH of XENP018782

SEQ ID NO: 13530 - protein, 107 aa, Artificial Sequence
  Description of Artificial Sequence: Synthetic polypeptide
  VL of XENP018782
SIVMTQSPATLSVSPGERATLSCRASQSVSNHVAWYQQKPGQSPRLLINYASHRYTGVPDRFTGSGYGTEFTLTISSLQSEDFAVYFCQQDYSSPRTFGGGTKVEIK

SEQ ID NO: 13531 - protein, 5 aa, Artificial Sequence
  Description of Artificial Sequence: Synthetic peptide
  XENP018782 vhCDR1
NYWMN

SEQ ID NO: 13532 - protein, 19 aa, Artificial Sequence
  Description of Artificial Sequence: Synthetic peptide
  XENP018782 vhCDR2
EIRLKSNNYATHYAEPVKG

SEQ ID NO: 13533 - protein, 11 aa, Artificial Sequence
  Description of Artificial Sequence: Synthetic peptide
  XENP018782 vhCDR3
YYGNYGGYFDV

SEQ ID NO: 13534 - protein, 11 aa, Artificial Sequence
  Description of Artificial Sequence: Synthetic peptide
  XENP018782 vlCDR1
RASQSVSNHVA

SEQ ID NO: 13535 - protein, 7 aa, Artificial Sequence
  Description of Artificial Sequence: Synthetic peptide
  XENP018782 vlCDR2
YASHRYT

SEQ ID NO: 13536 - protein, 9 aa, Artificial Sequence
  Description of Artificial Sequence: Synthetic peptide
  XENP018782 vlCDR3
QQDYSSPRT

SEQ ID NO: 13537 - protein, 249 aa, Artificial Sequence
  Description of Artificial Sequence: Synthetic polypeptide
  XENP018783 1G6_H1_L1.41_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNSVAWYQQKPGQSPRLLINYASHRYTGVPDRFTGSGYGTEFTLTISSLQSEDFAVYFCQQDYSSPRTFGGGTKVEIK

SEQ ID NO: 13538 - protein, 122 aa, Artificial Sequence; identical to SEQ ID NO: 10922
  Description of Artificial Sequence: Synthetic polypeptide
  VH of XENP018783

SEQ ID NO: 13539 - protein, 107 aa, Artificial Sequence
  Description of Artificial Sequence: Synthetic polypeptide
  VL of XENP018783
SIVMTQSPATLSVSPGERATLSCRASQSVSNSVAWYQQKPGQSPRLLINYASHRYTGVPDRFTGSGYGTEFTLTISSLQSEDFAVYFCQQDYSSPRTFGGGTKVEIK

SEQ ID NO: 13540 - protein, 5 aa, Artificial Sequence
  Description of Artificial Sequence: Synthetic peptide
  XENP018783 vhCDR1
NYWMN

SEQ ID NO: 13541 - protein, 19 aa, Artificial Sequence
  Description of Artificial Sequence: Synthetic peptide
  XENP018783 vhCDR2
EIRLKSNNYATHYAEPVKG

SEQ ID NO: 13542 - protein, 11 aa, Artificial Sequence
  Description of Artificial Sequence: Synthetic peptide
  XENP018783 vhCDR3
YYGNYGGYFDV

SEQ ID NO: 13543 - protein, 11 aa, Artificial Sequence
  Description of Artificial Sequence: Synthetic peptide
  XENP018783 vlCDR1
RASQSVSNSVA

SEQ ID NO: 13544 - protein, 7 aa, Artificial Sequence
  Description of Artificial Sequence: Synthetic peptide
  XENP018783 vlCDR2
YASHRYT

SEQ ID NO: 13545 - protein, 9 aa, Artificial Sequence
  Description of Artificial Sequence: Synthetic peptide
  XENP018783 vlCDR3
QQDYSSPRT

SEQ ID NO: 13546 - protein, 249 aa, Artificial Sequence
  Description of Artificial Sequence: Synthetic polypeptide
  XENP018784 1G6_H1_L1.42_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNRVAWYQQKPGQSPRLLINYASHRYTGVPDRFTGSGYGTEFTLTISSLQSEDFAVYFCQQDYSSPRTFGGGTKVEIK

SEQ ID NO: 13547 - protein, 122 aa, Artificial Sequence; identical to SEQ ID NO: 10922
  Description of Artificial Sequence: Synthetic polypeptide
  VH of XENP018784

SEQ ID NO: 13548 - protein, 107 aa, Artificial Sequence
  Description of Artificial Sequence: Synthetic polypeptide
  VL of XENP018784
SIVMTQSPATLSVSPGERATLSCRASQSVSNRVAWYQQKPGQSPRLLINYASHRYTGVPDRFTGSGYGTEFTLTISSLQSEDFAVYFCQQDYSSPRTFGGGTKVEIK

SEQ ID NO: 13549 - protein, 5 aa, Artificial Sequence
  Description of Artificial Sequence: Synthetic peptide
  XENP018784 vhCDR1
NYWMN

SEQ ID NO: 13550 - protein, 19 aa, Artificial Sequence
  Description of Artificial Sequence: Synthetic peptide
  XENP018784 vhCDR2
EIRLKSNNYATHYAEPVKG

SEQ ID NO: 13551 - protein, 11 aa, Artificial Sequence
  Description of Artificial Sequence: Synthetic peptide
  XENP018784 vhCDR3
YYGNYGGYFDV

SEQ ID NO: 13552 - protein, 11 aa, Artificial Sequence
  Description of Artificial Sequence: Synthetic peptide
  XENP018784 vlCDR1
RASQSVSNRVA

SEQ ID NO: 13553 - protein, 7 aa, Artificial Sequence
  Description of Artificial Sequence: Synthetic peptide
  XENP018784 vlCDR2
YASHRYT

SEQ ID NO: 13554 - protein, 9 aa, Artificial Sequence
  Description of Artificial Sequence: Synthetic peptide
  XENP018784 vlCDR3
QQDYSSPRT

SEQ ID NO: 13555 - protein, 249 aa, Artificial Sequence
  Description of Artificial Sequence: Synthetic polypeptide
  XENP018785 1G6_H1_L1.43_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNLVAWYQQKPGQSPRLLINYASHRYTGVPDRFTGSGYGTEFTLTISSLQSEDFAVYFCQQDYSSPRTFGGGTKVEIK

SEQ ID NO: 13556 - protein, 122 aa, Artificial Sequence; identical to SEQ ID NO: 10922
  Description of Artificial Sequence: Synthetic polypeptide
  VH of XENP018785

SEQ ID NO: 13557 - protein, 107 aa, Artificial Sequence
  Description of Artificial Sequence: Synthetic polypeptide
  VL of XENP018785
SIVMTQSPATLSVSPGERATLSCRASQSVSNLVAWYQQKPGQSPRLLINYASHRYTGVPDRFTGSGYGTEFTLTISSLQSEDFAVYFCQQDYSSPRTFGGGTKVEIK

SEQ ID NO: 13558 - protein, 5 aa, Artificial Sequence
  Description of Artificial Sequence: Synthetic peptide
  XENP018785 vhCDR1
NYWMN

SEQ ID NO: 13559 - protein, 19 aa, Artificial Sequence
  Description of Artificial Sequence: Synthetic peptide
  XENP018785 vhCDR2
EIRLKSNNYATHYAEPVKG

SEQ ID NO: 13560 - protein, 11 aa, Artificial Sequence
  Description of Artificial Sequence: Synthetic peptide
  XENP018785 vhCDR3
YYGNYGGYFDV

SEQ ID NO: 13561 - protein, 11 aa, Artificial Sequence
  Description of Artificial Sequence: Synthetic peptide
  XENP018785 vlCDR1
RASQSVSNLVA

SEQ ID NO: 13562 - protein, 7 aa, Artificial Sequence
  Description of Artificial Sequence: Synthetic peptide
  XENP018785 vlCDR2
YASHRYT

SEQ ID NO: 13563 - protein, 9 aa, Artificial Sequence
  Description of Artificial Sequence: Synthetic peptide
  XENP018785 vlCDR3
QQDYSSPRT

SEQ ID NO: 13564 - protein, 249 aa, Artificial Sequence
  Description of Artificial Sequence: Synthetic polypeptide
  XENP018786 1G6_H1_L1.44_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNTVAWYQQKPGQSPRLLINYASHRYTGVPDRFTGSGYGTEFTLTISSLQSEDFAVYFCQQDYSSPRTFGGGTKVEIK

SEQ ID NO: 13565 - protein, 122 aa, Artificial Sequence; identical to SEQ ID NO: 10922
  Description of Artificial Sequence: Synthetic polypeptide
  VH of XENP018786

SEQ ID NO: 13566 - protein, 107 aa, Artificial Sequence
  Description of Artificial Sequence: Synthetic polypeptide
  VL of XENP018786
SIVMTQSPATLSVSPGERATLSCRASQSVSNTVAWYQQKPGQSPRLLINYASHRYTGVPDRFTGSGYGTEFTLTISSLQSEDFAVYFCQQDYSSPRTFGGGTKVEIK

SEQ ID NO: 13567 - protein, 5 aa, Artificial Sequence
  Description of Artificial Sequence: Synthetic peptide
  XENP018786 vhCDR1
NYWMN

SEQ ID NO: 13568 - protein, 19 aa, Artificial Sequence
  Description of Artificial Sequence: Synthetic peptide
  XENP018786 vhCDR2
EIRLKSNNYATHYAEPVKG

SEQ ID NO: 13569 - protein, 11 aa, Artificial Sequence
  Description of Artificial Sequence: Synthetic peptide
  XENP018786 vhCDR3
YYGNYGGYFDV

SEQ ID NO: 13570 - protein, 11 aa, Artificial Sequence
  Description of Artificial Sequence: Synthetic peptide
  XENP018786 vlCDR1
RASQSVSNTVA

SEQ ID NO: 13571 - protein, 7 aa, Artificial Sequence
  Description of Artificial Sequence: Synthetic peptide
  XENP018786 vlCDR2
YASHRYT

SEQ ID NO: 13572 - protein, 9 aa, Artificial Sequence
  Description of Artificial Sequence: Synthetic peptide
  XENP018786 vlCDR3
QQDYSSPRT

SEQ ID NO: 13573 - protein, 249 aa, Artificial Sequence
  Description of Artificial Sequence: Synthetic polypeptide
  XENP018787 1G6_H1_L1.45_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNGVAWYQQKPGQSPRLLINYASHRYTGVPDRFTGSGYGTEFTLTISSLQSEDFAVYFCQQDYSSPRTFGGGTKVEIK

SEQ ID NO: 13574 - protein, 122 aa, Artificial Sequence; identical to SEQ ID NO: 10922
  Description of Artificial Sequence: Synthetic polypeptide
  VH of XENP018787

SEQ ID NO: 13575 - protein, 107 aa, Artificial Sequence
  Description of Artificial Sequence: Synthetic polypeptide
  VL of XENP018787
SIVMTQSPATLSVSPGERATLSCRASQSVSNGVAWYQQKPGQSPRLLINYASHRYTGVPDRFTGSGYGTEFTLTISSLQSEDFAVYFCQQDYSSPRTFGGGTKVEIK

SEQ ID NO: 13576 - protein, 5 aa, Artificial Sequence
  Description of Artificial Sequence: Synthetic peptide
  XENP018787 vhCDR1
NYWMN

SEQ ID NO: 13577 - protein, 19 aa, Artificial Sequence
  Description of Artificial Sequence: Synthetic peptide
  XENP018787 vhCDR2
EIRLKSNNYATHYAEPVKG

SEQ ID NO: 13578 - protein, 11 aa, Artificial Sequence
  Description of Artificial Sequence: Synthetic peptide
  XENP018787 vhCDR3
YYGNYGGYFDV

SEQ ID NO: 13579 - protein, 11 aa, Artificial Sequence
  Description of Artificial Sequence: Synthetic peptide
  XENP018787 vlCDR1
RASQSVSNGVA

SEQ ID NO: 13580 - protein, 7 aa, Artificial Sequence
  Description of Artificial Sequence: Synthetic peptide
  XENP018787 vlCDR2
YASHRYT

SEQ ID NO: 13581 - protein, 9 aa, Artificial Sequence
  Description of Artificial Sequence: Synthetic peptide
  XENP018787 vlCDR3
QQDYSSPRT

SEQ ID NO: 13582 - protein, 249 aa, Artificial Sequence
  Description of Artificial Sequence: Synthetic polypeptide
  XENP018788 1G6_H1_L1.46_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNYVAWYQQKPGQSPRLLINYASHRYTGVPDRFTGSGYGTEFTLTISSLQSEDFAVYFCQQDYSSPRTFGGGTKVEIK

SEQ ID NO: 13583 - protein, 122 aa, Artificial Sequence; identical to SEQ ID NO: 10922
  Description of Artificial Sequence: Synthetic polypeptide
  VH of XENP018788

SEQ ID NO: 13584 - protein, 107 aa, Artificial Sequence
  Description of Artificial Sequence: Synthetic polypeptide
  VL of XENP018788
SIVMTQSPATLSVSPGERATLSCRASQSVSNYVAWYQQKPGQSPRLLINYASHRYTGVPDRFTGSGYGTEFTLTISSLQSEDFAVYFCQQDYSSPRTFGGGTKVEIK

SEQ ID NO: 13585 - protein, 5 aa, Artificial Sequence
  Description of Artificial Sequence: Synthetic peptide
  XENP018788 vhCDR1
NYWMN

SEQ ID NO: 13586 - protein, 19 aa, Artificial Sequence
  Description of Artificial Sequence: Synthetic peptide
  XENP018788 vhCDR2
EIRLKSNNYATHYAEPVKG

SEQ ID NO: 13587 - protein, 11 aa, Artificial Sequence
  Description of Artificial Sequence: Synthetic peptide
  XENP018788 vhCDR3
YYGNYGGYFDV

SEQ ID NO: 13588 - protein, 11 aa, Artificial Sequence
  Description of Artificial Sequence: Synthetic peptide
  XENP018788 vlCDR1
RASQSVSNYVA

SEQ ID NO: 13589 - protein, 7 aa, Artificial Sequence
  Description of Artificial Sequence: Synthetic peptide
  XENP018788 vlCDR2
YASHRYT

SEQ ID NO: 13590 - protein, 9 aa, Artificial Sequence
  Description of Artificial Sequence: Synthetic peptide
  XENP018788 vlCDR3
QQDYSSPRT

SEQ ID NO: 13591 - protein, 249 aa, Artificial Sequence
  Description of Artificial Sequence: Synthetic polypeptide
  XENP018789 1G6_H1_L1.47_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDLAWYQQKPGQSPRLLINYASHRYTGVPDRFTGSGYGTEFTLTISSLQSEDFAVYFCQQDYSSPRTFGGGTKVEIK

SEQ ID NO: 13592 - protein, 122 aa, Artificial Sequence; identical to SEQ ID NO: 10922
  Description of Artificial Sequence: Synthetic polypeptide
  VH of XENP018789

SEQ ID NO: 13593 - protein, 107 aa, Artificial Sequence
  Description of Artificial Sequence: Synthetic polypeptide
  VL of XENP018789
SIVMTQSPATLSVSPGERATLSCRASQSVSNDLAWYQQKPGQSPRLLINYASHRYTGVPDRFTGSGYGTEFTLTISSLQSEDFAVYFCQQDYSSPRTFGGGTKVEIK

SEQ ID NO: 13594 - protein, 5 aa, Artificial Sequence
  Description of Artificial Sequence: Synthetic peptide
  XENP018789 vhCDR1
NYWMN

SEQ ID NO: 13595 - protein, 19 aa, Artificial Sequence
  Description of Artificial Sequence: Synthetic peptide
  XENP018789 vhCDR2
EIRLKSNNYATHYAEPVKG

SEQ ID NO: 13596 - protein, 11 aa, Artificial Sequence
  Description of Artificial Sequence: Synthetic peptide
  XENP018789 vhCDR3
YYGNYGGYFDV

SEQ ID NO: 13597 - protein, 11 aa, Artificial Sequence
  Description of Artificial Sequence: Synthetic peptide
  XENP018789 vlCDR1
RASQSVSNDLA

SEQ ID NO: 13598 - protein, 7 aa, Artificial Sequence
  Description of Artificial Sequence: Synthetic peptide
  XENP018789 vlCDR2
YASHRYT

SEQ ID NO: 13599 - protein, 9 aa, Artificial Sequence
  Description of Artificial Sequence: Synthetic peptide
  XENP018789 vlCDR3
QQDYSSPRT

SEQ ID NO: 13600 - protein, 249 aa, Artificial Sequence
  Description of Artificial Sequence: Synthetic polypeptide
  XENP018790 1G6_H1_L1.48_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVSWYQQKPGQSPRLLINYASHRYTGVPDRFTGSGYGTEFTLTISSLQSEDFAVYFCQQDYSSPRTFGGGTKVEIK

SEQ ID NO: 13601 - protein, 122 aa, Artificial Sequence; identical to SEQ ID NO: 10922
  Description of Artificial Sequence: Synthetic polypeptide
  VH of XENP018790

SEQ ID NO: 13602 - protein, 107 aa, Artificial Sequence
  Description of Artificial Sequence: Synthetic polypeptide
  VL of XENP018790
SIVMTQSPATLSVSPGERATLSCRASQSVSNDVSWYQQKPGQSPRLLINYASHRYTGVPDRFTGSGYGTEFTLTISSLQSEDFAVYFCQQDYSSPRTFGGGTKVEIK

SEQ ID NO: 13603 - protein, 5 aa, Artificial Sequence
  Description of Artificial Sequence: Synthetic peptide
  XENP018790 vhCDR1
NYWMN

SEQ ID NO: 13604 - protein, 19 aa, Artificial Sequence
  Description of Artificial Sequence: Synthetic peptide
  XENP018790 vhCDR2
EIRLKSNNYATHYAEPVKG

SEQ ID NO: 13605 - protein, 11 aa, Artificial Sequence
  Description of Artificial Sequence: Synthetic peptide
  XENP018790 vhCDR3
YYGNYGGYFDV

SEQ ID NO: 13606 - protein, 11 aa, Artificial Sequence
  Description of Artificial Sequence: Synthetic peptide
  XENP018790 vlCDR1
RASQSVSNDVS

SEQ ID NO: 13607 - protein, 7 aa, Artificial Sequence
  Description of Artificial Sequence: Synthetic peptide
  XENP018790 vlCDR2
YASHRYT

SEQ ID NO: 13608 - protein, 9 aa, Artificial Sequence
  Description of Artificial Sequence: Synthetic peptide
  XENP018790 vlCDR3
QQDYSSPRT

SEQ ID NO: 13609 - protein, 249 aa, Artificial Sequence
  Description of Artificial Sequence: Synthetic polypeptide
  XENP018791 1G6_H1_L1.49_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVTWYQQKPGQSPRLLINYASHRYTGVPDRFTGSGYGTEFTLTISSLQSEDFAVYFCQQDYSSPRTFGGGTKVEIK

SEQ ID NO: 13610 - protein, 122 aa, Artificial Sequence; identical to SEQ ID NO: 10922
  Description of Artificial Sequence: Synthetic polypeptide
  VH of XENP018791

SEQ ID NO: 13611 - protein, 107 aa, Artificial Sequence
  Description of Artificial Sequence: Synthetic polypeptide
  VL of XENP018791
SIVMTQSPATLSVSPGERATLSCRASQSVSNDVTWYQQKPGQSPRLLINYASHRYTGVPDRFTGSGYGTEFTLTISSLQSEDFAVYFCQQDYSSPRTFGGGTKVEIK

SEQ ID NO: 13612 - protein, 5 aa, Artificial Sequence
  Description of Artificial Sequence: Synthetic peptide
  XENP018791 vhCDR1
NYWMN

SEQ ID NO: 13613 - protein, 19 aa, Artificial Sequence
  Description of Artificial Sequence: Synthetic peptide
  XENP018791 vhCDR2
EIRLKSNNYATHYAEPVKG

SEQ ID NO: 13614 - protein, 11 aa, Artificial Sequence
  Description of Artificial Sequence: Synthetic peptide
  XENP018791 vhCDR3
YYGNYGGYFDV

SEQ ID NO: 13615 - protein, 11 aa, Artificial Sequence
  Description of Artificial Sequence: Synthetic peptide
  XENP018791 vlCDR1
RASQSVSNDVT

SEQ ID NO: 13616 - protein, 7 aa, Artificial Sequence
  Description of Artificial Sequence: Synthetic peptide
  XENP018791 vlCDR2
YASHRYT

SEQ ID NO: 13617 - protein, 9 aa, Artificial Sequence
  Description of Artificial Sequence: Synthetic peptide
  XENP018791 vlCDR3
QQDYSSPRT

SEQ ID NO: 13618 - protein, 249 aa, Artificial Sequence
  Description of Artificial Sequence: Synthetic polypeptide
  XENP018792 1G6_H1_L1.50_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQAPRLLINYASHRYTGVPDRFTGSGYGTEFTLTISSLQSEDFAVYFCQQDYSSPRTFGGGTKVEIK

SEQ ID NO: 13619 - protein, 122 aa, Artificial Sequence; identical to SEQ ID NO: 10922
  Description of Artificial Sequence: Synthetic polypeptide
  VH of XENP018792

SEQ ID NO: 13620 - protein, 107 aa, Artificial Sequence
  Description of Artificial Sequence: Synthetic polypeptide
  VL of XENP018792
SIVMTQSPATLSVSPGERATLSCRASQSVSNDVAWYQQKPGQAPRLLINYASHRYTGVPDRFTGSGYGTEFTLTISSLQSEDFAVYFCQQDYSSPRTFGGGTKVEIK

SEQ ID NO: 13621 - protein, 5 aa, Artificial Sequence
  Description of Artificial Sequence: Synthetic peptide
  XENP018792 vhCDR1
NYWMN

SEQ ID NO: 13622 - protein, 19 aa, Artificial Sequence
  Description of Artificial Sequence: Synthetic peptide
  XENP018792 vhCDR2
EIRLKSNNYATHYAEPVKG

SEQ ID NO: 13623 - protein, 11 aa, Artificial Sequence
  Description of Artificial Sequence: Synthetic peptide
  XENP018792 vhCDR3
YYGNYGGYFDV

SEQ ID NO: 13624 - protein, 11 aa, Artificial Sequence
  Description of Artificial Sequence: Synthetic peptide
  XENP018792 vlCDR1
RASQSVSNDVA

SEQ ID NO: 13625 - protein, 7 aa, Artificial Sequence
  Description of Artificial Sequence: Synthetic peptide
  XENP018792 vlCDR2
YASHRYT

SEQ ID NO: 13626 - protein, 9 aa, Artificial Sequence
  Description of Artificial Sequence: Synthetic peptide
  XENP018792 vlCDR3
QQDYSSPRT

SEQ ID NO: 13627 - protein, 249 aa, Artificial Sequence
  Description of Artificial Sequence: Synthetic polypeptide
  XENP018793 1G6_H1_L1.51_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPKLLINYASHRYTGVPDRFTGSGYGTEFTLTISSLQSEDFAVYFCQQDYSSPRTFGGGTKVEIK

SEQ ID NO: 13628 - protein, 122 aa, Artificial Sequence; identical to SEQ ID NO: 10922
  Description of Artificial Sequence: Synthetic polypeptide
  VH of XENP018793

SEQ ID NO: 13629 - protein, 107 aa, Artificial Sequence
  Description of Artificial Sequence: Synthetic polypeptide
  VL of XENP018793
SIVMTQSPATLSVSPGERATLSCRASQSVSNDVAWYQQKPGQSPKLLINYASHRYTGVPDRFTGSGYGTEFTLTISSLQSEDFAVYFCQQDYSSPRTFGGGTKVEIK

SEQ ID NO: 13630 - protein, 5 aa, Artificial Sequence
  Description of Artificial Sequence: Synthetic peptide
  XENP018793 vhCDR1
NYWMN

SEQ ID NO: 13631 - protein, 19 aa, Artificial Sequence
  Description of Artificial Sequence: Synthetic peptide
  XENP018793 vhCDR2
EIRLKSNNYATHYAEPVKG

SEQ ID NO: 13632 - protein, 11 aa, Artificial Sequence
  Description of Artificial Sequence: Synthetic peptide
  XENP018793 vhCDR3
YYGNYGGYFDV

SEQ ID NO: 13633 - protein, 11 aa, Artificial Sequence
  Description of Artificial Sequence: Synthetic peptide
  XENP018793 vlCDR1
RASQSVSNDVA

SEQ ID NO: 13634 - protein, 7 aa, Artificial Sequence
  Description of Artificial Sequence: Synthetic peptide
  XENP018793 vlCDR2
YASHRYT

SEQ ID NO: 13635 - protein, 9 aa, Artificial Sequence
  Description of Artificial Sequence: Synthetic peptide
  XENP018793 vlCDR3
QQDYSSPRT

SEQ ID NO: 13636 - protein, 249 aa, Artificial Sequence
  Description of Artificial Sequence: Synthetic polypeptide
  XENP018794 1G6_H1_L1.52_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPQLLINYASHRYTGVPDRFTGSGYGTEFTLTISSLQSEDFAVYFCQQDYSSPRTFGGGTKVEIK

SEQ ID NO: 13637 - protein, 122 aa, Artificial Sequence; identical to SEQ ID NO: 10922
  Description of Artificial Sequence: Synthetic polypeptide
  VH of XENP018794

SEQ ID NO: 13638 - protein, 107 aa, Artificial Sequence
  Description of Artificial Sequence: Synthetic polypeptide
  VL of XENP018794
SIVMTQSPATLSVSPGERATLSCRASQSVSNDVAWYQQKPGQSPQLLINYASHRYTGVPDRFTGSGYGTEFTLTISSLQSEDFAVYFCQQDYSSPRTFGGGTKVEIK

SEQ ID NO: 13639 - protein, 5 aa, Artificial Sequence
  Description of Artificial Sequence: Synthetic peptide
  XENP018794 vhCDR1
NYWMN

SEQ ID NO: 13640 - protein, 19 aa, Artificial Sequence
  Description of Artificial Sequence: Synthetic peptide
  XENP018794 vhCDR2
EIRLKSNNYATHYAEPVKG

SEQ ID NO: 13641 - protein, 11 aa, Artificial Sequence
  Description of Artificial Sequence: Synthetic peptide
  XENP018794 vhCDR3
YYGNYGGYFDV

SEQ ID NO: 13642 - protein, 11 aa, Artificial Sequence
  Description of Artificial Sequence: Synthetic peptide
  XENP018794 vlCDR1
RASQSVSNDVA

SEQ ID NO: 13643 - protein, 7 aa, Artificial Sequence
  Description of Artificial Sequence: Synthetic peptide
  XENP018794 vlCDR2
YASHRYT

SEQ ID NO: 13644 - protein, 9 aa, Artificial Sequence
  Description of Artificial Sequence: Synthetic peptide
  XENP018794 vlCDR3
QQDYSSPRT

SEQ ID NO: 13645 - protein, 249 aa, Artificial Sequence
  Description of Artificial Sequence: Synthetic polypeptide
  XENP018795 1G6_H1_L1.53_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPILLINYASHRYTGVPDRFTGSGYGTEFTLTISSLQSEDFAVYFCQQDYSSPRTFGGGTKVEIK

SEQ ID NO: 13646 - protein, 122 aa, Artificial Sequence; identical to SEQ ID NO: 10922
  Description of Artificial Sequence: Synthetic polypeptide
  VH of XENP018795

SEQ ID NO: 13647 - protein, 107 aa, Artificial Sequence
  Description of Artificial Sequence: Synthetic polypeptide
  VL of XENP018795
SIVMTQSPATLSVSPGERATLSCRASQSVSNDVAWYQQKPGQSPILLINYASHRYTGVPDRFTGSGYGTEFTLTISSLQSEDFAVYFCQQDYSSPRTFGGGTKVEIK

SEQ ID NO: 13648 - protein, 5 aa, Artificial Sequence
  Description of Artificial Sequence: Synthetic peptide
  XENP018795 vhCDR1
NYWMN

SEQ ID NO: 13649 - protein, 19 aa, Artificial Sequence
  Description of Artificial Sequence: Synthetic peptide
  XENP018795 vhCDR2
EIRLKSNNYATHYAEPVKG

SEQ ID NO: 13650 - protein, 11 aa, Artificial Sequence
  Description of Artificial Sequence: Synthetic peptide
  XENP018795 vhCDR3
YYGNYGGYFDV

SEQ ID NO: 13651 - protein, 11 aa, Artificial Sequence
  Description of Artificial Sequence: Synthetic peptide
  XENP018795 vlCDR1
RASQSVSNDVA

SEQ ID NO: 13652 - protein, 7 aa, Artificial Sequence
  Description of Artificial Sequence: Synthetic peptide
  XENP018795 vlCDR2
YASHRYT

SEQ ID NO: 13653 - protein, 9 aa, Artificial Sequence
  Description of Artificial Sequence: Synthetic peptide
  XENP018795 vlCDR3
QQDYSSPRT

SEQ ID NO: 13654 - protein, 249 aa, Artificial Sequence
  Description of Artificial Sequence: Synthetic polypeptide
  XENP018796 1G6_H1_L1.54_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLIYYASHRYTGVPDRFTGSGYGTEFTLTISSLQSEDFAVYFCQQDYSSPRTFGGGTKVEIK

SEQ ID NO: 13655 - protein, 122 aa, Artificial Sequence; identical to SEQ ID NO: 10922
  Description of Artificial Sequence: Synthetic polypeptide
  VH of XENP018796

SEQ ID NO: 13656 - protein, 107 aa, Artificial Sequence
  Description of Artificial Sequence: Synthetic polypeptide
  VL of XENP018796
SIVMTQSPATLSVSPGERATLSCRASQSVSNDVAWYQQKPGQSPRLLIYYASHRYTGVPDRFTGSGYGTEFTLTISSLQSEDFAVYFCQQDYSSPRTFGGGTKVEIK

SEQ ID NO: 13657 - protein, 5 aa, Artificial Sequence
  Description of Artificial Sequence: Synthetic peptide
  XENP018796 vhCDR1
NYWMN

SEQ ID NO: 13658 - protein, 19 aa, Artificial Sequence
  Description of Artificial Sequence: Synthetic peptide
  XENP018796 vhCDR2
EIRLKSNNYATHYAEPVKG

SEQ ID NO: 13659 - protein, 11 aa, Artificial Sequence
  Description of Artificial Sequence: Synthetic peptide
  XENP018796 vhCDR3
YYGNYGGYFDV

SEQ ID NO: 13660 - protein, 11 aa, Artificial Sequence
  Description of Artificial Sequence: Synthetic peptide
  XENP018796 vlCDR1
RASQSVSNDVA

SEQ ID NO: 13661 - protein, 7 aa, Artificial Sequence
  Description of Artificial Sequence: Synthetic peptide
  XENP018796 vlCDR2
YASHRYT

SEQ ID NO: 13662 - protein, 9 aa, Artificial Sequence
  Description of Artificial Sequence: Synthetic peptide
  XENP018796 vlCDR3
QQDYSSPRT

SEQ ID NO: 13663 - protein, 249 aa, Artificial Sequence
  Description of Artificial Sequence: Synthetic polypeptide
  XENP018801 1G6_H1_L1.55_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINFASHRYTGVPDRFTGSGYGTEFTLTISSLQSEDFAVYFCQQDYSSPRTFGGGTKVEIK

SEQ ID NO: 13664 - protein, 122 aa, Artificial Sequence; identical to SEQ ID NO: 10922
  Description of Artificial Sequence: Synthetic polypeptide
  VH of XENP018801

SEQ ID NO: 13665 - protein, 107 aa, Artificial Sequence
  Description of Artificial Sequence: Synthetic polypeptide
  VL of XENP018801
SIVMTQSPATLSVSPGERATLSCRASQSVSNDVAWYQQKPGQSPRLLINFASHRYTGVPDRFTGSGYGTEFTLTISSLQSEDFAVYFCQQDYSSPRTFGGGTKVEIK

SEQ ID NO: 13666 - protein, 5 aa, Artificial Sequence
  Description of Artificial Sequence: Synthetic peptide
  XENP018801 vhCDR1
NYWMN

SEQ ID NO: 13667 - protein, 19 aa, Artificial Sequence
  Description of Artificial Sequence: Synthetic peptide
  XENP018801 vhCDR2
EIRLKSNNYATHYAEPVKG

SEQ ID NO: 13668 - protein, 11 aa, Artificial Sequence
  Description of Artificial Sequence: Synthetic peptide
  XENP018801 vhCDR3
YYGNYGGYFDV

SEQ ID NO: 13669 - protein, 11 aa, Artificial Sequence
  Description of Artificial Sequence: Synthetic peptide
  XENP018801 vlCDR1
RASQSVSNDVA

SEQ ID NO: 13670 - protein, 7 aa, Artificial Sequence
  Description of Artificial Sequence: Synthetic peptide
  XENP018801 vlCDR2
FASHRYT

SEQ ID NO: 13671 - protein, 9 aa, Artificial Sequence
  Description of Artificial Sequence: Synthetic peptide
  XENP018801 vlCDR3
QQDYSSPRT

SEQ ID NO: 13672 - protein, 249 aa, Artificial Sequence
  Description of Artificial Sequence: Synthetic polypeptide
  XENP018802 1G6_H1_L1.56_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINHASHRYTGVPDRFTGSGYGTEFTLTISSLQSEDFAVYFCQQDYSSPRTFGGGTKVEIK

SEQ ID NO: 13673 - protein, 122 aa, Artificial Sequence; identical to SEQ ID NO: 10922
  Description of Artificial Sequence: Synthetic polypeptide
  VH of XENP018802

SEQ ID NO: 13674 - protein, 107 aa, Artificial Sequence
  Description of Artificial Sequence: Synthetic polypeptide
  VL of XENP018802
SIVMTQSPATLSVSPGERATLSCRASQSVSNDVAWYQQKPGQSPRLLINHASHRYTGVPDRFTGSGYGTEFTLTISSLQSEDFAVYFCQQDYSSPRTFGGGTKVEIK

SEQ ID NO: 13675 - protein, 5 aa, Artificial Sequence
  Description of Artificial Sequence: Synthetic peptide
  XENP018802 vhCDR1
NYWMN

SEQ ID NO: 13676 - protein, 19 aa, Artificial Sequence
  Description of Artificial Sequence: Synthetic peptide
  XENP018802 vhCDR2
EIRLKSNNYATHYAEPVKG

SEQ ID NO: 13677 - protein, 11 aa, Artificial Sequence
  Description of Artificial Sequence: Synthetic peptide
  XENP018802 vhCDR3
YYGNYGGYFDV

SEQ ID NO: 13678 - protein, 11 aa, Artificial Sequence
  Description of Artificial Sequence: Synthetic peptide
  XENP018802 vlCDR1
RASQSVSNDVA

SEQ ID NO: 13679 - protein, 7 aa, Artificial Sequence
  Description of Artificial Sequence: Synthetic peptide
  XENP018802 vlCDR2
HASHRYT

SEQ ID NO: 13680 - protein, 9 aa, Artificial Sequence
  Description of Artificial Sequence: Synthetic peptide
  XENP018802 vlCDR3
QQDYSSPRT

SEQ ID NO: 13681 - protein, 249 aa, Artificial Sequence
  Description of Artificial Sequence: Synthetic polypeptide
  XENP018803 1G6_H1_L1.57_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINLASHRYTGVPDRFTGSGYGTEFTLTISSLQSEDFAVYFCQQDYSSPRTFGGGTKVEIK

SEQ ID NO: 13682 - protein, 122 aa, Artificial Sequence; identical to SEQ ID NO: 10922
  Description of Artificial Sequence: Synthetic polypeptide
  VH of XENP018803

SEQ ID NO: 13683 - protein, 107 aa, Artificial Sequence
  Description of Artificial Sequence: Synthetic polypeptide
  VL of XENP018803
SIVMTQSPATLSVSPGERATLSCRASQSVSNDVAWYQQKPGQSPRLLINLASHRYTGVPDRFTGSGYGTEFTLTISSLQSEDFAVYFCQQDYSSPRTFGGGTKVEIK

SEQ ID NO: 13684 - protein, 5 aa, Artificial Sequence
  Description of Artificial Sequence: Synthetic peptide
  XENP018803 vhCDR1
NYWMN

SEQ ID NO: 13685 - protein, 19 aa, Artificial Sequence
  Description of Artificial Sequence: Synthetic peptide
  XENP018803 vhCDR2
EIRLKSNNYATHYAEPVKG

SEQ ID NO: 13686 - protein, 11 aa, Artificial Sequence
  Description of Artificial Sequence: Synthetic peptide
  XENP018803 vhCDR3
YYGNYGGYFDV

SEQ ID NO: 13687 - protein, 11 aa, Artificial Sequence
  Description of Artificial Sequence: Synthetic peptide
  XENP018803 vlCDR1
RASQSVSNDVA

SEQ ID NO: 13688 - protein, 7 aa, Artificial Sequence
  Description of Artificial Sequence: Synthetic peptide
  XENP018803 vlCDR2
LASHRYT

SEQ ID NO: 13689 - protein, 9 aa, Artificial Sequence
  Description of Artificial Sequence: Synthetic peptide
  XENP018803 vlCDR3
QQDYSSPRT

SEQ ID NO: 13690 - protein, 249 aa, Artificial Sequence
  Description of Artificial Sequence: Synthetic polypeptide
  XENP018804 1G6_H1_L1.58_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINWASHRYTGVPDRFTGSGYGTEFTLTISSLQSEDFAVYFCQQDYSSPRTFGGGTKVEIK

SEQ ID NO: 13691 - protein, 122 aa, Artificial Sequence; identical to SEQ ID NO: 10922
  Description of Artificial Sequence: Synthetic polypeptide
  VH of XENP018804

SEQ ID NO: 13692 - protein, 107 aa, Artificial Sequence
  Description of Artificial Sequence: Synthetic polypeptide
  VL of XENP018804
SIVMTQSPATLSVSPGERATLSCRASQSVSNDVAWYQQKPGQSPRLLINWASHRYTGVPDRFTGSGYGTEFTLTISSLQSEDFAVYFCQQDYSSPRTFGGGTKVEIK

SEQ ID NO: 13693 - protein, 5 aa, Artificial Sequence
  Description of Artificial Sequence: Synthetic peptide
  XENP018804 vhCDR1
NYWMN

SEQ ID NO: 13694 - protein, 19 aa, Artificial Sequence
  Description of Artificial Sequence: Synthetic peptide
  XENP018804 vhCDR2
EIRLKSNNYATHYAEPVKG

SEQ ID NO: 13695 - protein, 11 aa, Artificial Sequence
  Description of Artificial Sequence: Synthetic peptide
  XENP018804 vhCDR3
YYGNYGGYFDV

SEQ ID NO: 13696 - protein, 11 aa, Artificial Sequence
  Description of Artificial Sequence: Synthetic peptide
  XENP018804 vlCDR1
RASQSVSNDVA

SEQ ID NO: 13697 - protein, 7 aa, Artificial Sequence
  Description of Artificial Sequence: Synthetic peptide
  XENP018804 vlCDR2
WASHRYT

SEQ ID NO: 13698 - protein, 9 aa, Artificial Sequence
  Description of Artificial Sequence: Synthetic peptide
  XENP018804 vlCDR3
QQDYSSPRT

SEQ ID NO: 13699 - protein, 249 aa, Artificial Sequence
  Description of Artificial Sequence: Synthetic polypeptide
  XENP018805 1G6_H1_L1.59_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINVASHRYTGVPDRFTGSGYGTEFTLTISSLQSEDFAVYFCQQDYSSPRTFGGGTKVEIK

SEQ ID NO: 13700 - protein, 122 aa, Artificial Sequence; identical to SEQ ID NO: 10922
  Description of Artificial Sequence: Synthetic polypeptide
  VH of XENP018805

SEQ ID NO: 13701 - protein, 107 aa, Artificial Sequence
  Description of Artificial Sequence: Synthetic polypeptide
  VL of XENP018805
SIVMTQSPATLSVSPGERATLSCRASQSVSNDVAWYQQKPGQSPRLLINVASHRYTGVPDRFTGSGYGTEFTLTISSLQSEDFAVYFCQQDYSSPRTFGGGTKVEIK

SEQ ID NO: 13702 - protein, 5 aa, Artificial Sequence
  Description of Artificial Sequence: Synthetic peptide
  XENP018805 vhCDR1
NYWMN

SEQ ID NO: 13703 - protein, 19 aa, Artificial Sequence
  Description of Artificial Sequence: Synthetic peptide
  XENP018805 vhCDR2
EIRLKSNNYATHYAEPVKG

SEQ ID NO: 13704 - protein, 11 aa, Artificial Sequence
  Description of Artificial Sequence: Synthetic peptide
  XENP018805 vhCDR3
YYGNYGGYFDV

SEQ ID NO: 13705 - protein, 11 aa, Artificial Sequence
  Description of Artificial Sequence: Synthetic peptide
  XENP018805 vlCDR1
RASQSVSNDVA

SEQ ID NO: 13706 - protein, 7 aa, Artificial Sequence
  Description of Artificial Sequence: Synthetic peptide
  XENP018805 vlCDR2
VASHRYT

SEQ ID NO: 13707 - protein, 9 aa, Artificial Sequence
  Description of Artificial Sequence: Synthetic peptide
  XENP018805 vlCDR3
QQDYSSPRT

SEQ ID NO: 13708 - protein, 249 aa, Artificial Sequence
  Description of Artificial Sequence: Synthetic polypeptide
  XENP018806 1G6_H1_L1.60_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINAASHRYTGVPDRFTGSGYGTEFTLTISSLQSEDFAVYFCQQDYSSPRTFGGGTKVEIK

SEQ ID NO: 13709 - protein, 122 aa, Artificial Sequence; identical to SEQ ID NO: 10922
  Description of Artificial Sequence: Synthetic polypeptide
  VH of XENP018806

SEQ ID NO: 13710 - protein, 107 aa, Artificial Sequence
  Description of Artificial Sequence: Synthetic polypeptide
  VL of XENP018806
SIVMTQSPATLSVSPGERATLSCRASQSVSNDVAWYQQKPGQSPRLLINAASHRYTGVPDRFTGSGYGTEFTLTISSLQSEDFAVYFCQQDYSSPRTFGGGTKVEIK

SEQ ID NO: 13711 - protein, 5 aa, Artificial Sequence
  Description of Artificial Sequence: Synthetic peptide
  XENP018806 vhCDR1
NYWMN

SEQ ID NO: 13712 - protein, 19 aa, Artificial Sequence
  Description of Artificial Sequence: Synthetic peptide
  XENP018806 vhCDR2
EIRLKSNNYATHYAEPVKG

SEQ ID NO: 13713 - protein, 11 aa, Artificial Sequence
  Description of Artificial Sequence: Synthetic peptide
  XENP018806 vhCDR3
YYGNYGGYFDV

SEQ ID NO: 13714 - protein, 11 aa, Artificial Sequence
  Description of Artificial Sequence: Synthetic peptide
  XENP018806 vlCDR1
RASQSVSNDVA

SEQ ID NO: 13715 - protein, 7 aa, Artificial Sequence
  Description of Artificial Sequence: Synthetic peptide
  XENP018806 vlCDR2
AASHRYT

SEQ ID NO: 13716 - protein, 9 aa, Artificial Sequence
  Description of Artificial Sequence: Synthetic peptide
  XENP018806 vlCDR3
QQDYSSPRT

SEQ ID NO: 13717 - protein, 249 aa, Artificial Sequence
  Description of Artificial Sequence: Synthetic polypeptide
  XENP018807 1G6_H1_L1.61_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINQASHRYTGVPDRFTGSGYGTEFTLTISSLQSEDFAVYFCQQDYSSPRTFGGGTKVEIK

SEQ ID NO: 13718 - protein, 122 aa, Artificial Sequence; identical to SEQ ID NO: 10922
  Description of Artificial Sequence: Synthetic polypeptide
  VH of XENP018807

SEQ ID NO: 13719 - protein, 107 aa, Artificial Sequence
  Description of Artificial Sequence: Synthetic polypeptide
  VL of XENP018807
SIVMTQSPATLSVSPGERATLSCRASQSVSNDVAWYQQKPGQSPRLLINQASHRYTGVPDRFTGSGYGTEFTLTISSLQSEDFAVYFCQQDYSSPRTFGGGTKVEIK

SEQ ID NO: 13720 - protein, 5 aa, Artificial Sequence
  Description of Artificial Sequence: Synthetic peptide
  XENP018807 vhCDR1
NYWMN

SEQ ID NO: 13721 - protein, 19 aa, Artificial Sequence
  Description of Artificial Sequence: Synthetic peptide
  XENP018807 vhCDR2
EIRLKSNNYATHYAEPVKG

SEQ ID NO: 13722 - protein, 11 aa, Artificial Sequence
  Description of Artificial Sequence: Synthetic peptide
  XENP018807 vhCDR3
YYGNYGGYFDV

SEQ ID NO: 13723 - protein, 11 aa, Artificial Sequence
  Description of Artificial Sequence: Synthetic peptide
  XENP018807 vlCDR1
RASQSVSNDVA

SEQ ID NO: 13724 - protein, 7 aa, Artificial Sequence
  Description of Artificial Sequence: Synthetic peptide
  XENP018807 vlCDR2
QASHRYT

SEQ ID NO: 13725 - protein, 9 aa, Artificial Sequence
  Description of Artificial Sequence: Synthetic peptide
  XENP018807 vlCDR3
QQDYSSPRT

SEQ ID NO: 13726 - protein, 249 aa, Artificial Sequence
  Description of Artificial Sequence: Synthetic polypeptide
  XENP018808 1G6_H1_L1.62_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINDASHRYTGVPDRFTGSGYGTEFTLTISSLQSEDFAVYFCQQDYSSPRTFGGGTKVEIK

SEQ ID NO: 13727 - protein, 122 aa, Artificial Sequence; identical to SEQ ID NO: 10922
  Description of Artificial Sequence: Synthetic polypeptide
  VH of XENP018808

SEQ ID NO: 13728 - protein, 107 aa, Artificial Sequence
  Description of Artificial Sequence: Synthetic polypeptide
  VL of XENP018808
SIVMTQSPATLSVSPGERATLSCRASQSVSNDVAWYQQKPGQSPRLLINDASHRYTGVPDRFTGSGYGTEFTLTISSLQSEDFAVYFCQQDYSSPRTFGGGTKVEIK

SEQ ID NO: 13729 - protein, 5 aa, Artificial Sequence
  Description of Artificial Sequence: Synthetic peptide
  XENP018808 vhCDR1
NYWMN

SEQ ID NO: 13730 - protein, 19 aa, Artificial Sequence
  Description of Artificial Sequence: Synthetic peptide
  XENP018808 vhCDR2
EIRLKSNNYATHYAEPVKG

SEQ ID NO: 13731 - protein, 11 aa, Artificial Sequence
  Description of Artificial Sequence: Synthetic peptide
  XENP018808 vhCDR3
YYGNYGGYFDV

SEQ ID NO: 13732 - protein, 11 aa, Artificial Sequence
  Description of Artificial Sequence: Synthetic peptide
  XENP018808 vlCDR1
RASQSVSNDVA

SEQ ID NO: 13733 - protein, 7 aa, Artificial Sequence
  Description of Artificial Sequence: Synthetic peptide
  XENP018808 vlCDR2
DASHRYT

SEQ ID NO: 13734 - protein, 9 aa, Artificial Sequence
  Description of Artificial Sequence: Synthetic peptide
  XENP018808 vlCDR3
QQDYSSPRT

SEQ ID NO: 13735 - protein, 249 aa, Artificial Sequence
  Description of Artificial Sequence: Synthetic polypeptide
  XENP018809 1G6_H1_L1.63_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINKASHRYTGVPDRFTGSGYGTEFTLTISSLQSEDFAVYFCQQDYSSPRTFGGGTKVEIK

SEQ ID NO: 13736 - protein, 122 aa, Artificial Sequence; identical to SEQ ID NO: 10922
  Description of Artificial Sequence: Synthetic polypeptide
  VH of XENP018809

SEQ ID NO: 13737 - protein, 107 aa, Artificial Sequence
  Description of Artificial Sequence: Synthetic polypeptide
  VL of XENP018809
SIVMTQSPATLSVSPGERATLSCRASQSVSNDVAWYQQKPGQSPRLLINKASHRYTGVPDRFTGSGYGTEFTLTISSLQSEDFAVYFCQQDYSSPRTFGGGTKVEIK

SEQ ID NO: 13738 - protein, 5 aa, Artificial Sequence
  Description of Artificial Sequence: Synthetic peptide
  XENP018809 vhCDR1
NYWMN

SEQ ID NO: 13739 - protein, 19 aa, Artificial Sequence
  Description of Artificial Sequence: Synthetic peptide
  XENP018809 vhCDR2
EIRLKSNNYATHYAEPVKG

SEQ ID NO: 13740 - protein, 11 aa, Artificial Sequence
  Description of Artificial Sequence: Synthetic peptide
  XENP018809 vhCDR3
YYGNYGGYFDV

SEQ ID NO: 13741 - protein, 11 aa, Artificial Sequence
  Description of Artificial Sequence: Synthetic peptide
  XENP018809 vlCDR1
RASQSVSNDVA

SEQ ID NO: 13742 - protein, 7 aa, Artificial Sequence
  Description of Artificial Sequence: Synthetic peptide
  XENP018809 vlCDR2
KASHRYT

SEQ ID NO: 13743 - protein, 9 aa, Artificial Sequence
  Description of Artificial Sequence: Synthetic peptide
  XENP018809 vlCDR3
QQDYSSPRT

SEQ ID NO: 13744 - protein, 249 aa, Artificial Sequence
  Description of Artificial Sequence: Synthetic polypeptide
  XENP018810 1G6_H1_L1.64_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASYRYTGVPDRFTGSGYGTEFTLTISSLQSEDFAVYFCQQDYSSPRTFGGGTKVEIK

SEQ ID NO: 13745 - protein, 122 aa, Artificial Sequence; identical to SEQ ID NO: 10922
  Description of Artificial Sequence: Synthetic polypeptide
  VH of XENP018810

SEQ ID NO: 13746 - protein, 107 aa, Artificial Sequence
  Description of Artificial Sequence: Synthetic polypeptide
  VL of XENP018810
SIVMTQSPATLSVSPGERATLSCRASQSVSNDVAWYQQKPGQSPRLLINYASYRYTGVPDRFTGSGYGTEFTLTISSLQSEDFAVYFCQQDYSSPRTFGGGTKVEIK

SEQ ID NO: 13747 - protein, 5 aa, Artificial Sequence
  Description of Artificial Sequence: Synthetic peptide
  XENP018810 vhCDR1
NYWMN

SEQ ID NO: 13748 - protein, 19 aa, Artificial Sequence
  Description of Artificial Sequence: Synthetic peptide
  XENP018810 vhCDR2
EIRLKSNNYATHYAEPVKG

SEQ ID NO: 13749 - protein, 11 aa, Artificial Sequence
  Description of Artificial Sequence: Synthetic peptide
  XENP018810 vhCDR3
YYGNYGGYFDV

SEQ ID NO: 13750 - protein, 11 aa, Artificial Sequence
  Description of Artificial Sequence: Synthetic peptide
  XENP018810 vlCDR1
RASQSVSNDVA

SEQ ID NO: 13751 - protein, 7 aa, Artificial Sequence
  Description of Artificial Sequence: Synthetic peptide
  XENP018810 vlCDR2
YASYRYT

SEQ ID NO: 13752 - protein, 9 aa, Artificial Sequence
  Description of Artificial Sequence: Synthetic peptide
  XENP018810 vlCDR3
QQDYSSPRT

SEQ ID NO: 13753 - protein, 249 aa, Artificial Sequence
  Description of Artificial Sequence: Synthetic polypeptide
  XENP018811 1G6_H1_L1.65_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASQRYTGVPDRFTGSGYGTEFTLTISSLQSEDFAVYFCQQDYSSPRTFGGGTKVEIK

SEQ ID NO: 13754 - protein, 122 aa, Artificial Sequence; identical to SEQ ID NO: 10922
  Description of Artificial Sequence: Synthetic polypeptide
  VH of XENP018811

SEQ ID NO: 13755 - protein, 107 aa, Artificial Sequence
  Description of Artificial Sequence: Synthetic polypeptide
  VL of XENP018811
SIVMTQSPATLSVSPGERATLSCRASQSVSNDVAWYQQKPGQSPRLLINYASQRYTGVPDRFTGSGYGTEFTLTISSLQSEDFAVYFCQQDYSSPRTFGGGTKVEIK

SEQ ID NO: 13756 - protein, 5 aa, Artificial Sequence
  Description of Artificial Sequence: Synthetic peptide
  XENP018811 vhCDR1
NYWMN

SEQ ID NO: 13757 - protein, 19 aa, Artificial Sequence
  Description of Artificial Sequence: Synthetic peptide
  XENP018811 vhCDR2
EIRLKSNNYATHYAEPVKG

SEQ ID NO: 13758 - protein, 11 aa, Artificial Sequence
  Description of Artificial Sequence: Synthetic peptide
  XENP018811 vhCDR3
YYGNYGGYFDV

SEQ ID NO: 13759 - protein, 11 aa, Artificial Sequence
  Description of Artificial Sequence: Synthetic peptide
  XENP018811 vlCDR1
RASQSVSNDVA

SEQ ID NO: 13760 - protein, 7 aa, Artificial Sequence
  Description of Artificial Sequence: Synthetic peptide
  XENP018811 vlCDR2
YASQRYT

SEQ ID NO: 13761 - protein, 9 aa, Artificial Sequence
  Description of Artificial Sequence: Synthetic peptide
  XENP018811 vlCDR3
QQDYSSPRT

SEQ ID NO: 13762 - protein, 249 aa, Artificial Sequence
  Description of Artificial Sequence: Synthetic polypeptide
  XENP018812 1G6_H1_L1.66_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASDRYTGVPDRFTGSGYGTEFTLTISSLQSEDFAVYFCQQDYSSPRTFGGGTKVEIK

SEQ ID NO: 13763 - protein, 122 aa, Artificial Sequence; identical to SEQ ID NO: 10922
  Description of Artificial Sequence: Synthetic polypeptide
  VH of XENP018812

SEQ ID NO: 13764 - protein, 107 aa, Artificial Sequence
  Description of Artificial Sequence: Synthetic polypeptide
  VL of XENP018812
SIVMTQSPATLSVSPGERATLSCRASQSVSNDVAWYQQKPGQSPRLLINYASDRYTGVPDRFTGSGYGTEFTLTISSLQSEDFAVYFCQQDYSSPRTFGGGTKVEIK

SEQ ID NO: 13765 - protein, 5 aa, Artificial Sequence
  Description of Artificial Sequence: Synthetic peptide
  XENP018812 vhCDR1
NYWMN

SEQ ID NO: 13766 - protein, 19 aa, Artificial Sequence
  Description of Artificial Sequence: Synthetic peptide
  XENP018812 vhCDR2
EIRLKSNNYATHYAEPVKG

SEQ ID NO: 13767 - protein, 11 aa, Artificial Sequence
  Description of Artificial Sequence: Synthetic peptide
  XENP018812 vhCDR3
YYGNYGGYFDV

SEQ ID NO: 13768 - protein, 11 aa, Artificial Sequence
  Description of Artificial Sequence: Synthetic peptide
  XENP018812 vlCDR1
RASQSVSNDVA

SEQ ID NO: 13769 - protein, 7 aa, Artificial Sequence
  Description of Artificial Sequence: Synthetic peptide
  XENP018812 vlCDR2
YASDRYT

SEQ ID NO: 13770 - protein, 9 aa, Artificial Sequence
  Description of Artificial Sequence: Synthetic peptide
  XENP018812 vlCDR3
QQDYSSPRT

SEQ ID NO: 13771 - protein, 249 aa, Artificial Sequence
  Description of Artificial Sequence: Synthetic polypeptide
  XENP018813 1G6_H1_L1.67_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASWRYTGVPDRFTGSGYGTEFTLTISSLQSEDFAVYFCQQDYSSPRTFGGGTKVEIK

SEQ ID NO: 13772 - protein, 122 aa, Artificial Sequence; identical to SEQ ID NO: 10922
  Description of Artificial Sequence: Synthetic polypeptide
  VH of XENP018813

SEQ ID NO: 13773 - protein, 107 aa, Artificial Sequence
  Description of Artificial Sequence: Synthetic polypeptide
  VL of XENP018813
SIVMTQSPATLSVSPGERATLSCRASQSVSNDVAWYQQKPGQSPRLLINYASWRYTGVPDRFTGSGYGTEFTLTISSLQSEDFAVYFCQQDYSSPRTFGGGTKVEIK

SEQ ID NO: 13774 - protein, 5 aa, Artificial Sequence
  Description of Artificial Sequence: Synthetic peptide
  XENP018813 vhCDR1
NYWMN

SEQ ID NO: 13775 - protein, 19 aa, Artificial Sequence
  Description of Artificial Sequence: Synthetic peptide
  XENP018813 vhCDR2
EIRLKSNNYATHYAEPVKG

SEQ ID NO: 13776 - protein, 11 aa, Artificial Sequence
  Description of Artificial Sequence: Synthetic peptide
  XENP018813 vhCDR3
YYGNYGGYFDV

SEQ ID NO: 13777 - protein, 11 aa, Artificial Sequence
  Description of Artificial Sequence: Synthetic peptide
  XENP018813 vlCDR1
RASQSVSNDVA

SEQ ID NO: 13778 - protein, 7 aa, Artificial Sequence
  Description of Artificial Sequence: Synthetic peptide
  XENP018813 vlCDR2
YASWRYT

SEQ ID NO: 13779 - protein, 9 aa, Artificial Sequence
  Description of Artificial Sequence: Synthetic peptide
  XENP018813 vlCDR3
QQDYSSPRT

SEQ ID NO: 13780 - protein, 249 aa, Artificial Sequence
  Description of Artificial Sequence: Synthetic polypeptide
  XENP018814 1G6_H1_L1.68_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASARYTGVPDRFTGSGYGTEFTLTISSLQSEDFAVYFCQQDYSSPRTFGGGTKVEIK

SEQ ID NO: 13781 - protein, 122 aa, Artificial Sequence; identical to SEQ ID NO: 10922
  Description of Artificial Sequence: Synthetic polypeptide
  VH of XENP018814

SEQ ID NO: 13782 - protein, 107 aa, Artificial Sequence
  Description of Artificial Sequence: Synthetic polypeptide
  VL of XENP018814
SIVMTQSPATLSVSPGERATLSCRASQSVSNDVAWYQQKPGQSPRLLINYASARYTGVPDRFTGSGYGTEFTLTISSLQSEDFAVYFCQQDYSSPRTFGGGTKVEIK

SEQ ID NO: 13783 - protein, 5 aa, Artificial Sequence
  Description of Artificial Sequence: Synthetic peptide
  XENP018814 vhCDR1
NYWMN

SEQ ID NO: 13784 - protein, 19 aa, Artificial Sequence
  Description of Artificial Sequence: Synthetic peptide
  XENP018814 vhCDR2
EIRLKSNNYATHYAEPVKG

SEQ ID NO: 13785 - protein, 11 aa, Artificial Sequence
  Description of Artificial Sequence: Synthetic peptide
  XENP018814 vhCDR3
YYGNYGGYFDV

SEQ ID NO: 13786 - protein, 11 aa, Artificial Sequence
  Description of Artificial Sequence: Synthetic peptide
  XENP018814 vlCDR1
RASQSVSNDVA

SEQ ID NO: 13787 - protein, 7 aa, Artificial Sequence
  Description of Artificial Sequence: Synthetic peptide
  XENP018814 vlCDR2
YASARYT

SEQ ID NO: 13788 - protein, 9 aa, Artificial Sequence
  Description of Artificial Sequence: Synthetic peptide
  XENP018814 vlCDR3
QQDYSSPRT

SEQ ID NO: 13789 - protein, 249 aa, Artificial Sequence
  Description of Artificial Sequence: Synthetic polypeptide
  XENP018815 1G6_H1_L1.69_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASTRYTGVPDRFTGSGYGTEFTLTISSLQSEDFAVYFCQQDYSSPRTFGGGTKVEIK

SEQ ID NO: 13790 - protein, 122 aa, Artificial Sequence; identical to SEQ ID NO: 10922
  Description of Artificial Sequence: Synthetic polypeptide
  VH of XENP018815

SEQ ID NO: 13791 - protein, 107 aa, Artificial Sequence
  Description of Artificial Sequence: Synthetic polypeptide
  VL of XENP018815
SIVMTQSPATLSVSPGERATLSCRASQSVSNDVAWYQQKPGQSPRLLINYASTRYTGVPDRFTGSGYGTEFTLTISSLQSEDFAVYFCQQDYSSPRTFGGGTKVEIK

SEQ ID NO: 13792 - protein, 5 aa, Artificial Sequence
  Description of Artificial Sequence: Synthetic peptide
  XENP018815 vhCDR1
NYWMN

SEQ ID NO: 13793 - protein, 19 aa, Artificial Sequence
  Description of Artificial Sequence: Synthetic peptide
  XENP018815 vhCDR2
EIRLKSNNYATHYAEPVKG

SEQ ID NO: 13794 - protein, 11 aa, Artificial Sequence
  Description of Artificial Sequence: Synthetic peptide
  XENP018815 vhCDR3
YYGNYGGYFDV

SEQ ID NO: 13795 - protein, 11 aa, Artificial Sequence
  Description of Artificial Sequence: Synthetic peptide
  XENP018815 vlCDR1
RASQSVSNDVA

SEQ ID NO: 13796 - protein, 7 aa, Artificial Sequence
  Description of Artificial Sequence: Synthetic peptide
  XENP018815 vlCDR2
YASTRYT

SEQ ID NO: 13797 - protein, 9 aa, Artificial Sequence
  Description of Artificial Sequence: Synthetic peptide
  XENP018815 vlCDR3
QQDYSSPRT

SEQ ID NO: 13798 - protein, 249 aa, Artificial Sequence
  Description of Artificial Sequence: Synthetic polypeptide
  XENP018816 1G6_H1_L1.70_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASKRYTGVPDRFTGSGYGTEFTLTISSLQSEDFAVYFCQQDYSSPRTFGGGTKVEIK

SEQ ID NO: 13799 - protein, 122 aa, Artificial Sequence; identical to SEQ ID NO: 10922
  Description of Artificial Sequence: Synthetic polypeptide
  VH of XENP018816

SEQ ID NO: 13800 - protein, 107 aa, Artificial Sequence
  Description of Artificial Sequence: Synthetic polypeptide
  VL of XENP018816
SIVMTQSPATLSVSPGERATLSCRASQSVSNDVAWYQQKPGQSPRLLINYASKRYTGVPDRFTGSGYGTEFTLTISSLQSEDFAVYFCQQDYSSPRTFGGGTKVEIK

SEQ ID NO: 13801 - protein, 5 aa, Artificial Sequence
  Description of Artificial Sequence: Synthetic peptide
  XENP018816 vhCDR1
NYWMN

SEQ ID NO: 13802 - protein, 19 aa, Artificial Sequence
  Description of Artificial Sequence: Synthetic peptide
  XENP018816 vhCDR2
EIRLKSNNYATHYAEPVKG

SEQ ID NO: 13803 - protein, 11 aa, Artificial Sequence
  Description of Artificial Sequence: Synthetic peptide
  XENP018816 vhCDR3
YYGNYGGYFDV

SEQ ID NO: 13804 - protein, 11 aa, Artificial Sequence
  Description of Artificial Sequence: Synthetic peptide
  XENP018816 vlCDR1
RASQSVSNDVA

SEQ ID NO: 13805 - protein, 7 aa, Artificial Sequence
  Description of Artificial Sequence: Synthetic peptide
  XENP018816 vlCDR2
YASKRYT

SEQ ID NO: 13806 - protein, 9 aa, Artificial Sequence
  Description of Artificial Sequence: Synthetic peptide
  XENP018816 vlCDR3
QQDYSSPRT

SEQ ID NO: 13807 - protein, 249 aa, Artificial Sequence
  Description of Artificial Sequence: Synthetic polypeptide
  XENP018817 1G6_H1_L1.71_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASGRYTGVPDRFTGSGYGTEFTLTISSLQSEDFAVYFCQQDYSSPRTFGGGTKVEIK

SEQ ID NO: 13808 - protein, 122 aa, Artificial Sequence; identical to SEQ ID NO: 10922
  Description of Artificial Sequence: Synthetic polypeptide
  VH of XENP018817

SEQ ID NO: 13809 - protein, 107 aa, Artificial Sequence
  Description of Artificial Sequence: Synthetic polypeptide
  VL of XENP018817
SIVMTQSPATLSVSPGERATLSCRASQSVSNDVAWYQQKPGQSPRLLINYASGRYTGVPDRFTGSGYGTEFTLTISSLQSEDFAVYFCQQDYSSPRTFGGGTKVEIK

SEQ ID NO: 13810 - protein, 5 aa, Artificial Sequence
  Description of Artificial Sequence: Synthetic peptide
  XENP018817 vhCDR1
NYWMN

SEQ ID NO: 13811 - protein, 19 aa, Artificial Sequence
  Description of Artificial Sequence: Synthetic peptide
  XENP018817 vhCDR2
EIRLKSNNYATHYAEPVKG

SEQ ID NO: 13812 - protein, 11 aa, Artificial Sequence
  Description of Artificial Sequence: Synthetic peptide
  XENP018817 vhCDR3
YYGNYGGYFDV

SEQ ID NO: 13813 - protein, 11 aa, Artificial Sequence
  Description of Artificial Sequence: Synthetic peptide
  XENP018817 vlCDR1
RASQSVSNDVA

SEQ ID NO: 13814 - protein, 7 aa, Artificial Sequence
  Description of Artificial Sequence: Synthetic peptide
  XENP018817 vlCDR2
YASGRYT

SEQ ID NO: 13815 - protein, 9 aa, Artificial Sequence
  Description of Artificial Sequence: Synthetic peptide
  XENP018817 vlCDR3
QQDYSSPRT

SEQ ID NO: 13816 - protein, 249 aa, Artificial Sequence
  Description of Artificial Sequence: Synthetic polypeptide
  XENP018818 1G6_H1_L1.72_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASLRYTGVPDRFTGSGYGTEFTLTISSLQSEDFAVYFCQQDYSSPRTFGGGTKVEIK

SEQ ID NO: 13817 - protein, 122 aa, Artificial Sequence; identical to SEQ ID NO: 10922
  Description of Artificial Sequence: Synthetic polypeptide
  VH of XENP018818

SEQ ID NO: 13818 - protein, 107 aa, Artificial Sequence
  Description of Artificial Sequence: Synthetic polypeptide
  VL of XENP018818
SIVMTQSPATLSVSPGERATLSCRASQSVSNDVAWYQQKPGQSPRLLINYASLRYTGVPDRFTGSGYGTEFTLTISSLQSEDFAVYFCQQDYSSPRTFGGGTKVEIK

SEQ ID NO: 13819 - protein, 5 aa, Artificial Sequence
  Description of Artificial Sequence: Synthetic peptide
  XENP018818 vhCDR1
NYWMN

SEQ ID NO: 13820 - protein, 19 aa, Artificial Sequence
  Description of Artificial Sequence: Synthetic peptide
  XENP018818 vhCDR2
EIRLKSNNYATHYAEPVKG

SEQ ID NO: 13821 - protein, 11 aa, Artificial Sequence
  Description of Artificial Sequence: Synthetic peptide
  XENP018818 vhCDR3
YYGNYGGYFDV

SEQ ID NO: 13822 - protein, 11 aa, Artificial Sequence
  Description of Artificial Sequence: Synthetic peptide
  XENP018818 vlCDR1
RASQSVSNDVA

SEQ ID NO: 13823 - protein, 7 aa, Artificial Sequence
  Description of Artificial Sequence: Synthetic peptide
  XENP018818 vlCDR2
YASLRYT

SEQ ID NO: 13824 - protein, 9 aa, Artificial Sequence
  Description of Artificial Sequence: Synthetic peptide
  XENP018818 vlCDR3
QQDYSSPRT

SEQ ID NO: 13825 - protein, 249 aa, Artificial Sequence
  Description of Artificial Sequence: Synthetic polypeptide
  XENP018819 1G6_H1_L1.73_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHLYTGVPDRFTGSGYGTEFTLTISSLQSEDFAVYFCQQDYSSPRTFGGGTKVEIK

SEQ ID NO: 13826 - protein, 122 aa, Artificial Sequence; identical to SEQ ID NO: 10922
  Description of Artificial Sequence: Synthetic polypeptide
  VH of XENP018819

SEQ ID NO: 13827 - protein, 107 aa, Artificial Sequence
  Description of Artificial Sequence: Synthetic polypeptide
  VL of XENP018819
SIVMTQSPATLSVSPGERATLSCRASQSVSNDVAWYQQKPGQSPRLLINYASHLYTGVPDRFTGSGYGTEFTLTISSLQSEDFAVYFCQQDYSSPRTFGGGTKVEIK

SEQ ID NO: 13828 - protein, 5 aa, Artificial Sequence
  Description of Artificial Sequence: Synthetic peptide
  XENP018819 vhCDR1
NYWMN

SEQ ID NO: 13829 - protein, 19 aa, Artificial Sequence
  Description of Artificial Sequence: Synthetic peptide
  XENP018819 vhCDR2
EIRLKSNNYATHYAEPVKG

SEQ ID NO: 13830 - protein, 11 aa, Artificial Sequence
  Description of Artificial Sequence: Synthetic peptide
  XENP018819 vhCDR3
YYGNYGGYFDV

SEQ ID NO: 13831 - protein, 11 aa, Artificial Sequence
  Description of Artificial Sequence: Synthetic peptide
  XENP018819 vlCDR1
RASQSVSNDVA

SEQ ID NO: 13832 - protein, 7 aa, Artificial Sequence
  Description of Artificial Sequence: Synthetic peptide
  XENP018819 vlCDR2
YASHLYT

SEQ ID NO: 13833 - protein, 9 aa, Artificial Sequence
  Description of Artificial Sequence: Synthetic peptide
  XENP018819 vlCDR3
QQDYSSPRT

SEQ ID NO: 13834 - protein, 249 aa, Artificial Sequence
  Description of Artificial Sequence: Synthetic polypeptide
  XENP018820 1G6_H1_L1.74_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHWYTGVPDRFTGSGYGTEFTLTISSLQSEDFAVYFCQQDYSSPRTFGGGTKVEIK

SEQ ID NO: 13835 - protein, 122 aa, Artificial Sequence; identical to SEQ ID NO: 10922
  Description of Artificial Sequence: Synthetic polypeptide
  VH of XENP018820

SEQ ID NO: 13836 - protein, 107 aa, Artificial Sequence
  Description of Artificial Sequence: Synthetic polypeptide
  VL of XENP018820
SIVMTQSPATLSVSPGERATLSCRASQSVSNDVAWYQQKPGQSPRLLINYASHWYTGVPDRFTGSGYGTEFTLTISSLQSEDFAVYFCQQDYSSPRTFGGGTKVEIK

SEQ ID NO: 13837 - protein, 5 aa, Artificial Sequence
  Description of Artificial Sequence: Synthetic peptide
  XENP018820 vhCDR1
NYWMN

SEQ ID NO: 13838 - protein, 19 aa, Artificial Sequence
  Description of Artificial Sequence: Synthetic peptide
  XENP018820 vhCDR2
EIRLKSNNYATHYAEPVKG

SEQ ID NO: 13839 - protein, 11 aa, Artificial Sequence
  Description of Artificial Sequence: Synthetic peptide
  XENP018820 vhCDR3
YYGNYGGYFDV

SEQ ID NO: 13840 - protein, 11 aa, Artificial Sequence
  Description of Artificial Sequence: Synthetic peptide
  XENP018820 vlCDR1
RASQSVSNDVA

SEQ ID NO: 13841 - protein, 7 aa, Artificial Sequence
  Description of Artificial Sequence: Synthetic peptide
  XENP018820 vlCDR2
YASHWYT

SEQ ID NO: 13842 - protein, 9 aa, Artificial Sequence
  Description of Artificial Sequence: Synthetic peptide
  XENP018820 vlCDR3
QQDYSSPRT

SEQ ID NO: 13843 - protein, 249 aa, Artificial Sequence
  Description of Artificial Sequence: Synthetic polypeptide
  XENP018821 1G6_H1_L1.75_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHSYTGVPDRFTGSGYGTEFTLTISSLQSEDFAVYFCQQDYSSPRTFGGGTKVEIK

SEQ ID NO: 13844 - protein, 122 aa, Artificial Sequence; identical to SEQ ID NO: 10922
  Description of Artificial Sequence: Synthetic polypeptide
  VH of XENP018821

SEQ ID NO: 13845 - protein, 107 aa, Artificial Sequence
  Description of Artificial Sequence: Synthetic polypeptide
  VL of XENP018821
SIVMTQSPATLSVSPGERATLSCRASQSVSNDVAWYQQKPGQSPRLLINYASHSYTGVPDRFTGSGYGTEFTLTISSLQSEDFAVYFCQQDYSSPRTFGGGTKVEIK

SEQ ID NO: 13846 - protein, 5 aa, Artificial Sequence
  Description of Artificial Sequence: Synthetic peptide
  XENP018821 vhCDR1
NYWMN

SEQ ID NO: 13847 - protein, 19 aa, Artificial Sequence
  Description of Artificial Sequence: Synthetic peptide
  XENP018821 vhCDR2
EIRLKSNNYATHYAEPVKG

SEQ ID NO: 13848 - protein, 11 aa, Artificial Sequence
  Description of Artificial Sequence: Synthetic peptide
  XENP018821 vhCDR3
YYGNYGGYFDV

SEQ ID NO: 13849 - protein, 11 aa, Artificial Sequence
  Description of Artificial Sequence: Synthetic peptide
  XENP018821 vlCDR1
RASQSVSNDVA

SEQ ID NO: 13850 - protein, 7 aa, Artificial Sequence
  Description of Artificial Sequence: Synthetic peptide
  XENP018821 vlCDR2
YASHSYT

SEQ ID NO: 13851 - protein, 9 aa, Artificial Sequence
  Description of Artificial Sequence: Synthetic peptide
  XENP018821 vlCDR3
QQDYSSPRT

SEQ ID NO: 13852 - protein, 249 aa, Artificial Sequence
  Description of Artificial Sequence: Synthetic polypeptide
  XENP018822 1G6_H1_L1.76_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRFTGVPDRFTGSGYGTEFTLTISSLQSEDFAVYFCQQDYSSPRTFGGGTKVEIK

SEQ ID NO: 13853 - protein, 122 aa, Artificial Sequence; identical to SEQ ID NO: 10922
  Description of Artificial Sequence: Synthetic polypeptide
  VH of XENP018822

SEQ ID NO: 13854 - protein, 107 aa, Artificial Sequence
  Description of Artificial Sequence: Synthetic polypeptide
  VL of XENP018822
SIVMTQSPATLSVSPGERATLSCRASQSVSNDVAWYQQKPGQSPRLLINYASHRFTGVPDRFTGSGYGTEFTLTISSLQSEDFAVYFCQQDYSSPRTFGGGTKVEIK

SEQ ID NO: 13855 - protein, 5 aa, Artificial Sequence
  Description of Artificial Sequence: Synthetic peptide
  XENP018822 vhCDR1
NYWMN

SEQ ID NO: 13856 - protein, 19 aa, Artificial Sequence
  Description of Artificial Sequence: Synthetic peptide
  XENP018822 vhCDR2
EIRLKSNNYATHYAEPVKG

SEQ ID NO: 13857 - protein, 11 aa, Artificial Sequence
  Description of Artificial Sequence: Synthetic peptide
  XENP018822 vhCDR3
YYGNYGGYFDV

SEQ ID NO: 13858 - protein, 11 aa, Artificial Sequence
  Description of Artificial Sequence: Synthetic peptide
  XENP018822 vlCDR1
RASQSVSNDVA

SEQ ID NO: 13859 - protein, 7 aa, Artificial Sequence
  Description of Artificial Sequence: Synthetic peptide
  XENP018822 vlCDR2
YASHRFT

SEQ ID NO: 13860 - protein, 9 aa, Artificial Sequence
  Description of Artificial Sequence: Synthetic peptide
  XENP018822 vlCDR3
QQDYSSPRT

SEQ ID NO: 13861 - protein, 249 aa, Artificial Sequence
  Description of Artificial Sequence: Synthetic polypeptide
  XENP018823 1G6_H1_L1.77_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRHTGVPDRFTGSGYGTEFTLTISSLQSEDFAVYFCQQDYSSPRTFGGGTKVEIK

SEQ ID NO: 13862 - protein, 122 aa, Artificial Sequence; identical to SEQ ID NO: 10922
  Description of Artificial Sequence: Synthetic polypeptide
  VH of XENP018823

SEQ ID NO: 13863 - protein, 107 aa, Artificial Sequence
  Description of Artificial Sequence: Synthetic polypeptide
  VL of XENP018823
SIVMTQSPATLSVSPGERATLSCRASQSVSNDVAWYQQKPGQSPRLLINYASHRHTGVPDRFTGSGYGTEFTLTISSLQSEDFAVYFCQQDYSSPRTFGGGTKVEIK

SEQ ID NO: 13864 - protein, 5 aa, Artificial Sequence
  Description of Artificial Sequence: Synthetic peptide
  XENP018823 vhCDR1
NYWMN

SEQ ID NO: 13865 - protein, 19 aa, Artificial Sequence
  Description of Artificial Sequence: Synthetic peptide
  XENP018823 vhCDR2
EIRLKSNNYATHYAEPVKG

SEQ ID NO: 13866 - protein, 11 aa, Artificial Sequence
  Description of Artificial Sequence: Synthetic peptide
  XENP018823 vhCDR3
YYGNYGGYFDV

SEQ ID NO: 13867 - protein, 11 aa, Artificial Sequence
  Description of Artificial Sequence: Synthetic peptide
  XENP018823 vlCDR1
RASQSVSNDVA

SEQ ID NO: 13868 - protein, 7 aa, Artificial Sequence
  Description of Artificial Sequence: Synthetic peptide
  XENP018823 vlCDR2
YASHRHT

SEQ ID NO: 13869 - protein, 9 aa, Artificial Sequence
  Description of Artificial Sequence: Synthetic peptide
  XENP018823 vlCDR3
QQDYSSPRT

SEQ ID NO: 13870 - protein, 249 aa, Artificial Sequence
  Description of Artificial Sequence: Synthetic polypeptide
  XENP018824 1G6_H1_L1.78_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRLTGVPDRFTGSGYGTEFTLTISSLQSEDFAVYFCQQDYSSPRTFGGGTKVEIK

SEQ ID NO: 13871 - protein, 122 aa, Artificial Sequence; identical to SEQ ID NO: 10922
  Description of Artificial Sequence: Synthetic polypeptide
  VH of XENP018824

SEQ ID NO: 13872 - protein, 107 aa, Artificial Sequence
  Description of Artificial Sequence: Synthetic polypeptide
  VL of XENP018824
SIVMTQSPATLSVSPGERATLSCRASQSVSNDVAWYQQKPGQSPRLLINYASHRLTGVPDRFTGSGYGTEFTLTISSLQSEDFAVYFCQQDYSSPRTFGGGTKVEIK

SEQ ID NO: 13873 - protein, 5 aa, Artificial Sequence
  Description of Artificial Sequence: Synthetic peptide
  XENP018824 vhCDR1
NYWMN

SEQ ID NO: 13874 - protein, 19 aa, Artificial Sequence
  Description of Artificial Sequence: Synthetic peptide
  XENP018824 vhCDR2
EIRLKSNNYATHYAEPVKG

SEQ ID NO: 13875 - protein, 11 aa, Artificial Sequence
  Description of Artificial Sequence: Synthetic peptide
  XENP018824 vhCDR3
YYGNYGGYFDV

SEQ ID NO: 13876 - protein, 11 aa, Artificial Sequence
  Description of Artificial Sequence: Synthetic peptide
  XENP018824 vlCDR1
RASQSVSNDVA

SEQ ID NO: 13877 - protein, 7 aa, Artificial Sequence
  Description of Artificial Sequence: Synthetic peptide
  XENP018824 vlCDR2
YASHRLT

SEQ ID NO: 13878 - protein, 9 aa, Artificial Sequence
  Description of Artificial Sequence: Synthetic peptide
  XENP018824 vlCDR3
QQDYSSPRT

SEQ ID NO: 13879 - protein, 249 aa, Artificial Sequence
  Description of Artificial Sequence: Synthetic polypeptide
  XENP018825 1G6_H1_L1.79_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRWTGVPDRFTGSGYGTEFTLTISSLQSEDFAVYFCQQDYSSPRTFGGGTKVEIK

SEQ ID NO: 13880 - protein, 122 aa, Artificial Sequence; identical to SEQ ID NO: 10922
  Description of Artificial Sequence: Synthetic polypeptide
  VH of XENP018825

SEQ ID NO: 13881 - protein, 107 aa, Artificial Sequence
  Description of Artificial Sequence: Synthetic polypeptide
  VL of XENP018825
SIVMTQSPATLSVSPGERATLSCRASQSVSNDVAWYQQKPGQSPRLLINYASHRWTGVPDRFTGSGYGTEFTLTISSLQSEDFAVYFCQQDYSSPRTFGGGTKVEIK

SEQ ID NO: 13882 - protein, 5 aa, Artificial Sequence
  Description of Artificial Sequence: Synthetic peptide
  XENP018825 vhCDR1
NYWMN

SEQ ID NO: 13883 - protein, 19 aa, Artificial Sequence
  Description of Artificial Sequence: Synthetic peptide
  XENP018825 vhCDR2
EIRLKSNNYATHYAEPVKG

SEQ ID NO: 13884 - protein, 11 aa, Artificial Sequence
  Description of Artificial Sequence: Synthetic peptide
  XENP018825 vhCDR3
YYGNYGGYFDV

SEQ ID NO: 13885 - protein, 11 aa, Artificial Sequence
  Description of Artificial Sequence: Synthetic peptide
  XENP018825 vlCDR1
RASQSVSNDVA

SEQ ID NO: 13886 - protein, 7 aa, Artificial Sequence
  Description of Artificial Sequence: Synthetic peptide
  XENP018825 vlCDR2
YASHRWT

SEQ ID NO: 13887 - protein, 9 aa, Artificial Sequence
  Description of Artificial Sequence: Synthetic peptide
  XENP018825 vlCDR3
QQDYSSPRT

SEQ ID NO: 13888 - protein, 249 aa, Artificial Sequence
  Description of Artificial Sequence: Synthetic polypeptide
  XENP018826 1G6_H1_L1.80_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRVTGVPDRFTGSGYGTEFTLTISSLQSEDFAVYFCQQDYSSPRTFGGGTKVEIK

SEQ ID NO: 13889 - protein, 122 aa, Artificial Sequence; identical to SEQ ID NO: 10922
  Description of Artificial Sequence: Synthetic polypeptide
  VH of XENP018826

SEQ ID NO: 13890 - protein, 107 aa, Artificial Sequence
  Description of Artificial Sequence: Synthetic polypeptide
  VL of XENP018826
SIVMTQSPATLSVSPGERATLSCRASQSVSNDVAWYQQKPGQSPRLLINYASHRVTGVPDRFTGSGYGTEFTLTISSLQSEDFAVYFCQQDYSSPRTFGGGTKVEIK

SEQ ID NO: 13891 - protein, 5 aa, Artificial Sequence
  Description of Artificial Sequence: Synthetic peptide
  XENP018826 vhCDR1
NYWMN

SEQ ID NO: 13892 - protein, 19 aa, Artificial Sequence
  Description of Artificial Sequence: Synthetic peptide
  XENP018826 vhCDR2
EIRLKSNNYATHYAEPVKG

SEQ ID NO: 13893 - protein, 11 aa, Artificial Sequence
  Description of Artificial Sequence: Synthetic peptide
  XENP018826 vhCDR3
YYGNYGGYFDV

SEQ ID NO: 13894 - protein, 11 aa, Artificial Sequence
  Description of Artificial Sequence: Synthetic peptide
  XENP018826 vlCDR1
RASQSVSNDVA

SEQ ID NO: 13895 - protein, 7 aa, Artificial Sequence
  Description of Artificial Sequence: Synthetic peptide
  XENP018826 vlCDR2
YASHRVT

SEQ ID NO: 13896 - protein, 9 aa, Artificial Sequence
  Description of Artificial Sequence: Synthetic peptide
  XENP018826 vlCDR3
QQDYSSPRT

SEQ ID NO: 13897 - protein, 249 aa, Artificial Sequence
  Description of Artificial Sequence: Synthetic polypeptide
  XENP018827 1G6_H1_L1.81_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRATGVPDRFTGSGYGTEFTLTISSLQSEDFAVYFCQQDYSSPRTFGGGTKVEIK

SEQ ID NO: 13898 - protein, 122 aa, Artificial Sequence; identical to SEQ ID NO: 10922
  Description of Artificial Sequence: Synthetic polypeptide
  VH of XENP018827

SEQ ID NO: 13899 - protein, 107 aa, Artificial Sequence
  Description of Artificial Sequence: Synthetic polypeptide
  VL of XENP018827
SIVMTQSPATLSVSPGERATLSCRASQSVSNDVAWYQQKPGQSPRLLINYASHRATGVPDRFTGSGYGTEFTLTISSLQSEDFAVYFCQQDYSSPRTFGGGTKVEIK

SEQ ID NO: 13900 - protein, 5 aa, Artificial Sequence
  Description of Artificial Sequence: Synthetic peptide
  XENP018827 vhCDR1
NYWMN

SEQ ID NO: 13901 - protein, 19 aa, Artificial Sequence
  Description of Artificial Sequence: Synthetic peptide
  XENP018827 vhCDR2
EIRLKSNNYATHYAEPVKG

SEQ ID NO: 13902 - protein, 11 aa, Artificial Sequence
  Description of Artificial Sequence: Synthetic peptide
  XENP018827 vhCDR3
YYGNYGGYFDV

SEQ ID NO: 13903 - protein, 11 aa, Artificial Sequence
  Description of Artificial Sequence: Synthetic peptide
  XENP018827 vlCDR1
RASQSVSNDVA

SEQ ID NO: 13904 - protein, 7 aa, Artificial Sequence
  Description of Artificial Sequence: Synthetic peptide
  XENP018827 vlCDR2
YASHRAT

SEQ ID NO: 13905 - protein, 9 aa, Artificial Sequence
  Description of Artificial Sequence: Synthetic peptide
  XENP018827 vlCDR3
QQDYSSPRT

SEQ ID NO: 13906 - protein, 249 aa, Artificial Sequence
  Description of Artificial Sequence: Synthetic polypeptide
  XENP018828 1G6_H1_L1.82_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRQTGVPDRFTGSGYGTEFTLTISSLQSEDFAVYFCQQDYSSPRTFGGGTKVEIK

SEQ ID NO: 13907 - protein, 122 aa, Artificial Sequence; identical to SEQ ID NO: 10922
  Description of Artificial Sequence: Synthetic polypeptide
  VH of XENP018828

SEQ ID NO: 13908 - protein, 107 aa, Artificial Sequence
  Description of Artificial Sequence: Synthetic polypeptide
  VL of XENP018828
SIVMTQSPATLSVSPGERATLSCRASQSVSNDVAWYQQKPGQSPRLLINYASHRQTGVPDRFTGSGYGTEFTLTISSLQSEDFAVYFCQQDYSSPRTFGGGTKVEIK

SEQ ID NO: 13909 - protein, 5 aa, Artificial Sequence
  Description of Artificial Sequence: Synthetic peptide
  XENP018828 vhCDR1
NYWMN

SEQ ID NO: 13910 - protein, 19 aa, Artificial Sequence
  Description of Artificial Sequence: Synthetic peptide
  XENP018828 vhCDR2
EIRLKSNNYATHYAEPVKG

SEQ ID NO: 13911 - protein, 11 aa, Artificial Sequence
  Description of Artificial Sequence: Synthetic peptide
  XENP018828 vhCDR3
YYGNYGGYFDV

SEQ ID NO: 13912 - protein, 11 aa, Artificial Sequence
  Description of Artificial Sequence: Synthetic peptide
  XENP018828 vlCDR1
RASQSVSNDVA

SEQ ID NO: 13913 - protein, 7 aa, Artificial Sequence
  Description of Artificial Sequence: Synthetic peptide
  XENP018828 vlCDR2
YASHRQT

SEQ ID NO: 13914 - protein, 9 aa, Artificial Sequence
  Description of Artificial Sequence: Synthetic peptide
  XENP018828 vlCDR3
QQDYSSPRT

SEQ ID NO: 13915 - protein, 249 aa, Artificial Sequence
  Description of Artificial Sequence: Synthetic polypeptide
  XENP018829 1G6_H1_L1.83_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRDTGVPDRFTGSGYGTEFTLTISSLQSEDFAVYFCQQDYSSPRTFGGGTKVEIK

SEQ ID NO: 13916 - protein, 122 aa, Artificial Sequence; identical to SEQ ID NO: 10922
  Description of Artificial Sequence: Synthetic polypeptide
  VH of XENP018829

SEQ ID NO: 13917 - protein, 107 aa, Artificial Sequence
  Description of Artificial Sequence: Synthetic polypeptide
  VL of XENP018829
SIVMTQSPATLSVSPGERATLSCRASQSVSNDVAWYQQKPGQSPRLLINYASHRDTGVPDRFTGSGYGTEFTLTISSLQSEDFAVYFCQQDYSSPRTFGGGTKVEIK

SEQ ID NO: 13918 - protein, 5 aa, Artificial Sequence
  Description of Artificial Sequence: Synthetic peptide
  XENP018829 vhCDR1
NYWMN

SEQ ID NO: 13919 - protein, 19 aa, Artificial Sequence
  Description of Artificial Sequence: Synthetic peptide
  XENP018829 vhCDR2
EIRLKSNNYATHYAEPVKG

SEQ ID NO: 13920 - protein, 11 aa, Artificial Sequence
  Description of Artificial Sequence: Synthetic peptide
  XENP018829 vhCDR3
YYGNYGGYFDV

SEQ ID NO: 13921 - protein, 11 aa, Artificial Sequence
  Description of Artificial Sequence: Synthetic peptide
  XENP018829 vlCDR1
RASQSVSNDVA

SEQ ID NO: 13922 - protein, 7 aa, Artificial Sequence
  Description of Artificial Sequence: Synthetic peptide
  XENP018829 vlCDR2
YASHRDT

SEQ ID NO: 13923 - protein, 9 aa, Artificial Sequence
  Description of Artificial Sequence: Synthetic peptide
  XENP018829 vlCDR3
QQDYSSPRT

SEQ ID NO: 13924 - protein, 249 aa, Artificial Sequence
  Description of Artificial Sequence: Synthetic polypeptide
  XENP018830 1G6_H1_L1.84_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRKTGVPDRFTGSGYGTEFTLTISSLQSEDFAVYFCQQDYSSPRTFGGGTKVEIK

SEQ ID NO: 13925 - protein, 122 aa, Artificial Sequence; identical to SEQ ID NO: 10922
  Description of Artificial Sequence: Synthetic polypeptide
  VH of XENP018830

SEQ ID NO: 13926 - protein, 107 aa, Artificial Sequence
  Description of Artificial Sequence: Synthetic polypeptide
  VL of XENP018830
SIVMTQSPATLSVSPGERATLSCRASQSVSNDVAWYQQKPGQSPRLLINYASHRKTGVPDRFTGSGYGTEFTLTISSLQSEDFAVYFCQQDYSSPRTFGGGTKVEIK

SEQ ID NO: 13927 - protein, 5 aa, Artificial Sequence
  Description of Artificial Sequence: Synthetic peptide
  XENP018830 vhCDR1
NYWMN

SEQ ID NO: 13928 - protein, 19 aa, Artificial Sequence
  Description of Artificial Sequence: Synthetic peptide
  XENP018830 vhCDR2
EIRLKSNNYATHYAEPVKG

SEQ ID NO: 13929 - protein, 11 aa, Artificial Sequence
  Description of Artificial Sequence: Synthetic peptide
  XENP018830 vhCDR3
YYGNYGGYFDV

SEQ ID NO: 13930 - protein, 11 aa, Artificial Sequence
  Description of Artificial Sequence: Synthetic peptide
  XENP018830 vlCDR1
RASQSVSNDVA

SEQ ID NO: 13931 - protein, 7 aa, Artificial Sequence
  Description of Artificial Sequence: Synthetic peptide
  XENP018830 vlCDR2
YASHRKT

SEQ ID NO: 13932 - protein, 9 aa, Artificial Sequence
  Description of Artificial Sequence: Synthetic peptide
  XENP018830 vlCDR3
QQDYSSPRT

SEQ ID NO: 13933 - protein, 249 aa, Artificial Sequence
  Description of Artificial Sequence: Synthetic polypeptide
  XENP018831 1G6_H1_L1.85_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYVGVPDRFTGSGYGTEFTLTISSLQSEDFAVYFCQQDYSSPRTFGGGTKVEIK

SEQ ID NO: 13934 - protein, 122 aa, Artificial Sequence; identical to SEQ ID NO: 10922
  Description of Artificial Sequence: Synthetic polypeptide
  VH of XENP018831

SEQ ID NO: 13935 - protein, 107 aa, Artificial Sequence
  Description of Artificial Sequence: Synthetic polypeptide
  VL of XENP018831
SIVMTQSPATLSVSPGERATLSCRASQSVSNDVAWYQQKPGQSPRLLINYASHRYVGVPDRFTGSGYGTEFTLTISSLQSEDFAVYFCQQDYSSPRTFGGGTKVEIK

SEQ ID NO: 13936 - protein, 5 aa, Artificial Sequence
  Description of Artificial Sequence: Synthetic peptide
  XENP018831 vhCDR1
NYWMN

SEQ ID NO: 13937 - protein, 19 aa, Artificial Sequence
  Description of Artificial Sequence: Synthetic peptide
  XENP018831 vhCDR2
EIRLKSNNYATHYAEPVKG

SEQ ID NO: 13938 - protein, 11 aa, Artificial Sequence
  Description of Artificial Sequence: Synthetic peptide
  XENP018831 vhCDR3
YYGNYGGYFDV

SEQ ID NO: 13939 - protein, 11 aa, Artificial Sequence
  Description of Artificial Sequence: Synthetic peptide
  XENP018831 vlCDR1
RASQSVSNDVA

SEQ ID NO: 13940 - protein, 7 aa, Artificial Sequence
  Description of Artificial Sequence: Synthetic peptide
  XENP018831 vlCDR2
YASHRYV

SEQ ID NO: 13941 - protein, 9 aa, Artificial Sequence
  Description of Artificial Sequence: Synthetic peptide
  XENP018831 vlCDR3
QQDYSSPRT

SEQ ID NO: 13942 - protein, 249 aa, Artificial Sequence
  Description of Artificial Sequence: Synthetic polypeptide
  XENP018832 1G6_H1_L1.86_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYSGVPDRFTGSGYGTEFTLTISSLQSEDFAVYFCQQDYSSPRTFGGGTKVEIK

SEQ ID NO: 13943 - protein, 122 aa, Artificial Sequence; identical to SEQ ID NO: 10922
  Description of Artificial Sequence: Synthetic polypeptide
  VH of XENP018832

SEQ ID NO: 13944 - protein, 107 aa, Artificial Sequence
  Description of Artificial Sequence: Synthetic polypeptide
  VL of XENP018832
SIVMTQSPATLSVSPGERATLSCRASQSVSNDVAWYQQKPGQSPRLLINYASHRYSGVPDRFTGSGYGTEFTLTISSLQSEDFAVYFCQQDYSSPRTFGGGTKVEIK

SEQ ID NO: 13945 - protein, 5 aa, Artificial Sequence
  Description of Artificial Sequence: Synthetic peptide
  XENP018832 vhCDR1
NYWMN

SEQ ID NO: 13946 - protein, 19 aa, Artificial Sequence
  Description of Artificial Sequence: Synthetic peptide
  XENP018832 vhCDR2
EIRLKSNNYATHYAEPVKG

SEQ ID NO: 13947 - protein, 11 aa, Artificial Sequence
  Description of Artificial Sequence: Synthetic peptide
  XENP018832 vhCDR3
YYGNYGGYFDV

SEQ ID NO: 13948 - protein, 11 aa, Artificial Sequence
  Description of Artificial Sequence: Synthetic peptide
  XENP018832 vlCDR1
RASQSVSNDVA

SEQ ID NO: 13949 - protein, 7 aa, Artificial Sequence
  Description of Artificial Sequence: Synthetic peptide
  XENP018832 vlCDR2
YASHRYS

SEQ ID NO: 13950 - protein, 9 aa, Artificial Sequence
  Description of Artificial Sequence: Synthetic peptide
  XENP018832 vlCDR3
QQDYSSPRT

SEQ ID NO: 13951 - protein, 249 aa, Artificial Sequence
  Description of Artificial Sequence: Synthetic polypeptide
  XENP018833 1G6_H1_L1.87_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYAGVPDRFTGSGYGTEFTLTISSLQSEDFAVYFCQQDYSSPRTFGGGTKVEIK

SEQ ID NO: 13952 - protein, 122 aa, Artificial Sequence; identical to SEQ ID NO: 10922
  Description of Artificial Sequence: Synthetic polypeptide
  VH of XENP018833

SEQ ID NO: 13953 - protein, 107 aa, Artificial Sequence
  Description of Artificial Sequence: Synthetic polypeptide
  VL of XENP018833
SIVMTQSPATLSVSPGERATLSCRASQSVSNDVAWYQQKPGQSPRLLINYASHRYAGVPDRFTGSGYGTEFTLTISSLQSEDFAVYFCQQDYSSPRTFGGGTKVEIK

SEQ ID NO: 13954 - protein, 5 aa, Artificial Sequence
  Description of Artificial Sequence: Synthetic peptide
  XENP018833 vhCDR1
NYWMN

SEQ ID NO: 13955 - protein, 19 aa, Artificial Sequence
  Description of Artificial Sequence: Synthetic peptide
  XENP018833 vhCDR2
EIRLKSNNYATHYAEPVKG

SEQ ID NO: 13956 - protein, 11 aa, Artificial Sequence
  Description of Artificial Sequence: Synthetic peptide
  XENP018833 vhCDR3
YYGNYGGYFDV

SEQ ID NO: 13957 - protein, 11 aa, Artificial Sequence
  Description of Artificial Sequence: Synthetic peptide
  XENP018833 vlCDR1
RASQSVSNDVA

SEQ ID NO: 13958 - protein, 7 aa, Artificial Sequence
  Description of Artificial Sequence: Synthetic peptide
  XENP018833 vlCDR2
YASHRYA

SEQ ID NO: 13959 - protein, 9 aa, Artificial Sequence
  Description of Artificial Sequence: Synthetic peptide
  XENP018833 vlCDR3
QQDYSSPRT

SEQ ID NO: 13960 - protein, 249 aa, Artificial Sequence
  Description of Artificial Sequence: Synthetic polypeptide
  XENP018834 1G6_H1_L1.88_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYIGVPDRFTGSGYGTEFTLTISSLQSEDFAVYFCQQDYSSPRTFGGGTKVEIK

SEQ ID NO: 13961 - protein, 122 aa, Artificial Sequence; identical to SEQ ID NO: 10922
  Description of Artificial Sequence: Synthetic polypeptide
  VH of XENP018834

SEQ ID NO: 13962 - protein, 107 aa, Artificial Sequence
  Description of Artificial Sequence: Synthetic polypeptide
  VL of XENP018834
SIVMTQSPATLSVSPGERATLSCRASQSVSNDVAWYQQKPGQSPRLLINYASHRYIGVPDRFTGSGYGTEFTLTISSLQSEDFAVYFCQQDYSSPRTFGGGTKVEIK

SEQ ID NO: 13963 - protein, 5 aa, Artificial Sequence
  Description of Artificial Sequence: Synthetic peptide
  XENP018834 vhCDR1
NYWMN

SEQ ID NO: 13964 - protein, 19 aa, Artificial Sequence
  Description of Artificial Sequence: Synthetic peptide
  XENP018834 vhCDR2
EIRLKSNNYATHYAEPVKG

SEQ ID NO: 13965 - protein, 11 aa, Artificial Sequence
  Description of Artificial Sequence: Synthetic peptide
  XENP018834 vhCDR3
YYGNYGGYFDV

SEQ ID NO: 13966 - protein, 11 aa, Artificial Sequence
  Description of Artificial Sequence: Synthetic peptide
  XENP018834 vlCDR1
RASQSVSNDVA

SEQ ID NO: 13967 - protein, 7 aa, Artificial Sequence
  Description of Artificial Sequence: Synthetic peptide
  XENP018834 vlCDR2
YASHRYI

SEQ ID NO: 13968 - protein, 9 aa, Artificial Sequence
  Description of Artificial Sequence: Synthetic peptide
  XENP018834 vlCDR3
QQDYSSPRT

SEQ ID NO: 13969 - protein, 249 aa, Artificial Sequence
  Description of Artificial Sequence: Synthetic polypeptide
  XENP018835 1G6_H1_L1.89_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYQGVPDRFTGSGYGTEFTLTISSLQSEDFAVYFCQQDYSSPRTFGGGTKVEIK

SEQ ID NO: 13970 - protein, 122 aa, Artificial Sequence; identical to SEQ ID NO: 10922
  Description of Artificial Sequence: Synthetic polypeptide
  VH of XENP018835

SEQ ID NO: 13971 - protein, 107 aa, Artificial Sequence
  Description of Artificial Sequence: Synthetic polypeptide
  VL of XENP018835
SIVMTQSPATLSVSPGERATLSCRASQSVSNDVAWYQQKPGQSPRLLINYASHRYQGVPDRFTGSGYGTEFTLTISSLQSEDFAVYFCQQDYSSPRTFGGGTKVEIK

SEQ ID NO: 13972 - protein, 5 aa, Artificial Sequence
  Description of Artificial Sequence: Synthetic peptide
  XENP018835 vhCDR1
NYWMN

SEQ ID NO: 13973 - protein, 19 aa, Artificial Sequence
  Description of Artificial Sequence: Synthetic peptide
  XENP018835 vhCDR2
EIRLKSNNYATHYAEPVKG

SEQ ID NO: 13974 - protein, 11 aa, Artificial Sequence
  Description of Artificial Sequence: Synthetic peptide
  XENP018835 vhCDR3
YYGNYGGYFDV

SEQ ID NO: 13975 - protein, 11 aa, Artificial Sequence
  Description of Artificial Sequence: Synthetic peptide
  XENP018835 vlCDR1
RASQSVSNDVA

SEQ ID NO: 13976 - protein, 7 aa, Artificial Sequence
  Description of Artificial Sequence: Synthetic peptide
  XENP018835 vlCDR2
YASHRYQ

SEQ ID NO: 13977 - protein, 9 aa, Artificial Sequence
  Description of Artificial Sequence: Synthetic peptide
  XENP018835 vlCDR3
QQDYSSPRT

SEQ ID NO: 13978 - protein, 249 aa, Artificial Sequence
  Description of Artificial Sequence: Synthetic polypeptide
  XENP018836 1G6_H1_L1.90_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYHGVPDRFTGSGYGTEFTLTISSLQSEDFAVYFCQQDYSSPRTFGGGTKVEIK

SEQ ID NO: 13979 - protein, 122 aa, Artificial Sequence; identical to SEQ ID NO: 10922
  Description of Artificial Sequence: Synthetic polypeptide
  VH of XENP018836

SEQ ID NO: 13980 - protein, 107 aa, Artificial Sequence
  Description of Artificial Sequence: Synthetic polypeptide
  VL of XENP018836
SIVMTQSPATLSVSPGERATLSCRASQSVSNDVAWYQQKPGQSPRLLINYASHRYHGVPDRFTGSGYGTEFTLTISSLQSEDFAVYFCQQDYSSPRTFGGGTKVEIK

SEQ ID NO: 13981 - protein, 5 aa, Artificial Sequence
  Description of Artificial Sequence: Synthetic peptide
  XENP018836 vhCDR1
NYWMN

SEQ ID NO: 13982 - protein, 19 aa, Artificial Sequence
  Description of Artificial Sequence: Synthetic peptide
  XENP018836 vhCDR2
EIRLKSNNYATHYAEPVKG

SEQ ID NO: 13983 - protein, 11 aa, Artificial Sequence
  Description of Artificial Sequence: Synthetic peptide
  XENP018836 vhCDR3
YYGNYGGYFDV

SEQ ID NO: 13984 - protein, 11 aa, Artificial Sequence
  Description of Artificial Sequence: Synthetic peptide
  XENP018836 vlCDR1
RASQSVSNDVA

SEQ ID NO: 13985 - protein, 7 aa, Artificial Sequence
  Description of Artificial Sequence: Synthetic peptide
  XENP018836 vlCDR2
YASHRYH

SEQ ID NO: 13986 - protein, 9 aa, Artificial Sequence
  Description of Artificial Sequence: Synthetic peptide
  XENP018836 vlCDR3
QQDYSSPRT

SEQ ID NO: 13987 - protein, 249 aa, Artificial Sequence
  Description of Artificial Sequence: Synthetic polypeptide
  XENP018837 1G6_H1_L1.91_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYDGVPDRFTGSGYGTEFTLTISSLQSEDFAVYFCQQDYSSPRTFGGGTKVEIK

SEQ ID NO: 13988 - protein, 122 aa, Artificial Sequence; identical to SEQ ID NO: 10922
  Description of Artificial Sequence: Synthetic polypeptide
  VH of XENP018837

SEQ ID NO: 13989 - protein, 107 aa, Artificial Sequence
  Description of Artificial Sequence: Synthetic polypeptide
  VL of XENP018837
SIVMTQSPATLSVSPGERATLSCRASQSVSNDVAWYQQKPGQSPRLLINYASHRYDGVPDRFTGSGYGTEFTLTISSLQSEDFAVYFCQQDYSSPRTFGGGTKVEIK

SEQ ID NO: 13990 - protein, 5 aa, Artificial Sequence
  Description of Artificial Sequence: Synthetic peptide
  XENP018837 vhCDR1
NYWMN

SEQ ID NO: 13991 - protein, 19 aa, Artificial Sequence
  Description of Artificial Sequence: Synthetic peptide
  XENP018837 vhCDR2
EIRLKSNNYATHYAEPVKG

SEQ ID NO: 13992 - protein, 11 aa, Artificial Sequence
  Description of Artificial Sequence: Synthetic peptide
  XENP018837 vhCDR3
YYGNYGGYFDV

SEQ ID NO: 13993 - protein, 11 aa, Artificial Sequence
  Description of Artificial Sequence: Synthetic peptide
  XENP018837 vlCDR1
RASQSVSNDVA

SEQ ID NO: 13994 - protein, 7 aa, Artificial Sequence
  Description of Artificial Sequence: Synthetic peptide
  XENP018837 vlCDR2
YASHRYD

SEQ ID NO: 13995 - protein, 9 aa, Artificial Sequence
  Description of Artificial Sequence: Synthetic peptide
  XENP018837 vlCDR3
QQDYSSPRT

SEQ ID NO: 13996 - protein, 249 aa, Artificial Sequence
  Description of Artificial Sequence: Synthetic polypeptide
  XENP018838 1G6_H1_L1.92_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYKGVPDRFTGSGYGTEFTLTISSLQSEDFAVYFCQQDYSSPRTFGGGTKVEIK

SEQ ID NO: 13997 - protein, 122 aa, Artificial Sequence; identical to SEQ ID NO: 10922
  Description of Artificial Sequence: Synthetic polypeptide
  VH of XENP018838

SEQ ID NO: 13998 - protein, 107 aa, Artificial Sequence
  Description of Artificial Sequence: Synthetic polypeptide
  VL of XENP018838
SIVMTQSPATLSVSPGERATLSCRASQSVSNDVAWYQQKPGQSPRLLINYASHRYKGVPDRFTGSGYGTEFTLTISSLQSEDFAVYFCQQDYSSPRTFGGGTKVEIK

SEQ ID NO: 13999 - protein, 5 aa, Artificial Sequence
  Description of Artificial Sequence: Synthetic peptide
  XENP018838 vhCDR1
NYWMN

SEQ ID NO: 14000 - protein, 19 aa, Artificial Sequence
  Description of Artificial Sequence: Synthetic peptide
  XENP018838 vhCDR2
EIRLKSNNYATHYAEPVKG

SEQ ID NO: 14001 - protein, 11 aa, Artificial Sequence
  Description of Artificial Sequence: Synthetic peptide
  XENP018838 vhCDR3
YYGNYGGYFDV

SEQ ID NO: 14002 - protein, 11 aa, Artificial Sequence
  Description of Artificial Sequence: Synthetic peptide
  XENP018838 vlCDR1
RASQSVSNDVA

SEQ ID NO: 14003 - protein, 7 aa, Artificial Sequence
  Description of Artificial Sequence: Synthetic peptide
  XENP018838 vlCDR2
YASHRYK

SEQ ID NO: 14004 - protein, 9 aa, Artificial Sequence
  Description of Artificial Sequence: Synthetic peptide
  XENP018838 vlCDR3
QQDYSSPRT

SEQ ID NO: 14005 - protein, 249 aa, Artificial Sequence
  Description of Artificial Sequence: Synthetic polypeptide
  XENP018839 1G6_H1_L1.93_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYYGVPDRFTGSGYGTEFTLTISSLQSEDFAVYFCQQDYSSPRTFGGGTKVEIK

SEQ ID NO: 14006 - protein, 122 aa, Artificial Sequence; identical to SEQ ID NO: 10922
  Description of Artificial Sequence: Synthetic polypeptide
  VH of XENP018839

SEQ ID NO: 14007 - protein, 107 aa, Artificial Sequence
  Description of Artificial Sequence: Synthetic polypeptide
  VL of XENP018839
SIVMTQSPATLSVSPGERATLSCRASQSVSNDVAWYQQKPGQSPRLLINYASHRYYGVPDRFTGSGYGTEFTLTISSLQSEDFAVYFCQQDYSSPRTFGGGTKVEIK

SEQ ID NO: 14008 - protein, 5 aa, Artificial Sequence
  Description of Artificial Sequence: Synthetic peptide
  XENP018839 vhCDR1
NYWMN

SEQ ID NO: 14009 - protein, 19 aa, Artificial Sequence
  Description of Artificial Sequence: Synthetic peptide
  XENP018839 vhCDR2
EIRLKSNNYATHYAEPVKG

SEQ ID NO: 14010 - protein, 11 aa, Artificial Sequence
  Description of Artificial Sequence: Synthetic peptide
  XENP018839 vhCDR3
YYGNYGGYFDV

SEQ ID NO: 14011 - protein, 11 aa, Artificial Sequence
  Description of Artificial Sequence: Synthetic peptide
  XENP018839 vlCDR1
RASQSVSNDVA

SEQ ID NO: 14012 - protein, 7 aa, Artificial Sequence
  Description of Artificial Sequence: Synthetic peptide
  XENP018839 vlCDR2
YASHRYY

SEQ ID NO: 14013 - protein, 9 aa, Artificial Sequence
  Description of Artificial Sequence: Synthetic peptide
  XENP018839 vlCDR3
QQDYSSPRT

SEQ ID NO: 14014 - protein, 249 aa, Artificial Sequence
  Description of Artificial Sequence: Synthetic polypeptide
  XENP018840 1G6_H1_L1.94_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTSVPDRFTGSGYGTEFTLTISSLQSEDFAVYFCQQDYSSPRTFGGGTKVEIK

SEQ ID NO: 14015 - protein, 122 aa, Artificial Sequence; identical to SEQ ID NO: 10922
  Description of Artificial Sequence: Synthetic polypeptide
  VH of XENP018840

SEQ ID NO: 14016 - protein, 107 aa, Artificial Sequence
  Description of Artificial Sequence: Synthetic polypeptide
  VL of XENP018840
SIVMTQSPATLSVSPGERATLSCRASQSVSNDVAWYQQKPGQSPRLLINYASHRYTSVPDRFTGSGYGTEFTLTISSLQSEDFAVYFCQQDYSSPRTFGGGTKVEIK

SEQ ID NO: 14017 - protein, 5 aa, Artificial Sequence
  Description of Artificial Sequence: Synthetic peptide
  XENP018840 vhCDR1
NYWMN

SEQ ID NO: 14018 - protein, 19 aa, Artificial Sequence
  Description of Artificial Sequence: Synthetic peptide
  XENP018840 vhCDR2
EIRLKSNNYATHYAEPVKG

SEQ ID NO: 14019 - protein, 11 aa, Artificial Sequence
  Description of Artificial Sequence: Synthetic peptide
  XENP018840 vhCDR3
YYGNYGGYFDV

SEQ ID NO: 14020 - protein, 11 aa, Artificial Sequence
  Description of Artificial Sequence: Synthetic peptide
  XENP018840 vlCDR1
RASQSVSNDVA

SEQ ID NO: 14021 - protein, 7 aa, Artificial Sequence
  Description of Artificial Sequence: Synthetic peptide
  XENP018840 vlCDR2
YASHRYT

SEQ ID NO: 14022 - protein, 9 aa, Artificial Sequence
  Description of Artificial Sequence: Synthetic peptide
  XENP018840 vlCDR3
QQDYSSPRT

SEQ ID NO: 14023 - protein, 249 aa, Artificial Sequence
  Description of Artificial Sequence: Synthetic polypeptide
  XENP018841 1G6_H1_L1.95_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGIPDRFTGSGYGTEFTLTISSLQSEDFAVYFCQQDYSSPRTFGGGTKVEIK

SEQ ID NO: 14024 - protein, 122 aa, Artificial Sequence; identical to SEQ ID NO: 10922
  Description of Artificial Sequence: Synthetic polypeptide
  VH of XENP018841

SEQ ID NO: 14025 - protein, 107 aa, Artificial Sequence
  Description of Artificial Sequence: Synthetic polypeptide
  VL of XENP018841
SIVMTQSPATLSVSPGERATLSCRASQSVSNDVAWYQQKPGQSPRLLINYASHRYTGIPDRFTGSGYGTEFTLTISSLQSEDFAVYFCQQDYSSPRTFGGGTKVEIK

SEQ ID NO: 14026 - protein, 5 aa, Artificial Sequence
  Description of Artificial Sequence: Synthetic peptide
  XENP018841 vhCDR1
NYWMN

SEQ ID NO: 14027 - protein, 19 aa, Artificial Sequence
  Description of Artificial Sequence: Synthetic peptide
  XENP018841 vhCDR2
EIRLKSNNYATHYAEPVKG

SEQ ID NO: 14028 - protein, 11 aa, Artificial Sequence
  Description of Artificial Sequence: Synthetic peptide
  XENP018841 vhCDR3
YYGNYGGYFDV

SEQ ID NO: 14029 - protein, 11 aa, Artificial Sequence
  Description of Artificial Sequence: Synthetic peptide
  XENP018841 vlCDR1
RASQSVSNDVA

SEQ ID NO: 14030 - protein, 7 aa, Artificial Sequence
  Description of Artificial Sequence: Synthetic peptide
  XENP018841 vlCDR2
YASHRYT

SEQ ID NO: 14031 - protein, 9 aa, Artificial Sequence
  Description of Artificial Sequence: Synthetic peptide
  XENP018841 vlCDR3
QQDYSSPRT

SEQ ID NO: 14032 - protein, 249 aa, Artificial Sequence
  Description of Artificial Sequence: Synthetic polypeptide
  XENP018842 1G6_H1_L1.96_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPARFTGSGYGTEFTLTISSLQSEDFAVYFCQQDYSSPRTFGGGTKVEIK

SEQ ID NO: 14033 - protein, 122 aa, Artificial Sequence; identical to SEQ ID NO: 10922
  Description of Artificial Sequence: Synthetic polypeptide
  VH of XENP018842

SEQ ID NO: 14034 - protein, 107 aa, Artificial Sequence
  Description of Artificial Sequence: Synthetic polypeptide
  VL of XENP018842
SIVMTQSPATLSVSPGERATLSCRASQSVSNDVAWYQQKPGQSPRLLINYASHRYTGVPARFTGSGYGTEFTLTISSLQSEDFAVYFCQQDYSSPRTFGGGTKVEIK

SEQ ID NO: 14035 - protein, 5 aa, Artificial Sequence
  Description of Artificial Sequence: Synthetic peptide
  XENP018842 vhCDR1
NYWMN

SEQ ID NO: 14036 - protein, 19 aa, Artificial Sequence
  Description of Artificial Sequence: Synthetic peptide
  XENP018842 vhCDR2
EIRLKSNNYATHYAEPVKG

SEQ ID NO: 14037 - protein, 11 aa, Artificial Sequence
  Description of Artificial Sequence: Synthetic peptide
  XENP018842 vhCDR3
YYGNYGGYFDV

SEQ ID NO: 14038 - protein, 11 aa, Artificial Sequence
  Description of Artificial Sequence: Synthetic peptide
  XENP018842 vlCDR1
RASQSVSNDVA

SEQ ID NO: 14039 - protein, 7 aa, Artificial Sequence
  Description of Artificial Sequence: Synthetic peptide
  XENP018842 vlCDR2
YASHRYT

SEQ ID NO: 14040 - protein, 9 aa, Artificial Sequence
  Description of Artificial Sequence: Synthetic peptide
  XENP018842 vlCDR3
QQDYSSPRT

SEQ ID NO: 14041 - protein, 249 aa, Artificial Sequence
  Description of Artificial Sequence: Synthetic polypeptide
  XENP018843 1G6_H1_L1.97_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFSGSGYGTEFTLTISSLQSEDFAVYFCQQDYSSPRTFGGGTKVEIK

SEQ ID NO: 14042 - protein, 122 aa, Artificial Sequence; identical to SEQ ID NO: 10922
  Description of Artificial Sequence: Synthetic polypeptide
  VH of XENP018843

SEQ ID NO: 14043 - protein, 107 aa, Artificial Sequence
  Description of Artificial Sequence: Synthetic polypeptide
  VL of XENP018843
SIVMTQSPATLSVSPGERATLSCRASQSVSNDVAWYQQKPGQSPRLLINYASHRYTGVPDRFSGSGYGTEFTLTISSLQSEDFAVYFCQQDYSSPRTFGGGTKVEIK

SEQ ID NO: 14044 - protein, 5 aa, Artificial Sequence
  Description of Artificial Sequence: Synthetic peptide
  XENP018843 vhCDR1
NYWMN

SEQ ID NO: 14045 - protein, 19 aa, Artificial Sequence
  Description of Artificial Sequence: Synthetic peptide
  XENP018843 vhCDR2
EIRLKSNNYATHYAEPVKG

SEQ ID NO: 14046 - protein, 11 aa, Artificial Sequence
  Description of Artificial Sequence: Synthetic peptide
  XENP018843 vhCDR3
YYGNYGGYFDV

SEQ ID NO: 14047 - protein, 11 aa, Artificial Sequence
  Description of Artificial Sequence: Synthetic peptide
  XENP018843 vlCDR1
RASQSVSNDVA

SEQ ID NO: 14048 - protein, 7 aa, Artificial Sequence
  Description of Artificial Sequence: Synthetic peptide
  XENP018843 vlCDR2
YASHRYT

SEQ ID NO: 14049 - protein, 9 aa, Artificial Sequence
  Description of Artificial Sequence: Synthetic peptide
  XENP018843 vlCDR3
QQDYSSPRT

SEQ ID NO: 14050 - protein, 249 aa, Artificial Sequence
  Description of Artificial Sequence: Synthetic polypeptide
  XENP018844 1G6_H1_L1.98_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGSGTEFTLTISSLQSEDFAVYFCQQDYSSPRTFGGGTKVEIK

SEQ ID NO: 14051 - protein, 122 aa, Artificial Sequence; identical to SEQ ID NO: 10922
  Description of Artificial Sequence: Synthetic polypeptide
  VH of XENP018844

SEQ ID NO: 14052 - protein, 107 aa, Artificial Sequence
  Description of Artificial Sequence: Synthetic polypeptide
  VL of XENP018844
SIVMTQSPATLSVSPGERATLSCRASQSVSNDVAWYQQKPGQSPRLLINYASHRYTGVPDRFTGSGSGTEFTLTISSLQSEDFAVYFCQQDYSSPRTFGGGTKVEIK

SEQ ID NO: 14053 - protein, 5 aa, Artificial Sequence
  Description of Artificial Sequence: Synthetic peptide
  XENP018844 vhCDR1
NYWMN

SEQ ID NO: 14054 - protein, 19 aa, Artificial Sequence
  Description of Artificial Sequence: Synthetic peptide
  XENP018844 vhCDR2
EIRLKSNNYATHYAEPVKG

SEQ ID NO: 14055 - protein, 11 aa, Artificial Sequence
  Description of Artificial Sequence: Synthetic peptide
  XENP018844 vhCDR3
YYGNYGGYFDV

SEQ ID NO: 14056 - protein, 11 aa, Artificial Sequence
  Description of Artificial Sequence: Synthetic peptide
  XENP018844 vlCDR1
RASQSVSNDVA

SEQ ID NO: 14057 - protein, 7 aa, Artificial Sequence
  Description of Artificial Sequence: Synthetic peptide
  XENP018844 vlCDR2
YASHRYT

SEQ ID NO: 14058 - protein, 9 aa, Artificial Sequence
  Description of Artificial Sequence: Synthetic peptide
  XENP018844 vlCDR3
QQDYSSPRT

SEQ ID NO: 14059 - protein, 249 aa, Artificial Sequence
  Description of Artificial Sequence: Synthetic polypeptide
  XENP018845 1G6_H1_L1.99_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGPGTEFTLTISSLQSEDFAVYFCQQDYSSPRTFGGGTKVEIK

SEQ ID NO: 14060 - protein, 122 aa, Artificial Sequence; identical to SEQ ID NO: 10922
  Description of Artificial Sequence: Synthetic polypeptide
  VH of XENP018845

SEQ ID NO: 14061 - protein, 107 aa, Artificial Sequence
  Description of Artificial Sequence: Synthetic polypeptide
  VL of XENP018845
SIVMTQSPATLSVSPGERATLSCRASQSVSNDVAWYQQKPGQSPRLLINYASHRYTGVPDRFTGSGPGTEFTLTISSLQSEDFAVYFCQQDYSSPRTFGGGTKVEIK

SEQ ID NO: 14062 - protein, 5 aa, Artificial Sequence
  Description of Artificial Sequence: Synthetic peptide
  XENP018845 vhCDR1
NYWMN

SEQ ID NO: 14063 - protein, 19 aa, Artificial Sequence
  Description of Artificial Sequence: Synthetic peptide
  XENP018845 vhCDR2
EIRLKSNNYATHYAEPVKG

SEQ ID NO: 14064 - protein, 11 aa, Artificial Sequence
  Description of Artificial Sequence: Synthetic peptide
  XENP018845 vhCDR3
YYGNYGGYFDV

SEQ ID NO: 14065 - protein, 11 aa, Artificial Sequence
  Description of Artificial Sequence: Synthetic peptide
  XENP018845 vlCDR1
RASQSVSNDVA

SEQ ID NO: 14066 - protein, 7 aa, Artificial Sequence
  Description of Artificial Sequence: Synthetic peptide
  XENP018845 vlCDR2
YASHRYT

SEQ ID NO: 14067 - protein, 9 aa, Artificial Sequence
  Description of Artificial Sequence: Synthetic peptide
  XENP018845 vlCDR3
QQDYSSPRT

SEQ ID NO: 14068 - protein, 249 aa, Artificial Sequence
  Description of Artificial Sequence: Synthetic polypeptide
  XENP018846 1G6_H1_L1.100_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTDFTLTISSLQSEDFAVYFCQQDYSSPRTFGGGTKVEIK

SEQ ID NO: 14069 - protein, 122 aa, Artificial Sequence; identical to SEQ ID NO: 10922
  Description of Artificial Sequence: Synthetic polypeptide
  VH of XENP018846

SEQ ID NO: 14070 - protein, 107 aa, Artificial Sequence
  Description of Artificial Sequence: Synthetic polypeptide
  VL of XENP018846
SIVMTQSPATLSVSPGERATLSCRASQSVSNDVAWYQQKPGQSPRLLINYASHRYTGVPDRFTGSGYGTDFTLTISSLQSEDFAVYFCQQDYSSPRTFGGGTKVEIK

SEQ ID NO: 14071 - protein, 5 aa, Artificial Sequence
  Description of Artificial Sequence: Synthetic peptide
  XENP018846 vhCDR1
NYWMN

SEQ ID NO: 14072 - protein, 19 aa, Artificial Sequence
  Description of Artificial Sequence: Synthetic peptide
  XENP018846 vhCDR2
EIRLKSNNYATHYAEPVKG

SEQ ID NO: 14073 - protein, 11 aa, Artificial Sequence
  Description of Artificial Sequence: Synthetic peptide
  XENP018846 vhCDR3
YYGNYGGYFDV

SEQ ID NO: 14074 - protein, 11 aa, Artificial Sequence
  Description of Artificial Sequence: Synthetic peptide
  XENP018846 vlCDR1
RASQSVSNDVA

SEQ ID NO: 14075 - protein, 7 aa, Artificial Sequence
  Description of Artificial Sequence: Synthetic peptide
  XENP018846 vlCDR2
YASHRYT

SEQ ID NO: 14076 - protein, 9 aa, Artificial Sequence
  Description of Artificial Sequence: Synthetic peptide
  XENP018846 vlCDR3
QQDYSSPRT

SEQ ID NO: 14077 - protein, 249 aa, Artificial Sequence
  Description of Artificial Sequence: Synthetic polypeptide
  XENP018847 1G6_H1_L1.101_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTFTISSLQSEDFAVYFCQQDYSSPRTFGGGTKVEIK

SEQ ID NO: 14078 - protein, 122 aa, Artificial Sequence; identical to SEQ ID NO: 10922
  Description of Artificial Sequence: Synthetic polypeptide
  VH of XENP018847

SEQ ID NO: 14079 - protein, 107 aa, Artificial Sequence
  Description of Artificial Sequence: Synthetic polypeptide
  VL of XENP018847
SIVMTQSPATLSVSPGERATLSCRASQSVSNDVAWYQQKPGQSPRLLINYASHRYTGVPDRFTGSGYGTEFTFTISSLQSEDFAVYFCQQDYSSPRTFGGGTKVEIK

SEQ ID NO: 14080 - protein, 5 aa, Artificial Sequence
  Description of Artificial Sequence: Synthetic peptide
  XENP018847 vhCDR1
NYWMN

SEQ ID NO: 14081 - protein, 19 aa, Artificial Sequence
  Description of Artificial Sequence: Synthetic peptide
  XENP018847 vhCDR2
EIRLKSNNYATHYAEPVKG

SEQ ID NO: 14082 - protein, 11 aa, Artificial Sequence
  Description of Artificial Sequence: Synthetic peptide
  XENP018847 vhCDR3
YYGNYGGYFDV

SEQ ID NO: 14083 - protein, 11 aa, Artificial Sequence
  Description of Artificial Sequence: Synthetic peptide
  XENP018847 vlCDR1
RASQSVSNDVA

SEQ ID NO: 14084 - protein, 7 aa, Artificial Sequence
  Description of Artificial Sequence: Synthetic peptide
  XENP018847 vlCDR2
YASHRYT

SEQ ID NO: 14085 - protein, 9 aa, Artificial Sequence
  Description of Artificial Sequence: Synthetic peptide
  XENP018847 vlCDR3
QQDYSSPRT

SEQ ID NO: 14086 - protein, 249 aa, Artificial Sequence
  Description of Artificial Sequence: Synthetic polypeptide
  XENP018848 1G6_H1_L1.102_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISTLQSEDFAVYFCQQDYSSPRTFGGGTKVEIK

SEQ ID NO: 14087 - protein, 122 aa, Artificial Sequence; identical to SEQ ID NO: 10922
  Description of Artificial Sequence: Synthetic polypeptide
  VH of XENP018848

SEQ ID NO: 14088 - protein, 107 aa, Artificial Sequence
  Description of Artificial Sequence: Synthetic polypeptide
  VL of XENP018848
SIVMTQSPATLSVSPGERATLSCRASQSVSNDVAWYQQKPGQSPRLLINYASHRYTGVPDRFTGSGYGTEFTLTISTLQSEDFAVYFCQQDYSSPRTFGGGTKVEIK

SEQ ID NO: 14089 - protein, 5 aa, Artificial Sequence
  Description of Artificial Sequence: Synthetic peptide
  XENP018848 vhCDR1
NYWMN

SEQ ID NO: 14090 - protein, 19 aa, Artificial Sequence
  Description of Artificial Sequence: Synthetic peptide
  XENP018848 vhCDR2
EIRLKSNNYATHYAEPVKG

SEQ ID NO: 14091 - protein, 11 aa, Artificial Sequence
  Description of Artificial Sequence: Synthetic peptide
  XENP018848 vhCDR3
YYGNYGGYFDV

SEQ ID NO: 14092 - protein, 11 aa, Artificial Sequence
  Description of Artificial Sequence: Synthetic peptide
  XENP018848 vlCDR1
RASQSVSNDVA

SEQ ID NO: 14093 - protein, 7 aa, Artificial Sequence
  Description of Artificial Sequence: Synthetic peptide
  XENP018848 vlCDR2
YASHRYT

SEQ ID NO: 14094 - protein, 9 aa, Artificial Sequence
  Description of Artificial Sequence: Synthetic peptide
  XENP018848 vlCDR3
QQDYSSPRT

SEQ ID NO: 14095 - protein, 249 aa, Artificial Sequence
  Description of Artificial Sequence: Synthetic polypeptide
  XENP018849 1G6_H1_L1.103_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSVQSEDFAVYFCQQDYSSPRTFGGGTKVEIK

SEQ ID NO: 14096 - protein, 122 aa, Artificial Sequence; identical to SEQ ID NO: 10922
  Description of Artificial Sequence: Synthetic polypeptide
  VH of XENP018849

SEQ ID NO: 14097 - protein, 107 aa, Artificial Sequence
  Description of Artificial Sequence: Synthetic polypeptide
  VL of XENP018849
SIVMTQSPATLSVSPGERATLSCRASQSVSNDVAWYQQKPGQSPRLLINYASHRYTGVPDRFTGSGYGTEFTLTISSVQSEDFAVYFCQQDYSSPRTFGGGTKVEIK

SEQ ID NO: 14098 - protein, 5 aa, Artificial Sequence
  Description of Artificial Sequence: Synthetic peptide
  XENP018849 vhCDR1
NYWMN

SEQ ID NO: 14099 - protein, 19 aa, Artificial Sequence
  Description of Artificial Sequence: Synthetic peptide
  XENP018849 vhCDR2
EIRLKSNNYATHYAEPVKG

SEQ ID NO: 14100 - protein, 11 aa, Artificial Sequence
  Description of Artificial Sequence: Synthetic peptide
  XENP018849 vhCDR3
YYGNYGGYFDV

SEQ ID NO: 14101 - protein, 11 aa, Artificial Sequence
  Description of Artificial Sequence: Synthetic peptide
  XENP018849 vlCDR1
RASQSVSNDVA

SEQ ID NO: 14102 - protein, 7 aa, Artificial Sequence
  Description of Artificial Sequence: Synthetic peptide
  XENP018849 vlCDR2
YASHRYT

SEQ ID NO: 14103 - protein, 9 aa, Artificial Sequence
  Description of Artificial Sequence: Synthetic peptide
  XENP018849 vlCDR3
QQDYSSPRT

SEQ ID NO: 14104 - protein, 249 aa, Artificial Sequence
  Description of Artificial Sequence: Synthetic polypeptide
  XENP018850 1G6_H1_L1.104_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQAEDFAVYFCQQDYSSPRTFGGGTKVEIK

SEQ ID NO: 14105 - protein, 122 aa, Artificial Sequence; identical to SEQ ID NO: 10922
  Description of Artificial Sequence: Synthetic polypeptide
  VH of XENP018850

SEQ ID NO: 14106 - protein, 107 aa, Artificial Sequence
  Description of Artificial Sequence: Synthetic polypeptide
  VL of XENP018850
SIVMTQSPATLSVSPGERATLSCRASQSVSNDVAWYQQKPGQSPRLLINYASHRYTGVPDRFTGSGYGTEFTLTISSLQAEDFAVYFCQQDYSSPRTFGGGTKVEIK

SEQ ID NO: 14107 - protein, 5 aa, Artificial Sequence
  Description of Artificial Sequence: Synthetic peptide
  XENP018850 vhCDR1
NYWMN

SEQ ID NO: 14108 - protein, 19 aa, Artificial Sequence
  Description of Artificial Sequence: Synthetic peptide
  XENP018850 vhCDR2
EIRLKSNNYATHYAEPVKG

SEQ ID NO: 14109 - protein, 11 aa, Artificial Sequence
  Description of Artificial Sequence: Synthetic peptide
  XENP018850 vhCDR3
YYGNYGGYFDV

SEQ ID NO: 14110 - protein, 11 aa, Artificial Sequence
  Description of Artificial Sequence: Synthetic peptide
  XENP018850 vlCDR1
RASQSVSNDVA

SEQ ID NO: 14111 - protein, 7 aa, Artificial Sequence
  Description of Artificial Sequence: Synthetic peptide
  XENP018850 vlCDR2
YASHRYT

SEQ ID NO: 14112 - protein, 9 aa, Artificial Sequence
  Description of Artificial Sequence: Synthetic peptide
  XENP018850 vlCDR3
QQDYSSPRT

SEQ ID NO: 14113 - protein, 249 aa, Artificial Sequence
  Description of Artificial Sequence: Synthetic polypeptide
  XENP018851 1G6_H1_L1.105_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDLAVYFCQQDYSSPRTFGGGTKVEIK

SEQ ID NO: 14114 - protein, 122 aa, Artificial Sequence; identical to SEQ ID NO: 10922
  Description of Artificial Sequence: Synthetic polypeptide
  VH of XENP018851

SEQ ID NO: 14115 - protein, 107 aa, Artificial Sequence
  Description of Artificial Sequence: Synthetic polypeptide
  VL of XENP018851
SIVMTQSPATLSVSPGERATLSCRASQSVSNDVAWYQQKPGQSPRLLINYASHRYTGVPDRFTGSGYGTEFTLTISSLQSEDLAVYFCQQDYSSPRTFGGGTKVEIK

SEQ ID NO: 14116 - protein, 5 aa, Artificial Sequence
  Description of Artificial Sequence: Synthetic peptide
  XENP018851 vhCDR1
NYWMN

SEQ ID NO: 14117 - protein, 19 aa, Artificial Sequence
  Description of Artificial Sequence: Synthetic peptide
  XENP018851 vhCDR2
EIRLKSNNYATHYAEPVKG

SEQ ID NO: 14118 - protein, 11 aa, Artificial Sequence
  Description of Artificial Sequence: Synthetic peptide
  XENP018851 vhCDR3
YYGNYGGYFDV

SEQ ID NO: 14119 - protein, 11 aa, Artificial Sequence
  Description of Artificial Sequence: Synthetic peptide
  XENP018851 vlCDR1
RASQSVSNDVA

SEQ ID NO: 14120 - protein, 7 aa, Artificial Sequence
  Description of Artificial Sequence: Synthetic peptide
  XENP018851 vlCDR2
YASHRYT

SEQ ID NO: 14121 - protein, 9 aa, Artificial Sequence
  Description of Artificial Sequence: Synthetic peptide
  XENP018851 vlCDR3
QQDYSSPRT

SEQ ID NO: 14122 - protein, 249 aa, Artificial Sequence
  Description of Artificial Sequence: Synthetic polypeptide
  XENP018852 1G6_H1_L1.106_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYYCQQDYSSPRTFGGGTKVEIK

SEQ ID NO: 14123 - protein, 122 aa, Artificial Sequence; identical to SEQ ID NO: 10922
  Description of Artificial Sequence: Synthetic polypeptide
  VH of XENP018852

SEQ ID NO: 14124 - protein, 107 aa, Artificial Sequence
  Description of Artificial Sequence: Synthetic polypeptide
  VL of XENP018852
SIVMTQSPATLSVSPGERATLSCRASQSVSNDVAWYQQKPGQSPRLLINYASHRYTGVPDRFTGSGYGTEFTLTISSLQSEDFAVYYCQQDYSSPRTFGGGTKVEIK

SEQ ID NO: 14125 - protein, 5 aa, Artificial Sequence
  Description of Artificial Sequence: Synthetic peptide
  XENP018852 vhCDR1
NYWMN

SEQ ID NO: 14126 - protein, 19 aa, Artificial Sequence
  Description of Artificial Sequence: Synthetic peptide
  XENP018852 vhCDR2
EIRLKSNNYATHYAEPVKG

SEQ ID NO: 14127 - protein, 11 aa, Artificial Sequence
  Description of Artificial Sequence: Synthetic peptide
  XENP018852 vhCDR3
YYGNYGGYFDV

SEQ ID NO: 14128 - protein, 11 aa, Artificial Sequence
  Description of Artificial Sequence: Synthetic peptide
  XENP018852 vlCDR1
RASQSVSNDVA

SEQ ID NO: 14129 - protein, 7 aa, Artificial Sequence
  Description of Artificial Sequence: Synthetic peptide
  XENP018852 vlCDR2
YASHRYT

SEQ ID NO: 14130 - protein, 9 aa, Artificial Sequence
  Description of Artificial Sequence: Synthetic peptide
  XENP018852 vlCDR3
QQDYSSPRT

SEQ ID NO: 14131 - protein, 249 aa, Artificial Sequence
  Description of Artificial Sequence: Synthetic polypeptide
  XENP018853 1G6_H1_L1.107_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQQYSSPRTFGGGTKVEIK

SEQ ID NO: 14132 - protein, 122 aa, Artificial Sequence; identical to SEQ ID NO: 10922
  Description of Artificial Sequence: Synthetic polypeptide
  VH of XENP018853

SEQ ID NO: 14133 - protein, 107 aa, Artificial Sequence
  Description of Artificial Sequence: Synthetic polypeptide
  VL of XENP018853
SIVMTQSPATLSVSPGERATLSCRASQSVSNDVAWYQQKPGQSPRLLINYASHRYTGVPDRFTGSGYGTEFTLTISSLQSEDFAVYFCQQQYSSPRTFGGGTKVEIK

SEQ ID NO: 14134 - protein, 5 aa, Artificial Sequence
  Description of Artificial Sequence: Synthetic peptide
  XENP018853 vhCDR1
NYWMN

SEQ ID NO: 14135 - protein, 19 aa, Artificial Sequence
  Description of Artificial Sequence: Synthetic peptide
  XENP018853 vhCDR2
EIRLKSNNYATHYAEPVKG

SEQ ID NO: 14136 - protein, 11 aa, Artificial Sequence
  Description of Artificial Sequence: Synthetic peptide
  XENP018853 vhCDR3
YYGNYGGYFDV

SEQ ID NO: 14137 - protein, 11 aa, Artificial Sequence
  Description of Artificial Sequence: Synthetic peptide
  XENP018853 vlCDR1
RASQSVSNDVA

SEQ ID NO: 14138 - protein, 7 aa, Artificial Sequence
  Description of Artificial Sequence: Synthetic peptide
  XENP018853 vlCDR2
YASHRYT

SEQ ID NO: 14139 - protein, 9 aa, Artificial Sequence
  Description of Artificial Sequence: Synthetic peptide
  XENP018853 vlCDR3
QQQYSSPRT

SEQ ID NO: 14140 - protein, 249 aa, Artificial Sequence
  Description of Artificial Sequence: Synthetic polypeptide
  XENP018854 1G6_H1_L1.108_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQEYSSPRTFGGGTKVEIK

SEQ ID NO: 14141 - protein, 122 aa, Artificial Sequence; identical to SEQ ID NO: 10922
  Description of Artificial Sequence: Synthetic polypeptide
  VH of XENP018854

SEQ ID NO: 14142 - protein, 107 aa, Artificial Sequence
  Description of Artificial Sequence: Synthetic polypeptide
  VL of XENP018854
SIVMTQSPATLSVSPGERATLSCRASQSVSNDVAWYQQKPGQSPRLLINYASHRYTGVPDRFTGSGYGTEFTLTISSLQSEDFAVYFCQQEYSSPRTFGGGTKVEIK

SEQ ID NO: 14143 - protein, 5 aa, Artificial Sequence
  Description of Artificial Sequence: Synthetic peptide
  XENP018854 vhCDR1
NYWMN

SEQ ID NO: 14144 - protein, 19 aa, Artificial Sequence
  Description of Artificial Sequence: Synthetic peptide
  XENP018854 vhCDR2
EIRLKSNNYATHYAEPVKG

SEQ ID NO: 14145 - protein, 11 aa, Artificial Sequence
  Description of Artificial Sequence: Synthetic peptide
  XENP018854 vhCDR3
YYGNYGGYFDV

SEQ ID NO: 14146 - protein, 11 aa, Artificial Sequence
  Description of Artificial Sequence: Synthetic peptide
  XENP018854 vlCDR1
RASQSVSNDVA

SEQ ID NO: 14147 - protein, 7 aa, Artificial Sequence
  Description of Artificial Sequence: Synthetic peptide
  XENP018854 vlCDR2
YASHRYT

SEQ ID NO: 14148 - protein, 9 aa, Artificial Sequence
  Description of Artificial Sequence: Synthetic peptide
  XENP018854 vlCDR3
QQEYSSPRT

SEQ ID NO: 14149 - protein, 249 aa, Artificial Sequence
  Description of Artificial Sequence: Synthetic polypeptide
  XENP018855 1G6_H1_L1.109_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQHYSSPRTFGGGTKVEIK

SEQ ID NO: 14150 - protein, 122 aa, Artificial Sequence; identical to SEQ ID NO: 10922
  Description of Artificial Sequence: Synthetic polypeptide
  VH of XENP018855

SEQ ID NO: 14151 - protein, 107 aa, Artificial Sequence
  Description of Artificial Sequence: Synthetic polypeptide
  VL of XENP018855
SIVMTQSPATLSVSPGERATLSCRASQSVSNDVAWYQQKPGQSPRLLINYASHRYTGVPDRFTGSGYGTEFTLTISSLQSEDFAVYFCQQHYSSPRTFGGGTKVEIK

SEQ ID NO: 14152 - protein, 5 aa, Artificial Sequence
  Description of Artificial Sequence: Synthetic peptide
  XENP018855 vhCDR1
NYWMN

SEQ ID NO: 14153 - protein, 19 aa, Artificial Sequence
  Description of Artificial Sequence: Synthetic peptide
  XENP018855 vhCDR2
EIRLKSNNYATHYAEPVKG

SEQ ID NO: 14154 - protein, 11 aa, Artificial Sequence
  Description of Artificial Sequence: Synthetic peptide
  XENP018855 vhCDR3
YYGNYGGYFDV

SEQ ID NO: 14155 - protein, 11 aa, Artificial Sequence
  Description of Artificial Sequence: Synthetic peptide
  XENP018855 vlCDR1
RASQSVSNDVA

SEQ ID NO: 14156 - protein, 7 aa, Artificial Sequence
  Description of Artificial Sequence: Synthetic peptide
  XENP018855 vlCDR2
YASHRYT

SEQ ID NO: 14157 - protein, 9 aa, Artificial Sequence
  Description of Artificial Sequence: Synthetic peptide
  XENP018855 vlCDR3
QQHYSSPRT

SEQ ID NO: 14158 - protein, 249 aa, Artificial Sequence
  Description of Artificial Sequence: Synthetic polypeptide
  XENP018856 1G6_H1_L1.110_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQSYSSPRTFGGGTKVEIK

SEQ ID NO: 14159 - protein, 122 aa, Artificial Sequence; identical to SEQ ID NO: 10922
  Description of Artificial Sequence: Synthetic polypeptide
  VH of XENP018856

SEQ ID NO: 14160 - protein, 107 aa, Artificial Sequence
  Description of Artificial Sequence: Synthetic polypeptide
  VL of XENP018856
SIVMTQSPATLSVSPGERATLSCRASQSVSNDVAWYQQKPGQSPRLLINYASHRYTGVPDRFTGSGYGTEFTLTISSLQSEDFAVYFCQQSYSSPRTFGGGTKVEIK

SEQ ID NO: 14161 - protein, 5 aa, Artificial Sequence
  Description of Artificial Sequence: Synthetic peptide
  XENP018856 vhCDR1
NYWMN

SEQ ID NO: 14162 - protein, 19 aa, Artificial Sequence
  Description of Artificial Sequence: Synthetic peptide
  XENP018856 vhCDR2
EIRLKSNNYATHYAEPVKG

SEQ ID NO: 14163 - protein, 11 aa, Artificial Sequence
  Description of Artificial Sequence: Synthetic peptide
  XENP018856 vhCDR3
YYGNYGGYFDV

SEQ ID NO: 14164 - protein, 11 aa, Artificial Sequence
  Description of Artificial Sequence: Synthetic peptide
  XENP018856 vlCDR1
RASQSVSNDVA

SEQ ID NO: 14165 - protein, 7 aa, Artificial Sequence
  Description of Artificial Sequence: Synthetic peptide
  XENP018856 vlCDR2
YASHRYT

SEQ ID NO: 14166 - protein, 9 aa, Artificial Sequence
  Description of Artificial Sequence: Synthetic peptide
  XENP018856 vlCDR3
QQSYSSPRT

SEQ ID NO: 14167 - protein, 249 aa, Artificial Sequence
  Description of Artificial Sequence: Synthetic polypeptide
  XENP018857 1G6_H1_L1.111_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQRYSSPRTFGGGTKVEIK

SEQ ID NO: 14168 - protein, 122 aa, Artificial Sequence; identical to SEQ ID NO: 10922
  Description of Artificial Sequence: Synthetic polypeptide
  VH of XENP018857

SEQ ID NO: 14169 - protein, 107 aa, Artificial Sequence
  Description of Artificial Sequence: Synthetic polypeptide
  VL of XENP018857
SIVMTQSPATLSVSPGERATLSCRASQSVSNDVAWYQQKPGQSPRLLINYASHRYTGVPDRFTGSGYGTEFTLTISSLQSEDFAVYFCQQRYSSPRTFGGGTKVEIK

SEQ ID NO: 14170 - protein, 5 aa, Artificial Sequence
  Description of Artificial Sequence: Synthetic peptide
  XENP018857 vhCDR1
NYWMN

SEQ ID NO: 14171 - protein, 19 aa, Artificial Sequence
  Description of Artificial Sequence: Synthetic peptide
  XENP018857 vhCDR2
EIRLKSNNYATHYAEPVKG

SEQ ID NO: 14172 - protein, 11 aa, Artificial Sequence
  Description of Artificial Sequence: Synthetic peptide
  XENP018857 vhCDR3
YYGNYGGYFDV

SEQ ID NO: 14173 - protein, 11 aa, Artificial Sequence
  Description of Artificial Sequence: Synthetic peptide
  XENP018857 vlCDR1
RASQSVSNDVA

SEQ ID NO: 14174 - protein, 7 aa, Artificial Sequence
  Description of Artificial Sequence: Synthetic peptide
  XENP018857 vlCDR2
YASHRYT

SEQ ID NO: 14175 - protein, 9 aa, Artificial Sequence
  Description of Artificial Sequence: Synthetic peptide
  XENP018857 vlCDR3
QQRYSSPRT

SEQ ID NO: 14176 - protein, 249 aa, Artificial Sequence
  Description of Artificial Sequence: Synthetic polypeptide
  XENP018858 1G6_H1_L1.112_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQLYSSPRTFGGGTKVEIK

SEQ ID NO: 14177 - protein, 122 aa, Artificial Sequence; identical to SEQ ID NO: 10922
  Description of Artificial Sequence: Synthetic polypeptide
  VH of XENP018858

SEQ ID NO: 14178 - protein, 107 aa, Artificial Sequence
  Description of Artificial Sequence: Synthetic polypeptide
  VL of XENP018858
SIVMTQSPATLSVSPGERATLSCRASQSVSNDVAWYQQKPGQSPRLLINYASHRYTGVPDRFTGSGYGTEFTLTISSLQSEDFAVYFCQQLYSSPRTFGGGTKVEIK

SEQ ID NO: 14179 - protein, 5 aa, Artificial Sequence
  Description of Artificial Sequence: Synthetic peptide
  XENP018858 vhCDR1
NYWMN

SEQ ID NO: 14180 - protein, 19 aa, Artificial Sequence
  Description of Artificial Sequence: Synthetic peptide
  XENP018858 vhCDR2
EIRLKSNNYATHYAEPVKG

SEQ ID NO: 14181 - protein, 11 aa, Artificial Sequence
  Description of Artificial Sequence: Synthetic peptide
  XENP018858 vhCDR3
YYGNYGGYFDV

SEQ ID NO: 14182 - protein, 11 aa, Artificial Sequence
  Description of Artificial Sequence: Synthetic peptide
  XENP018858 vlCDR1
RASQSVSNDVA

SEQ ID NO: 14183 - protein, 7 aa, Artificial Sequence
  Description of Artificial Sequence: Synthetic peptide
  XENP018858 vlCDR2
YASHRYT

SEQ ID NO: 14184 - protein, 9 aa, Artificial Sequence
  Description of Artificial Sequence: Synthetic peptide
  XENP018858 vlCDR3
QQLYSSPRT

SEQ ID NO: 14185 - protein, 249 aa, Artificial Sequence
  Description of Artificial Sequence: Synthetic polypeptide
  XENP018859 1G6_H1_L1.113_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQTYSSPRTFGGGTKVEIK

SEQ ID NO: 14186 - protein, 122 aa, Artificial Sequence; identical to SEQ ID NO: 10922
  Description of Artificial Sequence: Synthetic polypeptide
  VH of XENP018859

SEQ ID NO: 14187 - protein, 107 aa, Artificial Sequence
  Description of Artificial Sequence: Synthetic polypeptide
  VL of XENP018859
SIVMTQSPATLSVSPGERATLSCRASQSVSNDVAWYQQKPGQSPRLLINYASHRYTGVPDRFTGSGYGTEFTLTISSLQSEDFAVYFCQQTYSSPRTFGGGTKVEIK

SEQ ID NO: 14188 - protein, 5 aa, Artificial Sequence
  Description of Artificial Sequence: Synthetic peptide
  XENP018859 vhCDR1
NYWMN

SEQ ID NO: 14189 - protein, 19 aa, Artificial Sequence
  Description of Artificial Sequence: Synthetic peptide
  XENP018859 vhCDR2
EIRLKSNNYATHYAEPVKG

SEQ ID NO: 14190 - protein, 11 aa, Artificial Sequence
  Description of Artificial Sequence: Synthetic peptide
  XENP018859 vhCDR3
YYGNYGGYFDV

SEQ ID NO: 14191 - protein, 11 aa, Artificial Sequence
  Description of Artificial Sequence: Synthetic peptide
  XENP018859 vlCDR1
RASQSVSNDVA

SEQ ID NO: 14192 - protein, 7 aa, Artificial Sequence
  Description of Artificial Sequence: Synthetic peptide
  XENP018859 vlCDR2
YASHRYT

SEQ ID NO: 14193 - protein, 9 aa, Artificial Sequence
  Description of Artificial Sequence: Synthetic peptide
  XENP018859 vlCDR3
QQTYSSPRT

SEQ ID NO: 14194 - protein, 249 aa, Artificial Sequence
  Description of Artificial Sequence: Synthetic polypeptide
  XENP018860 1G6_H1_L1.114_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQGYSSPRTFGGGTKVEIK

SEQ ID NO: 14195 - protein, 122 aa, Artificial Sequence; identical to SEQ ID NO: 10922
  Description of Artificial Sequence: Synthetic polypeptide
  VH of XENP018860

SEQ ID NO: 14196 - protein, 107 aa, Artificial Sequence
  Description of Artificial Sequence: Synthetic polypeptide
  VL of XENP018860
SIVMTQSPATLSVSPGERATLSCRASQSVSNDVAWYQQKPGQSPRLLINYASHRYTGVPDRFTGSGYGTEFTLTISSLQSEDFAVYFCQQGYSSPRTFGGGTKVEIK

SEQ ID NO: 14197 - protein, 5 aa, Artificial Sequence
  Description of Artificial Sequence: Synthetic peptide
  XENP018860 vhCDR1
NYWMN

SEQ ID NO: 14198 - protein, 19 aa, Artificial Sequence
  Description of Artificial Sequence: Synthetic peptide
  XENP018860 vhCDR2
EIRLKSNNYATHYAEPVKG

SEQ ID NO: 14199 - protein, 11 aa, Artificial Sequence
  Description of Artificial Sequence: Synthetic peptide
  XENP018860 vhCDR3
YYGNYGGYFDV

SEQ ID NO: 14200 - protein, 11 aa, Artificial Sequence
  Description of Artificial Sequence: Synthetic peptide
  XENP018860 vlCDR1
RASQSVSNDVA

SEQ ID NO: 14201 - protein, 7 aa, Artificial Sequence
  Description of Artificial Sequence: Synthetic peptide
  XENP018860 vlCDR2
YASHRYT

SEQ ID NO: 14202 - protein, 9 aa, Artificial Sequence
  Description of Artificial Sequence: Synthetic peptide
  XENP018860 vlCDR3
QQGYSSPRT

SEQ ID NO: 14203 - protein, 249 aa, Artificial Sequence
  Description of Artificial Sequence: Synthetic polypeptide
  XENP018861 1G6_H1_L1.115_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQYYSSPRTFGGGTKVEIK

SEQ ID NO: 14204 - protein, 122 aa, Artificial Sequence; identical to SEQ ID NO: 10922
  Description of Artificial Sequence: Synthetic polypeptide
  VH of XENP018861

SEQ ID NO: 14205 - protein, 107 aa, Artificial Sequence
  Description of Artificial Sequence: Synthetic polypeptide
  VL of XENP018861
SIVMTQSPATLSVSPGERATLSCRASQSVSNDVAWYQQKPGQSPRLLINYASHRYTGVPDRFTGSGYGTEFTLTISSLQSEDFAVYFCQQYYSSPRTFGGGTKVEIK

SEQ ID NO: 14206 - protein, 5 aa, Artificial Sequence
  Description of Artificial Sequence: Synthetic peptide
  XENP018861 vhCDR1
NYWMN

SEQ ID NO: 14207 - protein, 19 aa, Artificial Sequence
  Description of Artificial Sequence: Synthetic peptide
  XENP018861 vhCDR2
EIRLKSNNYATHYAEPVKG

SEQ ID NO: 14208 - protein, 11 aa, Artificial Sequence
  Description of Artificial Sequence: Synthetic peptide
  XENP018861 vhCDR3
YYGNYGGYFDV

SEQ ID NO: 14209 - protein, 11 aa, Artificial Sequence
  Description of Artificial Sequence: Synthetic peptide
  XENP018861 vlCDR1
RASQSVSNDVA

SEQ ID NO: 14210 - protein, 7 aa, Artificial Sequence
  Description of Artificial Sequence: Synthetic peptide
  XENP018861 vlCDR2
YASHRYT

SEQ ID NO: 14211 - protein, 9 aa, Artificial Sequence
  Description of Artificial Sequence: Synthetic peptide
  XENP018861 vlCDR3
QQYYSSPRT

SEQ ID NO: 14212 - protein, 249 aa, Artificial Sequence
  Description of Artificial Sequence: Synthetic polypeptide
  XENP018862 1G6_H1_L1.116_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDFSSPRTFGGGTKVEIK

SEQ ID NO: 14213 - protein, 122 aa, Artificial Sequence; identical to SEQ ID NO: 10922
  Description of Artificial Sequence: Synthetic polypeptide
  VH of XENP018862

SEQ ID NO: 14214 - protein, 107 aa, Artificial Sequence
  Description of Artificial Sequence: Synthetic polypeptide
  VL of XENP018862
SIVMTQSPATLSVSPGERATLSCRASQSVSNDVAWYQQKPGQSPRLLINYASHRYTGVPDRFTGSGYGTEFTLTISSLQSEDFAVYFCQQDFSSPRTFGGGTKVEIK

SEQ ID NO: 14215 - protein, 5 aa, Artificial Sequence
  Description of Artificial Sequence: Synthetic peptide
  XENP018862 vhCDR1
NYWMN

SEQ ID NO: 14216 - protein, 19 aa, Artificial Sequence
  Description of Artificial Sequence: Synthetic peptide
  XENP018862 vhCDR2
EIRLKSNNYATHYAEPVKG

SEQ ID NO: 14217 - protein, 11 aa, Artificial Sequence
  Description of Artificial Sequence: Synthetic peptide
  XENP018862 vhCDR3
YYGNYGGYFDV

SEQ ID NO: 14218 - protein, 11 aa, Artificial Sequence
  Description of Artificial Sequence: Synthetic peptide
  XENP018862 vlCDR1
RASQSVSNDVA

SEQ ID NO: 14219 - protein, 7 aa, Artificial Sequence
  Description of Artificial Sequence: Synthetic peptide
  XENP018862 vlCDR2
YASHRYT

SEQ ID NO: 14220 - protein, 9 aa, Artificial Sequence
  Description of Artificial Sequence: Synthetic peptide
  XENP018862 vlCDR3
QQDFSSPRT

SEQ ID NO: 14221 - protein, 249 aa, Artificial Sequence
  Description of Artificial Sequence: Synthetic polypeptide
  XENP018863 1G6_H1_L1.117_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDHSSPRTFGGGTKVEIK

SEQ ID NO: 14222 - protein, 122 aa, Artificial Sequence; identical to SEQ ID NO: 10922
  Description of Artificial Sequence: Synthetic polypeptide
  VH of XENP018863

SEQ ID NO: 14223 - protein, 107 aa, Artificial Sequence
  Description of Artificial Sequence: Synthetic polypeptide
  VL of XENP018863
SIVMTQSPATLSVSPGERATLSCRASQSVSNDVAWYQQKPGQSPRLLINYASHRYTGVPDRFTGSGYGTEFTLTISSLQSEDFAVYFCQQDHSSPRTFGGGTKVEIK

SEQ ID NO: 14224 - protein, 5 aa, Artificial Sequence
  Description of Artificial Sequence: Synthetic peptide
  XENP018863 vhCDR1
NYWMN

SEQ ID NO: 14225 - protein, 19 aa, Artificial Sequence
  Description of Artificial Sequence: Synthetic peptide
  XENP018863 vhCDR2
EIRLKSNNYATHYAEPVKG

SEQ ID NO: 14226 - protein, 11 aa, Artificial Sequence
  Description of Artificial Sequence: Synthetic peptide
  XENP018863 vhCDR3
YYGNYGGYFDV

SEQ ID NO: 14227 - protein, 11 aa, Artificial Sequence
  Description of Artificial Sequence: Synthetic peptide
  XENP018863 vlCDR1
RASQSVSNDVA

SEQ ID NO: 14228 - protein, 7 aa, Artificial Sequence
  Description of Artificial Sequence: Synthetic peptide
  XENP018863 vlCDR2
YASHRYT

SEQ ID NO: 14229 - protein, 9 aa, Artificial Sequence
  Description of Artificial Sequence: Synthetic peptide
  XENP018863 vlCDR3
QQDHSSPRT

SEQ ID NO: 14230 - protein, 249 aa, Artificial Sequence
  Description of Artificial Sequence: Synthetic polypeptide
  XENP018864 1G6_H1_L1.118_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDLSSPRTFGGGTKVEIK

SEQ ID NO: 14231 - protein, 122 aa, Artificial Sequence; identical to SEQ ID NO: 10922
  Description of Artificial Sequence: Synthetic polypeptide
  VH of XENP018864

SEQ ID NO: 14232 - protein, 107 aa, Artificial Sequence
  Description of Artificial Sequence: Synthetic polypeptide
  VL of XENP018864
SIVMTQSPATLSVSPGERATLSCRASQSVSNDVAWYQQKPGQSPRLLINYASHRYTGVPDRFTGSGYGTEFTLTISSLQSEDFAVYFCQQDLSSPRTFGGGTKVEIK

SEQ ID NO: 14233 - protein, 5 aa, Artificial Sequence
  Description of Artificial Sequence: Synthetic peptide
  XENP018864 vhCDR1
NYWMN

SEQ ID NO: 14234 - protein, 19 aa, Artificial Sequence
  Description of Artificial Sequence: Synthetic peptide
  XENP018864 vhCDR2
EIRLKSNNYATHYAEPVKG

SEQ ID NO: 14235 - protein, 11 aa, Artificial Sequence
  Description of Artificial Sequence: Synthetic peptide
  XENP018864 vhCDR3
YYGNYGGYFDV

SEQ ID NO: 14236 - protein, 11 aa, Artificial Sequence
  Description of Artificial Sequence: Synthetic peptide
  XENP018864 vlCDR1
RASQSVSNDVA

SEQ ID NO: 14237 - protein, 7 aa, Artificial Sequence
  Description of Artificial Sequence: Synthetic peptide
  XENP018864 vlCDR2
YASHRYT

SEQ ID NO: 14238 - protein, 9 aa, Artificial Sequence
  Description of Artificial Sequence: Synthetic peptide
  XENP018864 vlCDR3
QQDLSSPRT

SEQ ID NO: 14239 - protein, 249 aa, Artificial Sequence
  Description of Artificial Sequence: Synthetic polypeptide
  XENP018865 1G6_H1_L1.119_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDWSSPRTFGGGTKVEIK

SEQ ID NO: 14240 - protein, 122 aa, Artificial Sequence; identical to SEQ ID NO: 10922
  Description of Artificial Sequence: Synthetic polypeptide
  VH of XENP018865

SEQ ID NO: 14241 - protein, 107 aa, Artificial Sequence
  Description of Artificial Sequence: Synthetic polypeptide
  VL of XENP018865
SIVMTQSPATLSVSPGERATLSCRASQSVSNDVAWYQQKPGQSPRLLINYASHRYTGVPDRFTGSGYGTEFTLTISSLQSEDFAVYFCQQDWSSPRTFGGGTKVEIK

SEQ ID NO: 14242 - protein, 5 aa, Artificial Sequence
  Description of Artificial Sequence: Synthetic peptide
  XENP018865 vhCDR1
NYWMN

SEQ ID NO: 14243 - protein, 19 aa, Artificial Sequence
  Description of Artificial Sequence: Synthetic peptide
  XENP018865 vhCDR2
EIRLKSNNYATHYAEPVKG

SEQ ID NO: 14244 - protein, 11 aa, Artificial Sequence
  Description of Artificial Sequence: Synthetic peptide
  XENP018865 vhCDR3
YYGNYGGYFDV

SEQ ID NO: 14245 - protein, 11 aa, Artificial Sequence
  Description of Artificial Sequence: Synthetic peptide
  XENP018865 vlCDR1
RASQSVSNDVA

SEQ ID NO: 14246 - protein, 7 aa, Artificial Sequence
  Description of Artificial Sequence: Synthetic peptide
  XENP018865 vlCDR2
YASHRYT

SEQ ID NO: 14247 - protein, 9 aa, Artificial Sequence
  Description of Artificial Sequence: Synthetic peptide
  XENP018865 vlCDR3
QQDWSSPRT

SEQ ID NO: 14248 - protein, 249 aa, Artificial Sequence
  Description of Artificial Sequence: Synthetic polypeptide
  XENP018866 1G6_H1_L1.120_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDVSSPRTFGGGTKVEIK

SEQ ID NO: 14249 - protein, 122 aa, Artificial Sequence; identical to SEQ ID NO: 10922
  Description of Artificial Sequence: Synthetic polypeptide
  VH of XENP018866

SEQ ID NO: 14250 - protein, 107 aa, Artificial Sequence
  Description of Artificial Sequence: Synthetic polypeptide
  VL of XENP018866
SIVMTQSPATLSVSPGERATLSCRASQSVSNDVAWYQQKPGQSPRLLINYASHRYTGVPDRFTGSGYGTEFTLTISSLQSEDFAVYFCQQDVSSPRTFGGGTKVEIK

SEQ ID NO: 14251 - protein, 5 aa, Artificial Sequence
  Description of Artificial Sequence: Synthetic peptide
  XENP018866 vhCDR1
NYWMN

SEQ ID NO: 14252 - protein, 19 aa, Artificial Sequence
  Description of Artificial Sequence: Synthetic peptide
  XENP018866 vhCDR2
EIRLKSNNYATHYAEPVKG

SEQ ID NO: 14253 - protein, 11 aa, Artificial Sequence
  Description of Artificial Sequence: Synthetic peptide
  XENP018866 vhCDR3
YYGNYGGYFDV

SEQ ID NO: 14254 - protein, 11 aa, Artificial Sequence
  Description of Artificial Sequence: Synthetic peptide
  XENP018866 vlCDR1
RASQSVSNDVA

SEQ ID NO: 14255 - protein, 7 aa, Artificial Sequence
  Description of Artificial Sequence: Synthetic peptide
  XENP018866 vlCDR2
YASHRYT

SEQ ID NO: 14256 - protein, 9 aa, Artificial Sequence
  Description of Artificial Sequence: Synthetic peptide
  XENP018866 vlCDR3
QQDVSSPRT

SEQ ID NO: 14257 - protein, 249 aa, Artificial Sequence
  Description of Artificial Sequence: Synthetic polypeptide
  XENP018867 1G6_H1_L1.121_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDASSPRTFGGGTKVEIK

SEQ ID NO: 14258 - protein, 122 aa, Artificial Sequence; identical to SEQ ID NO: 10922
  Description of Artificial Sequence: Synthetic polypeptide
  VH of XENP018867

SEQ ID NO: 14259 - protein, 107 aa, Artificial Sequence
  Description of Artificial Sequence: Synthetic polypeptide
  VL of XENP018867
SIVMTQSPATLSVSPGERATLSCRASQSVSNDVAWYQQKPGQSPRLLINYASHRYTGVPDRFTGSGYGTEFTLTISSLQSEDFAVYFCQQDASSPRTFGGGTKVEIK

SEQ ID NO: 14260 - protein, 5 aa, Artificial Sequence
  Description of Artificial Sequence: Synthetic peptide
  XENP018867 vhCDR1
NYWMN

SEQ ID NO: 14261 - protein, 19 aa, Artificial Sequence
  Description of Artificial Sequence: Synthetic peptide
  XENP018867 vhCDR2
EIRLKSNNYATHYAEPVKG

SEQ ID NO: 14262 - protein, 11 aa, Artificial Sequence
  Description of Artificial Sequence: Synthetic peptide
  XENP018867 vhCDR3
YYGNYGGYFDV

SEQ ID NO: 14263 - protein, 11 aa, Artificial Sequence
  Description of Artificial Sequence: Synthetic peptide
  XENP018867 vlCDR1
RASQSVSNDVA

SEQ ID NO: 14264 - protein, 7 aa, Artificial Sequence
  Description of Artificial Sequence: Synthetic peptide
  XENP018867 vlCDR2
YASHRYT

SEQ ID NO: 14265 - protein, 9 aa, Artificial Sequence
  Description of Artificial Sequence: Synthetic peptide
  XENP018867 vlCDR3
QQDASSPRT

SEQ ID NO: 14266 - protein, 249 aa, Artificial Sequence
  Description of Artificial Sequence: Synthetic polypeptide
  XENP018868 1G6_H1_L1.122_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDQSSPRTFGGGTKVEIK

SEQ ID NO: 14267 - protein, 122 aa, Artificial Sequence; identical to SEQ ID NO: 10922
  Description of Artificial Sequence: Synthetic polypeptide
  VH of XENP018868

SEQ ID NO: 14268 - protein, 107 aa, Artificial Sequence
  Description of Artificial Sequence: Synthetic polypeptide
  VL of XENP018868
SIVMTQSPATLSVSPGERATLSCRASQSVSNDVAWYQQKPGQSPRLLINYASHRYTGVPDRFTGSGYGTEFTLTISSLQSEDFAVYFCQQDQSSPRTFGGGTKVEIK

SEQ ID NO: 14269 - protein, 5 aa, Artificial Sequence
  Description of Artificial Sequence: Synthetic peptide
  XENP018868 vhCDR1
NYWMN

SEQ ID NO: 14270 - protein, 19 aa, Artificial Sequence
  Description of Artificial Sequence: Synthetic peptide
  XENP018868 vhCDR2
EIRLKSNNYATHYAEPVKG

SEQ ID NO: 14271 - protein, 11 aa, Artificial Sequence
  Description of Artificial Sequence: Synthetic peptide
  XENP018868 vhCDR3
YYGNYGGYFDV

SEQ ID NO: 14272 - protein, 11 aa, Artificial Sequence
  Description of Artificial Sequence: Synthetic peptide
  XENP018868 vlCDR1
RASQSVSNDVA

SEQ ID NO: 14273 - protein, 7 aa, Artificial Sequence
  Description of Artificial Sequence: Synthetic peptide
  XENP018868 vlCDR2
YASHRYT

SEQ ID NO: 14274 - protein, 9 aa, Artificial Sequence
  Description of Artificial Sequence: Synthetic peptide
  XENP018868 vlCDR3
QQDQSSPRT

SEQ ID NO: 14275 - protein, 249 aa, Artificial Sequence
  Description of Artificial Sequence: Synthetic polypeptide
  XENP018869 1G6_H1_L1.123_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDDSSPRTFGGGTKVEIK

SEQ ID NO: 14276 - protein, 122 aa, Artificial Sequence; identical to SEQ ID NO: 10922
  Description of Artificial Sequence: Synthetic polypeptide
  VH of XENP018869

SEQ ID NO: 14277 - protein, 107 aa, Artificial Sequence
  Description of Artificial Sequence: Synthetic polypeptide
  VL of XENP018869
SIVMTQSPATLSVSPGERATLSCRASQSVSNDVAWYQQKPGQSPRLLINYASHRYTGVPDRFTGSGYGTEFTLTISSLQSEDFAVYFCQQDDSSPRTFGGGTKVEIK

SEQ ID NO: 14278 - protein, 5 aa, Artificial Sequence
  Description of Artificial Sequence: Synthetic peptide
  XENP018869 vhCDR1
NYWMN

SEQ ID NO: 14279 - protein, 19 aa, Artificial Sequence
  Description of Artificial Sequence: Synthetic peptide
  XENP018869 vhCDR2
EIRLKSNNYATHYAEPVKG

SEQ ID NO: 14280 - protein, 11 aa, Artificial Sequence
  Description of Artificial Sequence: Synthetic peptide
  XENP018869 vhCDR3
YYGNYGGYFDV

SEQ ID NO: 14281 - protein, 11 aa, Artificial Sequence
  Description of Artificial Sequence: Synthetic peptide
  XENP018869 vlCDR1
RASQSVSNDVA

SEQ ID NO: 14282 - protein, 7 aa, Artificial Sequence
  Description of Artificial Sequence: Synthetic peptide
  XENP018869 vlCDR2
YASHRYT

SEQ ID NO: 14283 - protein, 9 aa, Artificial Sequence
  Description of Artificial Sequence: Synthetic peptide
  XENP018869 vlCDR3
QQDDSSPRT

SEQ ID NO: 14284 - protein, 249 aa, Artificial Sequence
  Description of Artificial Sequence: Synthetic polypeptide
  XENP018870 1G6_H1_L1.124_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDKSSPRTFGGGTKVEIK

SEQ ID NO: 14285 - protein, 122 aa, Artificial Sequence; identical to SEQ ID NO: 10922
  Description of Artificial Sequence: Synthetic polypeptide
  VH of XENP018870

SEQ ID NO: 14286 - protein, 107 aa, Artificial Sequence
  Description of Artificial Sequence: Synthetic polypeptide
  VL of XENP018870
SIVMTQSPATLSVSPGERATLSCRASQSVSNDVAWYQQKPGQSPRLLINYASHRYTGVPDRFTGSGYGTEFTLTISSLQSEDFAVYFCQQDKSSPRTFGGGTKVEIK

SEQ ID NO: 14287 - protein, 5 aa, Artificial Sequence
  Description of Artificial Sequence: Synthetic peptide
  XENP018870 vhCDR1
NYWMN

SEQ ID NO: 14288 - protein, 19 aa, Artificial Sequence
  Description of Artificial Sequence: Synthetic peptide
  XENP018870 vhCDR2
EIRLKSNNYATHYAEPVKG

SEQ ID NO: 14289 - protein, 11 aa, Artificial Sequence
  Description of Artificial Sequence: Synthetic peptide
  XENP018870 vhCDR3
YYGNYGGYFDV

SEQ ID NO: 14290 - protein, 11 aa, Artificial Sequence
  Description of Artificial Sequence: Synthetic peptide
  XENP018870 vlCDR1
RASQSVSNDVA

SEQ ID NO: 14291 - protein, 7 aa, Artificial Sequence
  Description of Artificial Sequence: Synthetic peptide
  XENP018870 vlCDR2
YASHRYT

SEQ ID NO: 14292 - protein, 9 aa, Artificial Sequence
  Description of Artificial Sequence: Synthetic peptide
  XENP018870 vlCDR3
QQDKSSPRT

SEQ ID NO: 14293 - protein, 249 aa, Artificial Sequence
  Description of Artificial Sequence: Synthetic polypeptide
  XENP018871 1G6_H1_L1.125_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDSSSPRTFGGGTKVEIK

SEQ ID NO: 14294 - protein, 122 aa, Artificial Sequence; identical to SEQ ID NO: 10922
  Description of Artificial Sequence: Synthetic polypeptide
  VH of XENP018871

SEQ ID NO: 14295 - protein, 107 aa, Artificial Sequence
  Description of Artificial Sequence: Synthetic polypeptide
  VL of XENP018871
SIVMTQSPATLSVSPGERATLSCRASQSVSNDVAWYQQKPGQSPRLLINYASHRYTGVPDRFTGSGYGTEFTLTISSLQSEDFAVYFCQQDSSSPRTFGGGTKVEIK

SEQ ID NO: 14296 - protein, 5 aa, Artificial Sequence
  Description of Artificial Sequence: Synthetic peptide
  XENP018871 vhCDR1
NYWMN

SEQ ID NO: 14297 - protein, 19 aa, Artificial Sequence
  Description of Artificial Sequence: Synthetic peptide
  XENP018871 vhCDR2
EIRLKSNNYATHYAEPVKG

SEQ ID NO: 14298 - protein, 11 aa, Artificial Sequence
  Description of Artificial Sequence: Synthetic peptide
  XENP018871 vhCDR3
YYGNYGGYFDV

SEQ ID NO: 14299 - protein, 11 aa, Artificial Sequence
  Description of Artificial Sequence: Synthetic peptide
  XENP018871 vlCDR1
RASQSVSNDVA

SEQ ID NO: 14300 - protein, 7 aa, Artificial Sequence
  Description of Artificial Sequence: Synthetic peptide
  XENP018871 vlCDR2
YASHRYT

SEQ ID NO: 14301 - protein, 9 aa, Artificial Sequence
  Description of Artificial Sequence: Synthetic peptide
  XENP018871 vlCDR3
QQDSSSPRT

SEQ ID NO: 14302 - protein, 249 aa, Artificial Sequence
  Description of Artificial Sequence: Synthetic polypeptide
  XENP018872 1G6_H1_L1.126_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDGSSPRTFGGGTKVEIK

SEQ ID NO: 14303 - protein, 122 aa, Artificial Sequence; identical to SEQ ID NO: 10922
  Description of Artificial Sequence: Synthetic polypeptide
  VH of XENP018872

SEQ ID NO: 14304 - protein, 107 aa, Artificial Sequence
  Description of Artificial Sequence: Synthetic polypeptide
  VL of XENP018872
SIVMTQSPATLSVSPGERATLSCRASQSVSNDVAWYQQKPGQSPRLLINYASHRYTGVPDRFTGSGYGTEFTLTISSLQSEDFAVYFCQQDGSSPRTFGGGTKVEIK

SEQ ID NO: 14305 - protein, 5 aa, Artificial Sequence
  Description of Artificial Sequence: Synthetic peptide
  XENP018872 vhCDR1
NYWMN

SEQ ID NO: 14306 - protein, 19 aa, Artificial Sequence
  Description of Artificial Sequence: Synthetic peptide
  XENP018872 vhCDR2
EIRLKSNNYATHYAEPVKG

SEQ ID NO: 14307 - protein, 11 aa, Artificial Sequence
  Description of Artificial Sequence: Synthetic peptide
  XENP018872 vhCDR3
YYGNYGGYFDV

SEQ ID NO: 14308 - protein, 11 aa, Artificial Sequence
  Description of Artificial Sequence: Synthetic peptide
  XENP018872 vlCDR1
RASQSVSNDVA

SEQ ID NO: 14309 - protein, 7 aa, Artificial Sequence
  Description of Artificial Sequence: Synthetic peptide
  XENP018872 vlCDR2
YASHRYT

SEQ ID NO: 14310 - protein, 9 aa, Artificial Sequence
  Description of Artificial Sequence: Synthetic peptide
  XENP018872 vlCDR3
QQDGSSPRT

SEQ ID NO: 14311 - protein, 249 aa, Artificial Sequence
  Description of Artificial Sequence: Synthetic polypeptide
  XENP018873 1G6_H1_L1.127_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYTSPRTFGGGTKVEIK

SEQ ID NO: 14312 - protein, 122 aa, Artificial Sequence; identical to SEQ ID NO: 10922
  Description of Artificial Sequence: Synthetic polypeptide
  VH of XENP018873

SEQ ID NO: 14313 - protein, 107 aa, Artificial Sequence
  Description of Artificial Sequence: Synthetic polypeptide
  VL of XENP018873
SIVMTQSPATLSVSPGERATLSCRASQSVSNDVAWYQQKPGQSPRLLINYASHRYTGVPDRFTGSGYGTEFTLTISSLQSEDFAVYFCQQDYTSPRTFGGGTKVEIK

SEQ ID NO: 14314 - protein, 5 aa, Artificial Sequence
  Description of Artificial Sequence: Synthetic peptide
  XENP018873 vhCDR1
NYWMN

SEQ ID NO: 14315 - protein, 19 aa, Artificial Sequence
  Description of Artificial Sequence: Synthetic peptide
  XENP018873 vhCDR2
EIRLKSNNYATHYAEPVKG

SEQ ID NO: 14316 - protein, 11 aa, Artificial Sequence
  Description of Artificial Sequence: Synthetic peptide
  XENP018873 vhCDR3
YYGNYGGYFDV

SEQ ID NO: 14317 - protein, 11 aa, Artificial Sequence
  Description of Artificial Sequence: Synthetic peptide
  XENP018873 vlCDR1
RASQSVSNDVA

SEQ ID NO: 14318 - protein, 7 aa, Artificial Sequence
  Description of Artificial Sequence: Synthetic peptide
  XENP018873 vlCDR2
YASHRYT

SEQ ID NO: 14319 - protein, 9 aa, Artificial Sequence
  Description of Artificial Sequence: Synthetic peptide
  XENP018873 vlCDR3
QQDYTSPRT

SEQ ID NO: 14320 - protein, 249 aa, Artificial Sequence
  Description of Artificial Sequence: Synthetic polypeptide
  XENP018874 1G6_H1_L1.128_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYASPRTFGGGTKVEIK

SEQ ID NO: 14321 - protein, 122 aa, Artificial Sequence; identical to SEQ ID NO: 10922
  Description of Artificial Sequence: Synthetic polypeptide
  VH of XENP018874

SEQ ID NO: 14322 - protein, 107 aa, Artificial Sequence
  Description of Artificial Sequence: Synthetic polypeptide
  VL of XENP018874
SIVMTQSPATLSVSPGERATLSCRASQSVSNDVAWYQQKPGQSPRLLINYASHRYTGVPDRFTGSGYGTEFTLTISSLQSEDFAVYFCQQDYASPRTFGGGTKVEIK

SEQ ID NO: 14323 - protein, 5 aa, Artificial Sequence
  Description of Artificial Sequence: Synthetic peptide
  XENP018874 vhCDR1
NYWMN

SEQ ID NO: 14324 - protein, 19 aa, Artificial Sequence
  Description of Artificial Sequence: Synthetic peptide
  XENP018874 vhCDR2
EIRLKSNNYATHYAEPVKG

SEQ ID NO: 14325 - protein, 11 aa, Artificial Sequence
  Description of Artificial Sequence: Synthetic peptide
  XENP018874 vhCDR3
YYGNYGGYFDV

SEQ ID NO: 14326 - protein, 11 aa, Artificial Sequence
  Description of Artificial Sequence: Synthetic peptide
  XENP018874 vlCDR1
RASQSVSNDVA

SEQ ID NO: 14327 - protein, 7 aa, Artificial Sequence
  Description of Artificial Sequence: Synthetic peptide
  XENP018874 vlCDR2
YASHRYT

SEQ ID NO: 14328 - protein, 9 aa, Artificial Sequence
  Description of Artificial Sequence: Synthetic peptide
  XENP018874 vlCDR3
QQDYASPRT

SEQ ID NO: 14329 - protein, 249 aa, Artificial Sequence
  Description of Artificial Sequence: Synthetic polypeptide
  XENP018875 1G6_H1_L1.129_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYQSPRTFGGGTKVEIK

SEQ ID NO: 14330 - protein, 122 aa, Artificial Sequence; identical to SEQ ID NO: 10922
  Description of Artificial Sequence: Synthetic polypeptide
  VH of XENP018875

SEQ ID NO: 14331 - protein, 107 aa, Artificial Sequence
  Description of Artificial Sequence: Synthetic polypeptide
  VL of XENP018875
SIVMTQSPATLSVSPGERATLSCRASQSVSNDVAWYQQKPGQSPRLLINYASHRYTGVPDRFTGSGYGTEFTLTISSLQSEDFAVYFCQQDYQSPRTFGGGTKVEIK

SEQ ID NO: 14332 - protein, 5 aa, Artificial Sequence
  Description of Artificial Sequence: Synthetic peptide
  XENP018875 vhCDR1
NYWMN

SEQ ID NO: 14333 - protein, 19 aa, Artificial Sequence
  Description of Artificial Sequence: Synthetic peptide
  XENP018875 vhCDR2
EIRLKSNNYATHYAEPVKG

SEQ ID NO: 14334 - protein, 11 aa, Artificial Sequence
  Description of Artificial Sequence: Synthetic peptide
  XENP018875 vhCDR3
YYGNYGGYFDV

SEQ ID NO: 14335 - protein, 11 aa, Artificial Sequence
  Description of Artificial Sequence: Synthetic peptide
  XENP018875 vlCDR1
RASQSVSNDVA

SEQ ID NO: 14336 - protein, 7 aa, Artificial Sequence
  Description of Artificial Sequence: Synthetic peptide
  XENP018875 vlCDR2
YASHRYT

SEQ ID NO: 14337 - protein, 9 aa, Artificial Sequence
  Description of Artificial Sequence: Synthetic peptide
  XENP018875 vlCDR3
QQDYQSPRT

SEQ ID NO: 14338 - protein, 249 aa, Artificial Sequence
  Description of Artificial Sequence: Synthetic polypeptide
  XENP018876 1G6_H1_L1.130_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYGSPRTFGGGTKVEIK

SEQ ID NO: 14339 - protein, 122 aa, Artificial Sequence; identical to SEQ ID NO: 10922
  Description of Artificial Sequence: Synthetic polypeptide
  VH of XENP018876

SEQ ID NO: 14340 - protein, 107 aa, Artificial Sequence
  Description of Artificial Sequence: Synthetic polypeptide
  VL of XENP018876
SIVMTQSPATLSVSPGERATLSCRASQSVSNDVAWYQQKPGQSPRLLINYASHRYTGVPDRFTGSGYGTEFTLTISSLQSEDFAVYFCQQDYGSPRTFGGGTKVEIK

SEQ ID NO: 14341 - protein, 5 aa, Artificial Sequence
  Description of Artificial Sequence: Synthetic peptide
  XENP018876 vhCDR1
NYWMN

SEQ ID NO: 14342 - protein, 19 aa, Artificial Sequence
  Description of Artificial Sequence: Synthetic peptide
  XENP018876 vhCDR2
EIRLKSNNYATHYAEPVKG

SEQ ID NO: 14343 - protein, 11 aa, Artificial Sequence
  Description of Artificial Sequence: Synthetic peptide
  XENP018876 vhCDR3
YYGNYGGYFDV

SEQ ID NO: 14344 - protein, 11 aa, Artificial Sequence
  Description of Artificial Sequence: Synthetic peptide
  XENP018876 vlCDR1
RASQSVSNDVA

SEQ ID NO: 14345 - protein, 7 aa, Artificial Sequence
  Description of Artificial Sequence: Synthetic peptide
  XENP018876 vlCDR2
YASHRYT

SEQ ID NO: 14346 - protein, 9 aa, Artificial Sequence
  Description of Artificial Sequence: Synthetic peptide
  XENP018876 vlCDR3
QQDYGSPRT

SEQ ID NO: 14347 - protein, 249 aa, Artificial Sequence
  Description of Artificial Sequence: Synthetic polypeptide
  XENP018877 1G6_H1_L1.131_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYVSPRTFGGGTKVEIK

SEQ ID NO: 14348 - protein, 122 aa, Artificial Sequence; identical to SEQ ID NO: 10922
  Description of Artificial Sequence: Synthetic polypeptide
  VH of XENP018877

SEQ ID NO: 14349 - protein, 107 aa, Artificial Sequence
  Description of Artificial Sequence: Synthetic polypeptide
  VL of XENP018877
SIVMTQSPATLSVSPGERATLSCRASQSVSNDVAWYQQKPGQSPRLLINYASHRYTGVPDRFTGSGYGTEFTLTISSLQSEDFAVYFCQQDYVSPRTFGGGTKVEIK

SEQ ID NO: 14350 - protein, 5 aa, Artificial Sequence
  Description of Artificial Sequence: Synthetic peptide
  XENP018877 vhCDR1
NYWMN

SEQ ID NO: 14351 - protein, 19 aa, Artificial Sequence
  Description of Artificial Sequence: Synthetic peptide
  XENP018877 vhCDR2
EIRLKSNNYATHYAEPVKG

SEQ ID NO: 14352 - protein, 11 aa, Artificial Sequence
  Description of Artificial Sequence: Synthetic peptide
  XENP018877 vhCDR3
YYGNYGGYFDV

SEQ ID NO: 14353 - protein, 11 aa, Artificial Sequence
  Description of Artificial Sequence: Synthetic peptide
  XENP018877 vlCDR1
RASQSVSNDVA

SEQ ID NO: 14354 - protein, 7 aa, Artificial Sequence
  Description of Artificial Sequence: Synthetic peptide
  XENP018877 vlCDR2
YASHRYT

SEQ ID NO: 14355 - protein, 9 aa, Artificial Sequence
  Description of Artificial Sequence: Synthetic peptide
  XENP018877 vlCDR3
QQDYVSPRT

SEQ ID NO: 14356 - protein, 249 aa, Artificial Sequence
  Description of Artificial Sequence: Synthetic polypeptide
  XENP018878 1G6_H1_L1.132_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYHSPRTFGGGTKVEIK

SEQ ID NO: 14357 - protein, 122 aa, Artificial Sequence; identical to SEQ ID NO: 10922
  Description of Artificial Sequence: Synthetic polypeptide
  VH of XENP018878

SEQ ID NO: 14358 - protein, 107 aa, Artificial Sequence
  Description of Artificial Sequence: Synthetic polypeptide
  VL of XENP018878
SIVMTQSPATLSVSPGERATLSCRASQSVSNDVAWYQQKPGQSPRLLINYASHRYTGVPDRFTGSGYGTEFTLTISSLQSEDFAVYFCQQDYHSPRTFGGGTKVEIK

SEQ ID NO: 14359 - protein, 5 aa, Artificial Sequence
  Description of Artificial Sequence: Synthetic peptide
  XENP018878 vhCDR1
NYWMN

SEQ ID NO: 14360 - protein, 19 aa, Artificial Sequence
  Description of Artificial Sequence: Synthetic peptide
  XENP018878 vhCDR2
EIRLKSNNYATHYAEPVKG

SEQ ID NO: 14361 - protein, 11 aa, Artificial Sequence
  Description of Artificial Sequence: Synthetic peptide
  XENP018878 vhCDR3
YYGNYGGYFDV

SEQ ID NO: 14362 - protein, 11 aa, Artificial Sequence
  Description of Artificial Sequence: Synthetic peptide
  XENP018878 vlCDR1
RASQSVSNDVA

SEQ ID NO: 14363 - protein, 7 aa, Artificial Sequence
  Description of Artificial Sequence: Synthetic peptide
  XENP018878 vlCDR2
YASHRYT

SEQ ID NO: 14364 - protein, 9 aa, Artificial Sequence
  Description of Artificial Sequence: Synthetic peptide
  XENP018878 vlCDR3
QQDYHSPRT

SEQ ID NO: 14365 - protein, 249 aa, Artificial Sequence
  Description of Artificial Sequence: Synthetic polypeptide
  XENP018879 1G6_H1_L1.133_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYDSPRTFGGGTKVEIK

SEQ ID NO: 14366 - protein, 122 aa, Artificial Sequence; identical to SEQ ID NO: 10922
  Description of Artificial Sequence: Synthetic polypeptide
  VH of XENP018879

SEQ ID NO: 14367 - protein, 107 aa, Artificial Sequence
  Description of Artificial Sequence: Synthetic polypeptide
  VL of XENP018879
SIVMTQSPATLSVSPGERATLSCRASQSVSNDVAWYQQKPGQSPRLLINYASHRYTGVPDRFTGSGYGTEFTLTISSLQSEDFAVYFCQQDYDSPRTFGGGTKVEIK

SEQ ID NO: 14368 - protein, 5 aa, Artificial Sequence
  Description of Artificial Sequence: Synthetic peptide
  XENP018879 vhCDR1
NYWMN

SEQ ID NO: 14369 - protein, 19 aa, Artificial Sequence
  Description of Artificial Sequence: Synthetic peptide
  XENP018879 vhCDR2
EIRLKSNNYATHYAEPVKG

SEQ ID NO: 14370 - protein, 11 aa, Artificial Sequence
  Description of Artificial Sequence: Synthetic peptide
  XENP018879 vhCDR3
YYGNYGGYFDV

SEQ ID NO: 14371 - protein, 11 aa, Artificial Sequence
  Description of Artificial Sequence: Synthetic peptide
  XENP018879 vlCDR1
RASQSVSNDVA

SEQ ID NO: 14372 - protein, 7 aa, Artificial Sequence
  Description of Artificial Sequence: Synthetic peptide
  XENP018879 vlCDR2
YASHRYT

SEQ ID NO: 14373 - protein, 9 aa, Artificial Sequence
  Description of Artificial Sequence: Synthetic peptide
  XENP018879 vlCDR3
QQDYDSPRT

SEQ ID NO: 14374 - protein, 249 aa, Artificial Sequence
  Description of Artificial Sequence: Synthetic polypeptide
  XENP018880 1G6_H1_L1.134_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYKSPRTFGGGTKVEIK

SEQ ID NO: 14375 - protein, 122 aa, Artificial Sequence; identical to SEQ ID NO: 10922
  Description of Artificial Sequence: Synthetic polypeptide
  VH of XENP018880

SEQ ID NO: 14376 - protein, 107 aa, Artificial Sequence
  Description of Artificial Sequence: Synthetic polypeptide
  VL of XENP018880
SIVMTQSPATLSVSPGERATLSCRASQSVSNDVAWYQQKPGQSPRLLINYASHRYTGVPDRFTGSGYGTEFTLTISSLQSEDFAVYFCQQDYKSPRTFGGGTKVEIK

SEQ ID NO: 14377 - protein, 5 aa, Artificial Sequence
  Description of Artificial Sequence: Synthetic peptide
  XENP018880 vhCDR1
NYWMN

SEQ ID NO: 14378 - protein, 19 aa, Artificial Sequence
  Description of Artificial Sequence: Synthetic peptide
  XENP018880 vhCDR2
EIRLKSNNYATHYAEPVKG

SEQ ID NO: 14379 - protein, 11 aa, Artificial Sequence
  Description of Artificial Sequence: Synthetic peptide
  XENP018880 vhCDR3
YYGNYGGYFDV

SEQ ID NO: 14380 - protein, 11 aa, Artificial Sequence
  Description of Artificial Sequence: Synthetic peptide
  XENP018880 vlCDR1
RASQSVSNDVA

SEQ ID NO: 14381 - protein, 7 aa, Artificial Sequence
  Description of Artificial Sequence: Synthetic peptide
  XENP018880 vlCDR2
YASHRYT

SEQ ID NO: 14382 - protein, 9 aa, Artificial Sequence
  Description of Artificial Sequence: Synthetic peptide
  XENP018880 vlCDR3
QQDYKSPRT

SEQ ID NO: 14383 - protein, 249 aa, Artificial Sequence
  Description of Artificial Sequence: Synthetic polypeptide
  XENP018881 1G6_H1_L1.135_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYFSPRTFGGGTKVEIK

SEQ ID NO: 14384 - protein, 122 aa, Artificial Sequence; identical to SEQ ID NO: 10922
  Description of Artificial Sequence: Synthetic polypeptide
  VH of XENP018881

SEQ ID NO: 14385 - protein, 107 aa, Artificial Sequence
  Description of Artificial Sequence: Synthetic polypeptide
  VL of XENP018881
SIVMTQSPATLSVSPGERATLSCRASQSVSNDVAWYQQKPGQSPRLLINYASHRYTGVPDRFTGSGYGTEFTLTISSLQSEDFAVYFCQQDYFSPRTFGGGTKVEIK

SEQ ID NO: 14386 - protein, 5 aa, Artificial Sequence
  Description of Artificial Sequence: Synthetic peptide
  XENP018881 vhCDR1
NYWMN

SEQ ID NO: 14387 - protein, 19 aa, Artificial Sequence
  Description of Artificial Sequence: Synthetic peptide
  XENP018881 vhCDR2
EIRLKSNNYATHYAEPVKG

SEQ ID NO: 14388 - protein, 11 aa, Artificial Sequence
  Description of Artificial Sequence: Synthetic peptide
  XENP018881 vhCDR3
YYGNYGGYFDV

SEQ ID NO: 14389 - protein, 11 aa, Artificial Sequence
  Description of Artificial Sequence: Synthetic peptide
  XENP018881 vlCDR1
RASQSVSNDVA

SEQ ID NO: 14390 - protein, 7 aa, Artificial Sequence
  Description of Artificial Sequence: Synthetic peptide
  XENP018881 vlCDR2
YASHRYT

SEQ ID NO: 14391 - protein, 9 aa, Artificial Sequence
  Description of Artificial Sequence: Synthetic peptide
  XENP018881 vlCDR3
QQDYFSPRT

SEQ ID NO: 14392 - protein, 249 aa, Artificial Sequence
  Description of Artificial Sequence: Synthetic polypeptide
  XENP018882 1G6_H1_L1.136_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSTPRTFGGGTKVEIK

SEQ ID NO: 14393 - protein, 122 aa, Artificial Sequence; identical to SEQ ID NO: 10922
  Description of Artificial Sequence: Synthetic polypeptide
  VH of XENP018882

SEQ ID NO: 14394 - protein, 107 aa, Artificial Sequence
  Description of Artificial Sequence: Synthetic polypeptide
  VL of XENP018882
SIVMTQSPATLSVSPGERATLSCRASQSVSNDVAWYQQKPGQSPRLLINYASHRYTGVPDRFTGSGYGTEFTLTISSLQSEDFAVYFCQQDYSTPRTFGGGTKVEIK

SEQ ID NO: 14395 - protein, 5 aa, Artificial Sequence
  Description of Artificial Sequence: Synthetic peptide
  XENP018882 vhCDR1
NYWMN

SEQ ID NO: 14396 - protein, 19 aa, Artificial Sequence
  Description of Artificial Sequence: Synthetic peptide
  XENP018882 vhCDR2
EIRLKSNNYATHYAEPVKG

SEQ ID NO: 14397 - protein, 11 aa, Artificial Sequence
  Description of Artificial Sequence: Synthetic peptide
  XENP018882 vhCDR3
YYGNYGGYFDV

SEQ ID NO: 14398 - protein, 11 aa, Artificial Sequence
  Description of Artificial Sequence: Synthetic peptide
  XENP018882 vlCDR1
RASQSVSNDVA

SEQ ID NO: 14399 - protein, 7 aa, Artificial Sequence
  Description of Artificial Sequence: Synthetic peptide
  XENP018882 vlCDR2
YASHRYT

SEQ ID NO: 14400 - protein, 9 aa, Artificial Sequence
  Description of Artificial Sequence: Synthetic peptide
  XENP018882 vlCDR3
QQDYSTPRT

SEQ ID NO: 14401 - protein, 249 aa, Artificial Sequence
  Description of Artificial Sequence: Synthetic polypeptide
  XENP018883 1G6_H1_L1.137_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSAPRTFGGGTKVEIK

SEQ ID NO: 14402 - protein, 122 aa, Artificial Sequence; identical to SEQ ID NO: 10922
  Description of Artificial Sequence: Synthetic polypeptide
  VH of XENP018883

SEQ ID NO: 14403 - protein, 107 aa, Artificial Sequence
  Description of Artificial Sequence: Synthetic polypeptide
  VL of XENP018883
SIVMTQSPATLSVSPGERATLSCRASQSVSNDVAWYQQKPGQSPRLLINYASHRYTGVPDRFTGSGYGTEFTLTISSLQSEDFAVYFCQQDYSAPRTFGGGTKVEIK

SEQ ID NO: 14404 - protein, 5 aa, Artificial Sequence
  Description of Artificial Sequence: Synthetic peptide
  XENP018883 vhCDR1
NYWMN

SEQ ID NO: 14405 - protein, 19 aa, Artificial Sequence
  Description of Artificial Sequence: Synthetic peptide
  XENP018883 vhCDR2
EIRLKSNNYATHYAEPVKG

SEQ ID NO: 14406 - protein, 11 aa, Artificial Sequence
  Description of Artificial Sequence: Synthetic peptide
  XENP018883 vhCDR3
YYGNYGGYFDV

SEQ ID NO: 14407 - protein, 11 aa, Artificial Sequence
  Description of Artificial Sequence: Synthetic peptide
  XENP018883 vlCDR1
RASQSVSNDVA

SEQ ID NO: 14408 - protein, 7 aa, Artificial Sequence
  Description of Artificial Sequence: Synthetic peptide
  XENP018883 vlCDR2
YASHRYT

SEQ ID NO: 14409 - protein, 9 aa, Artificial Sequence
  Description of Artificial Sequence: Synthetic peptide
  XENP018883 vlCDR3
QQDYSAPRT

SEQ ID NO: 14410 - protein, 249 aa, Artificial Sequence
  Description of Artificial Sequence: Synthetic polypeptide
  XENP018884 1G6_H1_L1.138_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSNPRTFGGGTKVEIK

SEQ ID NO: 14411 - protein, 122 aa, Artificial Sequence; identical to SEQ ID NO: 10922
  Description of Artificial Sequence: Synthetic polypeptide
  VH of XENP018884

SEQ ID NO: 14412 - protein, 107 aa, Artificial Sequence
  Description of Artificial Sequence: Synthetic polypeptide
  VL of XENP018884
SIVMTQSPATLSVSPGERATLSCRASQSVSNDVAWYQQKPGQSPRLLINYASHRYTGVPDRFTGSGYGTEFTLTISSLQSEDFAVYFCQQDYSNPRTFGGGTKVEIK

SEQ ID NO: 14413 - protein, 5 aa, Artificial Sequence
  Description of Artificial Sequence: Synthetic peptide
  XENP018884 vhCDR1
NYWMN

SEQ ID NO: 14414 - protein, 19 aa, Artificial Sequence
  Description of Artificial Sequence: Synthetic peptide
  XENP018884 vhCDR2
EIRLKSNNYATHYAEPVKG

SEQ ID NO: 14415 - protein, 11 aa, Artificial Sequence
  Description of Artificial Sequence: Synthetic peptide
  XENP018884 vhCDR3
YYGNYGGYFDV

SEQ ID NO: 14416 - protein, 11 aa, Artificial Sequence
  Description of Artificial Sequence: Synthetic peptide
  XENP018884 vlCDR1
RASQSVSNDVA

SEQ ID NO: 14417 - protein, 7 aa, Artificial Sequence
  Description of Artificial Sequence: Synthetic peptide
  XENP018884 vlCDR2
YASHRYT

SEQ ID NO: 14418 - protein, 9 aa, Artificial Sequence
  Description of Artificial Sequence: Synthetic peptide
  XENP018884 vlCDR3
QQDYSNPRT

SEQ ID NO: 14419 - protein, 249 aa, Artificial Sequence
  Description of Artificial Sequence: Synthetic polypeptide
  XENP018885 1G6_H1_L1.139_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSGPRTFGGGTKVEIK

SEQ ID NO: 14420 - protein, 122 aa, Artificial Sequence; identical to SEQ ID NO: 10922
  Description of Artificial Sequence: Synthetic polypeptide
  VH of XENP018885

SEQ ID NO: 14421 - protein, 107 aa, Artificial Sequence
  Description of Artificial Sequence: Synthetic polypeptide
  VL of XENP018885
SIVMTQSPATLSVSPGERATLSCRASQSVSNDVAWYQQKPGQSPRLLINYASHRYTGVPDRFTGSGYGTEFTLTISSLQSEDFAVYFCQQDYSGPRTFGGGTKVEIK

SEQ ID NO: 14422 - protein, 5 aa, Artificial Sequence
  Description of Artificial Sequence: Synthetic peptide
  XENP018885 vhCDR1
NYWMN

SEQ ID NO: 14423 - protein, 19 aa, Artificial Sequence
  Description of Artificial Sequence: Synthetic peptide
  XENP018885 vhCDR2
EIRLKSNNYATHYAEPVKG

SEQ ID NO: 14424 - protein, 11 aa, Artificial Sequence
  Description of Artificial Sequence: Synthetic peptide
  XENP018885 vhCDR3
YYGNYGGYFDV

SEQ ID NO: 14425 - protein, 11 aa, Artificial Sequence
  Description of Artificial Sequence: Synthetic peptide
  XENP018885 vlCDR1
RASQSVSNDVA

SEQ ID NO: 14426 - protein, 7 aa, Artificial Sequence
  Description of Artificial Sequence: Synthetic peptide
  XENP018885 vlCDR2
YASHRYT

SEQ ID NO: 14427 - protein, 9 aa, Artificial Sequence
  Description of Artificial Sequence: Synthetic peptide
  XENP018885 vlCDR3
QQDYSGPRT

SEQ ID NO: 14428 - protein, 249 aa, Artificial Sequence
  Description of Artificial Sequence: Synthetic polypeptide
  XENP018886 1G6_H1_L1.140_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSVPRTFGGGTKVEIK

SEQ ID NO: 14429 - protein, 122 aa, Artificial Sequence; identical to SEQ ID NO: 10922
  Description of Artificial Sequence: Synthetic polypeptide
  VH of XENP018886

SEQ ID NO: 14430 - protein, 107 aa, Artificial Sequence
  Description of Artificial Sequence: Synthetic polypeptide
  VL of XENP018886
SIVMTQSPATLSVSPGERATLSCRASQSVSNDVAWYQQKPGQSPRLLINYASHRYTGVPDRFTGSGYGTEFTLTISSLQSEDFAVYFCQQDYSVPRTFGGGTKVEIK

SEQ ID NO: 14431 - protein, 5 aa, Artificial Sequence
  Description of Artificial Sequence: Synthetic peptide
  XENP018886 vhCDR1
NYWMN

SEQ ID NO: 14432 - protein, 19 aa, Artificial Sequence
  Description of Artificial Sequence: Synthetic peptide
  XENP018886 vhCDR2
EIRLKSNNYATHYAEPVKG

SEQ ID NO: 14433 - protein, 11 aa, Artificial Sequence
  Description of Artificial Sequence: Synthetic peptide
  XENP018886 vhCDR3
YYGNYGGYFDV

SEQ ID NO: 14434 - protein, 11 aa, Artificial Sequence
  Description of Artificial Sequence: Synthetic peptide
  XENP018886 vlCDR1
RASQSVSNDVA

SEQ ID NO: 14435 - protein, 7 aa, Artificial Sequence
  Description of Artificial Sequence: Synthetic peptide
  XENP018886 vlCDR2
YASHRYT

SEQ ID NO: 14436 - protein, 9 aa, Artificial Sequence
  Description of Artificial Sequence: Synthetic peptide
  XENP018886 vlCDR3
QQDYSVPRT

SEQ ID NO: 14437 - protein, 249 aa, Artificial Sequence
  Description of Artificial Sequence: Synthetic polypeptide
  XENP018887 1G6_H1_L1.141_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSHPRTFGGGTKVEIK

SEQ ID NO: 14438 - protein, 122 aa, Artificial Sequence; identical to SEQ ID NO: 10922
  Description of Artificial Sequence: Synthetic polypeptide
  VH of XENP018887

SEQ ID NO: 14439 - protein, 107 aa, Artificial Sequence
  Description of Artificial Sequence: Synthetic polypeptide
  VL of XENP018887
SIVMTQSPATLSVSPGERATLSCRASQSVSNDVAWYQQKPGQSPRLLINYASHRYTGVPDRFTGSGYGTEFTLTISSLQSEDFAVYFCQQDYSHPRTFGGGTKVEIK

SEQ ID NO: 14440 - protein, 5 aa, Artificial Sequence
  Description of Artificial Sequence: Synthetic peptide
  XENP018887 vhCDR1
NYWMN

SEQ ID NO: 14441 - protein, 19 aa, Artificial Sequence
  Description of Artificial Sequence: Synthetic peptide
  XENP018887 vhCDR2
EIRLKSNNYATHYAEPVKG

SEQ ID NO: 14442 - protein, 11 aa, Artificial Sequence
  Description of Artificial Sequence: Synthetic peptide
  XENP018887 vhCDR3
YYGNYGGYFDV

SEQ ID NO: 14443 - protein, 11 aa, Artificial Sequence
  Description of Artificial Sequence: Synthetic peptide
  XENP018887 vlCDR1
RASQSVSNDVA

SEQ ID NO: 14444 - protein, 7 aa, Artificial Sequence
  Description of Artificial Sequence: Synthetic peptide
  XENP018887 vlCDR2
YASHRYT

SEQ ID NO: 14445 - protein, 9 aa, Artificial Sequence
  Description of Artificial Sequence: Synthetic peptide
  XENP018887 vlCDR3
QQDYSHPRT

SEQ ID NO: 14446 - protein, 249 aa, Artificial Sequence
  Description of Artificial Sequence: Synthetic polypeptide
  XENP018888 1G6_H1_L1.142_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSDPRTFGGGTKVEIK

SEQ ID NO: 14447 - protein, 122 aa, Artificial Sequence; identical to SEQ ID NO: 10922
  Description of Artificial Sequence: Synthetic polypeptide
  VH of XENP018888

SEQ ID NO: 14448 - protein, 107 aa, Artificial Sequence
  Description of Artificial Sequence: Synthetic polypeptide
  VL of XENP018888
SIVMTQSPATLSVSPGERATLSCRASQSVSNDVAWYQQKPGQSPRLLINYASHRYTGVPDRFTGSGYGTEFTLTISSLQSEDFAVYFCQQDYSDPRTFGGGTKVEIK

SEQ ID NO: 14449 - protein, 5 aa, Artificial Sequence
  Description of Artificial Sequence: Synthetic peptide
  XENP018888 vhCDR1
NYWMN

SEQ ID NO: 14450 - protein, 19 aa, Artificial Sequence
  Description of Artificial Sequence: Synthetic peptide
  XENP018888 vhCDR2
EIRLKSNNYATHYAEPVKG

SEQ ID NO: 14451 - protein, 11 aa, Artificial Sequence
  Description of Artificial Sequence: Synthetic peptide
  XENP018888 vhCDR3
YYGNYGGYFDV

SEQ ID NO: 14452 - protein, 11 aa, Artificial Sequence
  Description of Artificial Sequence: Synthetic peptide
  XENP018888 vlCDR1
RASQSVSNDVA

SEQ ID NO: 14453 - protein, 7 aa, Artificial Sequence
  Description of Artificial Sequence: Synthetic peptide
  XENP018888 vlCDR2
YASHRYT

SEQ ID NO: 14454 - protein, 9 aa, Artificial Sequence
  Description of Artificial Sequence: Synthetic peptide
  XENP018888 vlCDR3
QQDYSDPRT

SEQ ID NO: 14455 - protein, 249 aa, Artificial Sequence
  Description of Artificial Sequence: Synthetic polypeptide
  XENP018889 1G6_H1_L1.143_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSKPRTFGGGTKVEIK

SEQ ID NO: 14456 - protein, 122 aa, Artificial Sequence; identical to SEQ ID NO: 10922
  Description of Artificial Sequence: Synthetic polypeptide
  VH of XENP018889

SEQ ID NO: 14457 - protein, 107 aa, Artificial Sequence
  Description of Artificial Sequence: Synthetic polypeptide
  VL of XENP018889
SIVMTQSPATLSVSPGERATLSCRASQSVSNDVAWYQQKPGQSPRLLINYASHRYTGVPDRFTGSGYGTEFTLTISSLQSEDFAVYFCQQDYSKPRTFGGGTKVEIK

SEQ ID NO: 14458 - protein, 5 aa, Artificial Sequence
  Description of Artificial Sequence: Synthetic peptide
  XENP018889 vhCDR1
NYWMN

SEQ ID NO: 14459 - protein, 19 aa, Artificial Sequence
  Description of Artificial Sequence: Synthetic peptide
  XENP018889 vhCDR2
EIRLKSNNYATHYAEPVKG

SEQ ID NO: 14460 - protein, 11 aa, Artificial Sequence
  Description of Artificial Sequence: Synthetic peptide
  XENP018889 vhCDR3
YYGNYGGYFDV

SEQ ID NO: 14461 - protein, 11 aa, Artificial Sequence
  Description of Artificial Sequence: Synthetic peptide
  XENP018889 vlCDR1
RASQSVSNDVA

SEQ ID NO: 14462 - protein, 7 aa, Artificial Sequence
  Description of Artificial Sequence: Synthetic peptide
  XENP018889 vlCDR2
YASHRYT

SEQ ID NO: 14463 - protein, 9 aa, Artificial Sequence
  Description of Artificial Sequence: Synthetic peptide
  XENP018889 vlCDR3
QQDYSKPRT

SEQ ID NO: 14464 - protein, 249 aa, Artificial Sequence
  Description of Artificial Sequence: Synthetic polypeptide
  XENP018890 1G6_H1_L1.144_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSFPRTFGGGTKVEIK

SEQ ID NO: 14465 - protein, 122 aa, Artificial Sequence; identical to SEQ ID NO: 10922
  Description of Artificial Sequence: Synthetic polypeptide
  VH of XENP018890

SEQ ID NO: 14466 - protein, 107 aa, Artificial Sequence
  Description of Artificial Sequence: Synthetic polypeptide
  VL of XENP018890
SIVMTQSPATLSVSPGERATLSCRASQSVSNDVAWYQQKPGQSPRLLINYASHRYTGVPDRFTGSGYGTEFTLTISSLQSEDFAVYFCQQDYSFPRTFGGGTKVEIK

SEQ ID NO: 14467 - protein, 5 aa, Artificial Sequence
  Description of Artificial Sequence: Synthetic peptide
  XENP018890 vhCDR1
NYWMN

SEQ ID NO: 14468 - protein, 19 aa, Artificial Sequence
  Description of Artificial Sequence: Synthetic peptide
  XENP018890 vhCDR2
EIRLKSNNYATHYAEPVKG

SEQ ID NO: 14469 - protein, 11 aa, Artificial Sequence
  Description of Artificial Sequence: Synthetic peptide
  XENP018890 vhCDR3
YYGNYGGYFDV

SEQ ID NO: 14470 - protein, 11 aa, Artificial Sequence
  Description of Artificial Sequence: Synthetic peptide
  XENP018890 vlCDR1
RASQSVSNDVA

SEQ ID NO: 14471 - protein, 7 aa, Artificial Sequence
  Description of Artificial Sequence: Synthetic peptide
  XENP018890 vlCDR2
YASHRYT

SEQ ID NO: 14472 - protein, 9 aa, Artificial Sequence
  Description of Artificial Sequence: Synthetic peptide
  XENP018890 vlCDR3
QQDYSFPRT

SEQ ID NO: 14473 - protein, 249 aa, Artificial Sequence
  Description of Artificial Sequence: Synthetic polypeptide
  XENP018891 1G6_H1_L1.145_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKLEIK

SEQ ID NO: 14474 - protein, 122 aa, Artificial Sequence; identical to SEQ ID NO: 10922
  Description of Artificial Sequence: Synthetic polypeptide
  VH of XENP018891

SEQ ID NO: 14475 - protein, 107 aa, Artificial Sequence
  Description of Artificial Sequence: Synthetic polypeptide
  VL of XENP018891
SIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKLEIK

SEQ ID NO: 14476 - protein, 5 aa, Artificial Sequence
  Description of Artificial Sequence: Synthetic peptide
  XENP018891 vhCDR1
NYWMN

SEQ ID NO: 14477 - protein, 19 aa, Artificial Sequence
  Description of Artificial Sequence: Synthetic peptide
  XENP018891 vhCDR2
EIRLKSNNYATHYAEPVKG

SEQ ID NO: 14478 - protein, 11 aa, Artificial Sequence
  Description of Artificial Sequence: Synthetic peptide
  XENP018891 vhCDR3
YYGNYGGYFDV

SEQ ID NO: 14479 - protein, 11 aa, Artificial Sequence
  Description of Artificial Sequence: Synthetic peptide
  XENP018891 vlCDR1
RASQSVSNDVA

SEQ ID NO: 14480 - protein, 7 aa, Artificial Sequence
  Description of Artificial Sequence: Synthetic peptide
  XENP018891 vlCDR2
YASHRYT

SEQ ID NO: 14481 - protein, 9 aa, Artificial Sequence
  Description of Artificial Sequence: Synthetic peptide
  XENP018891 vlCDR3
QQDYSSPRT

SEQ ID NO: 14482 - protein, 249 aa, Artificial Sequence
  Description of Artificial Sequence: Synthetic polypeptide
  XENP018895 1G6_H0L0_scFv(GKPGS)4
EVKLEESGGGLVQPGGSMKLSCVASGFTFSNYWMNWVRQSPEKGLEWVAEIRLKSNNYATHYAESVKGRFTISRDDSKSSVYLQMNNLRAEDTGIYYCTRYYGNYGGYFDVWGAGTTVTVSSGKPGSGKPGSGKPGSGKPGSSIVMTQTPKFLLVSAGDRVTITCKASQSVSNDVAWYQQKPGQSPKLLINYASHRYTGVPDRFTGSGYGTDFTFTISTVQAEDLAVYFCQQDYSSPRTFGGGTKLEIK

SEQ ID NO: 14483 - protein, 122 aa, Artificial Sequence
  Description of Artificial Sequence: Synthetic polypeptide
  VH of XENP018895
EVKLEESGGGLVQPGGSMKLSCVASGFTFSNYWMNWVRQSPEKGLEWVAEIRLKSNNYATHYAESVKGRFTISRDDSKSSVYLQMNNLRAEDTGIYYCTRYYGNYGGYFDVWGAGTTVTVSS

SEQ ID NO: 14484 - protein, 107 aa, Artificial Sequence
  Description of Artificial Sequence: Synthetic polypeptide
  VL of XENP018895
SIVMTQTPKFLLVSAGDRVTITCKASQSVSNDVAWYQQKPGQSPKLLINYASHRYTGVPDRFTGSGYGTDFTFTISTVQAEDLAVYFCQQDYSSPRTFGGGTKLEIK

SEQ ID NO: 14485 - protein, 5 aa, Artificial Sequence
  Description of Artificial Sequence: Synthetic peptide
  XENP018895 vhCDR1
NYWMN

SEQ ID NO: 14486 - protein, 19 aa, Artificial Sequence
  Description of Artificial Sequence: Synthetic peptide
  XENP018895 vhCDR2
EIRLKSNNYATHYAESVKG

SEQ ID NO: 14487 - protein, 11 aa, Artificial Sequence
  Description of Artificial Sequence: Synthetic peptide
  XENP018895 vhCDR3
YYGNYGGYFDV

SEQ ID NO: 14488 - protein, 11 aa, Artificial Sequence
  Description of Artificial Sequence: Synthetic peptide
  XENP018895 vlCDR1
KASQSVSNDVA

SEQ ID NO: 14489 - protein, 7 aa, Artificial Sequence
  Description of Artificial Sequence: Synthetic peptide
  XENP018895 vlCDR2
YASHRYT

SEQ ID NO: 14490 - protein, 9 aa, Artificial Sequence
  Description of Artificial Sequence: Synthetic peptide
  XENP018895 vlCDR3
QQDYSSPRT

SEQ ID NO: 14491 - protein, 249 aa, Artificial Sequence
  Description of Artificial Sequence: Synthetic polypeptide
  XENP018896 1G6_L1H1_scFv(GKPGS)4
SIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIKGKPGSGKPGSGKPGSGKPGSEVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSS

SEQ ID NO: 14492 - protein, 107 aa, Artificial Sequence; identical to SEQ ID NO: 10923
  Description of Artificial Sequence: Synthetic polypeptide
  VH of XENP018896

SEQ ID NO: 14493 - protein, 122 aa, Artificial Sequence; identical to SEQ ID NO: 10922
  Description of Artificial Sequence: Synthetic polypeptide
  VL of XENP018896

SEQ ID NO: 14494 - protein, 11 aa, Artificial Sequence
  Description of Artificial Sequence: Synthetic peptide
  XENP018896 vhCDR1
RASQSVSNDVA

SEQ ID NO: 14495 - protein, 7 aa, Artificial Sequence
  Description of Artificial Sequence: Synthetic peptide
  XENP018896 vhCDR2
YASHRYT

SEQ ID NO: 14496 - protein, 9 aa, Artificial Sequence
  Description of Artificial Sequence: Synthetic peptide
  XENP018896 vhCDR3
QQDYSSPRT

SEQ ID NO: 14497 - protein, 5 aa, Artificial Sequence
  Description of Artificial Sequence: Synthetic peptide
  XENP018896 vlCDR1
NYWMN

SEQ ID NO: 14498 - protein, 19 aa, Artificial Sequence
  Description of Artificial Sequence: Synthetic peptide
  XENP018896 vlCDR2
EIRLKSNNYATHYAEPVKG

SEQ ID NO: 14499 - protein, 11 aa, Artificial Sequence
  Description of Artificial Sequence: Synthetic peptide
  XENP018896 vlCDR3
YYGNYGGYFDV

SEQ ID NO: 14500 - protein, 244 aa, Artificial Sequence
  Description of Artificial Sequence: Synthetic polypeptide
  XENP018901 6A3_H0L0_scFv(GKPGS)4
EVKLVESGGGLVKPGGSLKLSCAASGFTFSSYGMSWVRQTPEKRLEWVATISGGGRYTYYPDSVKGRFTISRDNAKNNLYLQMSSLRSEDTALYYCASYYDSSFDYWGQGTTLTVSSGKPGSGKPGSGKPGSGKPGSDIVMTQSHKFMSTSVGDRVSITCKASQDVGTAVAWYQQKPGQSPKLLIYWASTRHTGVPDRFTGSGSGTDFTLTISNVQSEDLADYFCQHYSIYPWTFGGGTKLEIK

SEQ ID NO: 14501 - protein, 117 aa, Artificial Sequence
  Description of Artificial Sequence: Synthetic polypeptide
  VH of XENP018901
EVKLVESGGGLVKPGGSLKLSCAASGFTFSSYGMSWVRQTPEKRLEWVATISGGGRYTYYPDSVKGRFTISRDNAKNNLYLQMSSLRSEDTALYYCASYYDSSFDYWGQGTTLTVSS

SEQ ID NO: 14502 - protein, 107 aa, Artificial Sequence
  Description of Artificial Sequence: Synthetic polypeptide
  VL of XENP018901
DIVMTQSHKFMSTSVGDRVSITCKASQDVGTAVAWYQQKPGQSPKLLIYWASTRHTGVPDRFTGSGSGTDFTLTISNVQSEDLADYFCQHYSIYPWTFGGGTKLEIK

SEQ ID NO: 14503 - protein, 5 aa, Artificial Sequence
  Description of Artificial Sequence: Synthetic peptide
  XENP018901 vhCDR1
SYGMS

SEQ ID NO: 14504 - protein, 17 aa, Artificial Sequence
  Description of Artificial Sequence: Synthetic peptide
  XENP018901 vhCDR2
TISGGGRYTYYPDSVKG

SEQ ID NO: 14505 - protein, 8 aa, Artificial Sequence
  Description of Artificial Sequence: Synthetic peptide
  XENP018901 vhCDR3
YYDSSFDY

SEQ ID NO: 14506 - protein, 11 aa, Artificial Sequence
  Description of Artificial Sequence: Synthetic peptide
  XENP018901 vlCDR1
KASQDVGTAVA

SEQ ID NO: 14507 - protein, 7 aa, Artificial Sequence
  Description of Artificial Sequence: Synthetic peptide
  XENP018901 vlCDR2
WASTRHT

SEQ ID NO: 14508 - protein, 9 aa, Artificial Sequence
  Description of Artificial Sequence: Synthetic peptide
  XENP018901 vlCDR3
QHYSIYPWT

SEQ ID NO: 14509 - protein, 244 aa, Artificial Sequence
  Description of Artificial Sequence: Synthetic polypeptide
  XENP018902 6A3_L3_H1.1_scFv(GKPGS)4
DIVMTQSPSSLSASVGDRVTITCRASQDVGTAVAWYQQKPGKSPKLLIYWASTRHTGVPDRFTGSGSGTDFTLTISSLQPEDFATYFCQHYSIYPWTFGGGTKVEIKGKPGSGKPGSGKPGSGKPGSEVQLLESGGGLVQPGGSLRLSCAASGFTFSSYGMSWVRQAPGKGLEWVSTISGGGRYTYYPDSVKGRFTISRDNSKNTLYLQMNSLRAEDTAVYYCASYYDSSFDYWGQGTLVTVSS

SEQ ID NO: 14510 - protein, 107 aa, Artificial Sequence; identical to SEQ ID NO: 11013
  Description of Artificial Sequence: Synthetic polypeptide
  VH of XENP018902

SEQ ID NO: 14511 - protein, 117 aa, Artificial Sequence; identical to SEQ ID NO: 11030
  Description of Artificial Sequence: Synthetic polypeptide
  VL of XENP018902

SEQ ID NO: 14512 - protein, 11 aa, Artificial Sequence
  Description of Artificial Sequence: Synthetic peptide
  XENP018902 vhCDR1
RASQDVGTAVA

SEQ ID NO: 14513 - protein, 7 aa, Artificial Sequence
  Description of Artificial Sequence: Synthetic peptide
  XENP018902 vhCDR2
WASTRHT

SEQ ID NO: 14514 - protein, 9 aa, Artificial Sequence
  Description of Artificial Sequence: Synthetic peptide
  XENP018902 vhCDR3
QHYSIYPWT

SEQ ID NO: 14515 - protein, 5 aa, Artificial Sequence
  Description of Artificial Sequence: Synthetic peptide
  XENP018902 vlCDR1
SYGMS

SEQ ID NO: 14516 - protein, 17 aa, Artificial Sequence
  Description of Artificial Sequence: Synthetic peptide
  XENP018902 vlCDR2
TISGGGRYTYYPDSVKG

SEQ ID NO: 14517 - protein, 9 aa, Artificial Sequence
  Description of Artificial Sequence: Synthetic peptide
  XENP018902 vlCDR3
SYYDSSFDY

SEQ ID NO: 14518 - protein, 249 aa, Artificial Sequence
  Description of Artificial Sequence: Synthetic polypeptide
  XENP018921 1G6_H1L3_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPLSLPVTPGEPASISCRASQSVSNDVAWYLQKPGQSPQLLINYASHRYTGVPDRFTGSGYGTDFTLKISRVEAEDVGVYFCQQDYSSPRTFGGGTKVEIK

SEQ ID NO: 14519 - protein, 122 aa, Artificial Sequence; identical to SEQ ID NO: 10922
  Description of Artificial Sequence: Synthetic polypeptide
  VH of XENP018921

SEQ ID NO: 14520 - protein, 107 aa, Artificial Sequence
  Description of Artificial Sequence: Synthetic polypeptide
  VL of XENP018921
SIVMTQSPLSLPVTPGEPASISCRASQSVSNDVAWYLQKPGQSPQLLINYASHRYTGVPDRFTGSGYGTDFTLKISRVEAEDVGVYFCQQDYSSPRTFGGGTKVEIK

SEQ ID NO: 14521 - protein, 5 aa, Artificial Sequence
  Description of Artificial Sequence: Synthetic peptide
  XENP018921 vhCDR1
NYWMN

SEQ ID NO: 14522 - protein, 19 aa, Artificial Sequence
  Description of Artificial Sequence: Synthetic peptide
  XENP018921 vhCDR2
EIRLKSNNYATHYAEPVKG

SEQ ID NO: 14523 - protein, 11 aa, Artificial Sequence
  Description of Artificial Sequence: Synthetic peptide
  XENP018921 vhCDR3
YYGNYGGYFDV

SEQ ID NO: 14524 - protein, 11 aa, Artificial Sequence
  Description of Artificial Sequence: Synthetic peptide
  XENP018921 vlCDR1
RASQSVSNDVA

SEQ ID NO: 14525 - protein, 7 aa, Artificial Sequence
  Description of Artificial Sequence: Synthetic peptide
  XENP018921 vlCDR2
YASHRYT

SEQ ID NO: 14526 - protein, 9 aa, Artificial Sequence
  Description of Artificial Sequence: Synthetic peptide
  XENP018921 vlCDR3
QQDYSSPRT

SEQ ID NO: 14527 - protein, 249 aa, Artificial Sequence
  Description of Artificial Sequence: Synthetic polypeptide
  XENP018922 1G6_H1L4_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPGTLSLSPGERATLSCRASQSVSNDVAWYQQKPGQSPRLLINYASHRYTGVPDRFTGSGYGTDFTLTISRLEPEDFAVYFCQQDYSSPRTFGGGTKVEIK

SEQ ID NO: 14528 - protein, 122 aa, Artificial Sequence; identical to SEQ ID NO: 10922
  Description of Artificial Sequence: Synthetic polypeptide
  VH of XENP018922

SEQ ID NO: 14529 - protein, 107 aa, Artificial Sequence
  Description of Artificial Sequence: Synthetic polypeptide
  VL of XENP018922
SIVMTQSPGTLSLSPGERATLSCRASQSVSNDVAWYQQKPGQSPRLLINYASHRYTGVPDRFTGSGYGTDFTLTISRLEPEDFAVYFCQQDYSSPRTFGGGTKVEIK

SEQ ID NO: 14530 - protein, 5 aa, Artificial Sequence
  Description of Artificial Sequence: Synthetic peptide
  XENP018922 vhCDR1
NYWMN

SEQ ID NO: 14531 - protein, 19 aa, Artificial Sequence
  Description of Artificial Sequence: Synthetic peptide
  XENP018922 vhCDR2
EIRLKSNNYATHYAEPVKG

SEQ ID NO: 14532 - protein, 11 aa, Artificial Sequence
  Description of Artificial Sequence: Synthetic peptide
  XENP018922 vhCDR3
YYGNYGGYFDV

SEQ ID NO: 14533 - protein, 11 aa, Artificial Sequence
  Description of Artificial Sequence: Synthetic peptide
  XENP018922 vlCDR1
RASQSVSNDVA

SEQ ID NO: 14534 - protein, 7 aa, Artificial Sequence
  Description of Artificial Sequence: Synthetic peptide
  XENP018922 vlCDR2
YASHRYT

SEQ ID NO: 14535 - protein, 9 aa, Artificial Sequence
  Description of Artificial Sequence: Synthetic peptide
  XENP018922 vlCDR3
QQDYSSPRT

SEQ ID NO: 14536 - protein, 249 aa, Artificial Sequence
  Description of Artificial Sequence: Synthetic polypeptide
  XENP018923 1G6_H1L5_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPDSLAVSLGERATINCKASQSVSNDVAWYQQKPGQSPKLLINYASHRYTGVPDRFTGSGYGTDFTLTISSLQAEDVAVYFCQQDYSSPRTFGGGTKVEIK

SEQ ID NO: 14537 - protein, 122 aa, Artificial Sequence; identical to SEQ ID NO: 10922
  Description of Artificial Sequence: Synthetic polypeptide
  VH of XENP018923

SEQ ID NO: 14538 - protein, 107 aa, Artificial Sequence
  Description of Artificial Sequence: Synthetic polypeptide
  VL of XENP018923
SIVMTQSPDSLAVSLGERATINCKASQSVSNDVAWYQQKPGQSPKLLINYASHRYTGVPDRFTGSGYGTDFTLTISSLQAEDVAVYFCQQDYSSPRTFGGGTKVEIK

SEQ ID NO: 14539 - protein, 5 aa, Artificial Sequence
  Description of Artificial Sequence: Synthetic peptide
  XENP018923 vhCDR1
NYWMN

SEQ ID NO: 14540 - protein, 19 aa, Artificial Sequence
  Description of Artificial Sequence: Synthetic peptide
  XENP018923 vhCDR2
EIRLKSNNYATHYAEPVKG

SEQ ID NO: 14541 - protein, 11 aa, Artificial Sequence
  Description of Artificial Sequence: Synthetic peptide
  XENP018923 vhCDR3
YYGNYGGYFDV

SEQ ID NO: 14542 - protein, 11 aa, Artificial Sequence
  Description of Artificial Sequence: Synthetic peptide
  XENP018923 vlCDR1
KASQSVSNDVA

SEQ ID NO: 14543 - protein, 7 aa, Artificial Sequence
  Description of Artificial Sequence: Synthetic peptide
  XENP018923 vlCDR2
YASHRYT

SEQ ID NO: 14544 - protein, 9 aa, Artificial Sequence
  Description of Artificial Sequence: Synthetic peptide
  XENP018923 vlCDR3
QQDYSSPRT

SEQ ID NO: 14545 - protein, 249 aa, Artificial Sequence
  Description of Artificial Sequence: Synthetic polypeptide
  XENP018924 1G6_H2L1_scFv(GKPGS)4
QVQLVQSGAEVKKPGASVKVSCKASGFTFSNYWMNWVRQAPGQGLEWMGEIRLKSNNYATHYAEKFQGRVTMTRDDSTSTVYMELSSLRSEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 14546 - protein, 122 aa, Artificial Sequence
  Description of Artificial Sequence: Synthetic polypeptide
  VH of XENP018924
QVQLVQSGAEVKKPGASVKVSCKASGFTFSNYWMNWVRQAPGQGLEWMGEIRLKSNNYATHYAEKFQGRVTMTRDDSTSTVYMELSSLRSEDTAVYYCTRYYGNYGGYFDVWGAGTLVTVSS

SEQ ID NO: 14547 - protein, 107 aa, Artificial Sequence; identical to SEQ ID NO: 10923
  Description of Artificial Sequence: Synthetic polypeptide
  VL of XENP018924

SEQ ID NO: 14548 - protein, 5 aa, Artificial Sequence
  Description of Artificial Sequence: Synthetic peptide
  XENP018924 vhCDR1
NYWMN

SEQ ID NO: 14549 - protein, 19 aa, Artificial Sequence
  Description of Artificial Sequence: Synthetic peptide
  XENP018924 vhCDR2
EIRLKSNNYATHYAEKFQG

SEQ ID NO: 14550 - protein, 11 aa, Artificial Sequence
  Description of Artificial Sequence: Synthetic peptide
  XENP018924 vhCDR3
YYGNYGGYFDV

SEQ ID NO: 14551 - protein, 11 aa, Artificial Sequence
  Description of Artificial Sequence: Synthetic peptide
  XENP018924 vlCDR1
RASQSVSNDVA

SEQ ID NO: 14552 - protein, 7 aa, Artificial Sequence
  Description of Artificial Sequence: Synthetic peptide
  XENP018924 vlCDR2
YASHRYT

SEQ ID NO: 14553 - protein, 9 aa, Artificial Sequence
  Description of Artificial Sequence: Synthetic peptide
  XENP018924 vlCDR3
QQDYSSPRT

SEQ ID NO: 14554 - protein, 249 aa, Artificial Sequence
  Description of Artificial Sequence: Synthetic polypeptide
  XENP018925 1G6_H2L2_scFv(GKPGS)4
QVQLVQSGAEVKKPGASVKVSCKASGFTFSNYWMNWVRQAPGQGLEWMGEIRLKSNNYATHYAEKFQGRVTMTRDDSTSTVYMELSSLRSEDTAVYYCTRYYGNYGGYFDVWGAGTLVTVSSGKPGSGKPGSGKPGSGKPGSSIVMTQSPSSLSASVGDRVTITCRASQSVSNDVAWYQQKPGKSPKLLINYASHRYTGVPDRFTGSGYGTDFTLTISSLQPEDFATYFCQQDYSSPRTFGGGTKVEIK

SEQ ID NO: 14555 - protein, 122 aa, Artificial Sequence; identical to SEQ ID NO: 14546
  Description of Artificial Sequence: Synthetic polypeptide
  VH of XENP018925

SEQ ID NO: 14556 - protein, 107 aa, Artificial Sequence; identical to SEQ ID NO: 10932
  Description of Artificial Sequence: Synthetic polypeptide
  VL of XENP018925

SEQ ID NO: 14557 - protein, 5 aa, Artificial Sequence
  Description of Artificial Sequence: Synthetic peptide
  XENP018925 vhCDR1
NYWMN

SEQ ID NO: 14558 - protein, 19 aa, Artificial Sequence
  Description of Artificial Sequence: Synthetic peptide
  XENP018925 vhCDR2
EIRLKSNNYATHYAEKFQG

SEQ ID NO: 14559 - protein, 11 aa, Artificial Sequence
  Description of Artificial Sequence: Synthetic peptide
  XENP018925 vhCDR3
YYGNYGGYFDV

SEQ ID NO: 14560 - protein, 11 aa, Artificial Sequence
  Description of Artificial Sequence: Synthetic peptide
  XENP018925 vlCDR1
RASQSVSNDVA

SEQ ID NO: 14561 - protein, 7 aa, Artificial Sequence
  Description of Artificial Sequence: Synthetic peptide
  XENP018925 vlCDR2
YASHRYT

SEQ ID NO: 14562 - protein, 9 aa, Artificial Sequence
  Description of Artificial Sequence: Synthetic peptide
  XENP018925 vlCDR3
QQDYSSPRT

SEQ ID NO: 14563 - protein, 249 aa, Artificial Sequence
  Description of Artificial Sequence: Synthetic polypeptide
  XENP018926 1G6_H2L3_scFv(GKPGS)4
QVQLVQSGAEVKKPGASVKVSCKASGFTFSNYWMNWVRQAPGQGLEWMGEIRLKSNNYATHYAEKFQGRVTMTRDDSTSTVYMELSSLRSEDTAVYYCTRYYGNYGGYFDVWGAGTLVTVSSGKPGSGKPGSGKPGSGKPGSSIVMTQSPLSLPVTPGEPASISCRASQSVSNDVAWYLQKPGQSPQLLINYASHRYTGVPDRFTGSGYGTDFTLKISRVEAEDVGVYFCQQDYSSPRTFGGGTKVEIK

SEQ ID NO: 14564 - protein, 122 aa, Artificial Sequence; identical to SEQ ID NO: 14546
  Description of Artificial Sequence: Synthetic polypeptide
  VH of XENP018926

SEQ ID NO: 14565 - protein, 107 aa, Artificial Sequence; identical to SEQ ID NO: 14520
  Description of Artificial Sequence: Synthetic polypeptide
  VL of XENP018926

SEQ ID NO: 14566 - protein, 5 aa, Artificial Sequence
  Description of Artificial Sequence: Synthetic peptide
  XENP018926 vhCDR1
NYWMN

SEQ ID NO: 14567 - protein, 19 aa, Artificial Sequence
  Description of Artificial Sequence: Synthetic peptide
  XENP018926 vhCDR2
EIRLKSNNYATHYAEKFQG

SEQ ID NO: 14568 - protein, 11 aa, Artificial Sequence
  Description of Artificial Sequence: Synthetic peptide
  XENP018926 vhCDR3
YYGNYGGYFDV

SEQ ID NO: 14569 - protein, 11 aa, Artificial Sequence
  Description of Artificial Sequence: Synthetic peptide
  XENP018926 vlCDR1
RASQSVSNDVA

SEQ ID NO: 14570 - protein, 7 aa, Artificial Sequence
  Description of Artificial Sequence: Synthetic peptide
  XENP018926 vlCDR2
YASHRYT

SEQ ID NO: 14571 - protein, 9 aa, Artificial Sequence
  Description of Artificial Sequence: Synthetic peptide
  XENP018926 vlCDR3
QQDYSSPRT

SEQ ID NO: 14572 - protein, 249 aa, Artificial Sequence
  Description of Artificial Sequence: Synthetic polypeptide
  XENP018927 1G6_H2L4_scFv(GKPGS)4
QVQLVQSGAEVKKPGASVKVSCKASGFTFSNYWMNWVRQAPGQGLEWMGEIRLKSNNYATHYAEKFQGRVTMTRDDSTSTVYMELSSLRSEDTAVYYCTRYYGNYGGYFDVWGAGTLVTVSSGKPGSGKPGSGKPGSGKPGSSIVMTQSPGTLSLSPGERATLSCRASQSVSNDVAWYQQKPGQSPRLLINYASHRYTGVPDRFTGSGYGTDFTLTISRLEPEDFAVYFCQQDYSSPRTFGGGTKVEIK

SEQ ID NO: 14573 - protein, 122 aa, Artificial Sequence; identical to SEQ ID NO: 14546
  Description of Artificial Sequence: Synthetic polypeptide
  VH of XENP018927

SEQ ID NO: 14574 - protein, 107 aa, Artificial Sequence; identical to SEQ ID NO: 14529
  Description of Artificial Sequence: Synthetic polypeptide
  VL of XENP018927

SEQ ID NO: 14575 - protein, 5 aa, Artificial Sequence
  Description of Artificial Sequence: Synthetic peptide
  XENP018927 vhCDR1
NYWMN

SEQ ID NO: 14576 - protein, 19 aa, Artificial Sequence
  Description of Artificial Sequence: Synthetic peptide
  XENP018927 vhCDR2
EIRLKSNNYATHYAEKFQG

SEQ ID NO: 14577 - protein, 11 aa, Artificial Sequence
  Description of Artificial Sequence: Synthetic peptide
  XENP018927 vhCDR3
YYGNYGGYFDV

SEQ ID NO: 14578 - protein, 11 aa, Artificial Sequence
  Description of Artificial Sequence: Synthetic peptide
  XENP018927 vlCDR1
RASQSVSNDVA

SEQ ID NO: 14579 - protein, 7 aa, Artificial Sequence
  Description of Artificial Sequence: Synthetic peptide
  XENP018927 vlCDR2
YASHRYT

SEQ ID NO: 14580 - protein, 9 aa, Artificial Sequence
  Description of Artificial Sequence: Synthetic peptide
  XENP018927 vlCDR3
QQDYSSPRT

SEQ ID NO: 14581 - protein, 249 aa, Artificial Sequence
  Description of Artificial Sequence: Synthetic polypeptide
  XENP018928 1G6_H2L5_scFv(GKPGS)4
QVQLVQSGAEVKKPGASVKVSCKASGFTFSNYWMNWVRQAPGQGLEWMGEIRLKSNNYATHYAEKFQGRVTMTRDDSTSTVYMELSSLRSEDTAVYYCTRYYGNYGGYFDVWGAGTLVTVSSGKPGSGKPGSGKPGSGKPGSSIVMTQSPDSLAVSLGERATINCKASQSVSNDVAWYQQKPGQSPKLLINYASHRYTGVPDRFTGSGYGTDFTLTISSLQAEDVAVYFCQQDYSSPRTFGGGTKVEIK

SEQ ID NO: 14582 - protein, 122 aa, Artificial Sequence; identical to SEQ ID NO: 14546
  Description of Artificial Sequence: Synthetic polypeptide
  VH of XENP018928

SEQ ID NO: 14583 - protein, 107 aa, Artificial Sequence; identical to SEQ ID NO: 14538
  Description of Artificial Sequence: Synthetic polypeptide
  VL of XENP018928

SEQ ID NO: 14584 - protein, 5 aa, Artificial Sequence
  Description of Artificial Sequence: Synthetic peptide
  XENP018928 vhCDR1
NYWMN

SEQ ID NO: 14585 - protein, 19 aa, Artificial Sequence
  Description of Artificial Sequence: Synthetic peptide
  XENP018928 vhCDR2
EIRLKSNNYATHYAEKFQG

SEQ ID NO: 14586 - protein, 11 aa, Artificial Sequence
  Description of Artificial Sequence: Synthetic peptide
  XENP018928 vhCDR3
YYGNYGGYFDV

SEQ ID NO: 14587 - protein, 11 aa, Artificial Sequence
  Description of Artificial Sequence: Synthetic peptide
  XENP018928 vlCDR1
KASQSVSNDVA

SEQ ID NO: 14588 - protein, 7 aa, Artificial Sequence
  Description of Artificial Sequence: Synthetic peptide
  XENP018928 vlCDR2
YASHRYT

SEQ ID NO: 14589 - protein, 9 aa, Artificial Sequence
  Description of Artificial Sequence: Synthetic peptide
  XENP018928 vlCDR3
QQDYSSPRT

SEQ ID NO: 14590 - protein, 249 aa, Artificial Sequence
  Description of Artificial Sequence: Synthetic polypeptide
  XENP018929 1G6_H3L1_scFv(GKPGS)4
EVQLLESGGGLVQPGGSLRLSCAASGFTFSNYWMNWVRQAPGKGLEWVSEIRLKSNNYATHYAESVKGRFTISRDDSKSTVYLQMNSLRAEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 14591 - protein, 122 aa, Artificial Sequence
  Description of Artificial Sequence: Synthetic polypeptide
  VH of XENP018929
EVQLLESGGGLVQPGGSLRLSCAASGFTFSNYWMNWVRQAPGKGLEWVSEIRLKSNNYATHYAESVKGRFTISRDDSKSTVYLQMNSLRAEDTAVYYCTRYYGNYGGYFDVWGAGTLVTVSS

SEQ ID NO: 14592 - protein, 107 aa, Artificial Sequence; identical to SEQ ID NO: 10923
  Description of Artificial Sequence: Synthetic polypeptide
  VL of XENP018929

SEQ ID NO: 14593 - protein, 5 aa, Artificial Sequence
  Description of Artificial Sequence: Synthetic peptide
  XENP018929 vhCDR1
NYWMN

SEQ ID NO: 14594 - protein, 19 aa, Artificial Sequence
  Description of Artificial Sequence: Synthetic peptide
  XENP018929 vhCDR2
EIRLKSNNYATHYAESVKG

SEQ ID NO: 14595 - protein, 11 aa, Artificial Sequence
  Description of Artificial Sequence: Synthetic peptide
  XENP018929 vhCDR3
YYGNYGGYFDV

SEQ ID NO: 14596 - protein, 11 aa, Artificial Sequence
  Description of Artificial Sequence: Synthetic peptide
  XENP018929 vlCDR1
RASQSVSNDVA

SEQ ID NO: 14597 - protein, 7 aa, Artificial Sequence
  Description of Artificial Sequence: Synthetic peptide
  XENP018929 vlCDR2
YASHRYT

SEQ ID NO: 14598 - protein, 9 aa, Artificial Sequence
  Description of Artificial Sequence: Synthetic peptide
  XENP018929 vlCDR3
QQDYSSPRT

SEQ ID NO: 14599 - protein, 249 aa, Artificial Sequence
  Description of Artificial Sequence: Synthetic polypeptide
  XENP018930 1G6_H3L2_scFv(GKPGS)4
EVQLLESGGGLVQPGGSLRLSCAASGFTFSNYWMNWVRQAPGKGLEWVSEIRLKSNNYATHYAESVKGRFTISRDDSKSTVYLQMNSLRAEDTAVYYCTRYYGNYGGYFDVWGAGTLVTVSSGKPGSGKPGSGKPGSGKPGSSIVMTQSPSSLSASVGDRVTITCRASQSVSNDVAWYQQKPGKSPKLLINYASHRYTGVPDRFTGSGYGTDFTLTISSLQPEDFATYFCQQDYSSPRTFGGGTKVEIK

SEQ ID NO: 14600 - protein, 122 aa, Artificial Sequence; identical to SEQ ID NO: 14591
  Description of Artificial Sequence: Synthetic polypeptide
  VH of XENP018930

SEQ ID NO: 14601 - protein, 107 aa, Artificial Sequence; identical to SEQ ID NO: 10932
  Description of Artificial Sequence: Synthetic polypeptide
  VL of XENP018930

SEQ ID NO: 14602 - protein, 5 aa, Artificial Sequence
  Description of Artificial Sequence: Synthetic peptide
  XENP018930 vhCDR1
NYWMN

SEQ ID NO: 14603 - protein, 19 aa, Artificial Sequence
  Description of Artificial Sequence: Synthetic peptide
  XENP018930 vhCDR2
EIRLKSNNYATHYAESVKG

SEQ ID NO: 14604 - protein, 11 aa, Artificial Sequence
  Description of Artificial Sequence: Synthetic peptide
  XENP018930 vhCDR3
YYGNYGGYFDV

SEQ ID NO: 14605 - protein, 11 aa, Artificial Sequence
  Description of Artificial Sequence: Synthetic peptide
  XENP018930 vlCDR1
RASQSVSNDVA

SEQ ID NO: 14606 - protein, 7 aa, Artificial Sequence
  Description of Artificial Sequence: Synthetic peptide
  XENP018930 vlCDR2
YASHRYT

SEQ ID NO: 14607 - protein, 9 aa, Artificial Sequence
  Description of Artificial Sequence: Synthetic peptide
  XENP018930 vlCDR3
QQDYSSPRT

SEQ ID NO: 14608 - protein, 249 aa, Artificial Sequence
  Description of Artificial Sequence: Synthetic polypeptide
  XENP018931 1G6_H3L3_scFv(GKPGS)4
EVQLLESGGGLVQPGGSLRLSCAASGFTFSNYWMNWVRQAPGKGLEWVSEIRLKSNNYATHYAESVKGRFTISRDDSKSTVYLQMNSLRAEDTAVYYCTRYYGNYGGYFDVWGAGTLVTVSSGKPGSGKPGSGKPGSGKPGSSIVMTQSPLSLPVTPGEPASISCRASQSVSNDVAWYLQKPGQSPQLLINYASHRYTGVPDRFTGSGYGTDFTLKISRVEAEDVGVYFCQQDYSSPRTFGGGTKVEIK

SEQ ID NO: 14609 - protein, 122 aa, Artificial Sequence; identical to SEQ ID NO: 14591
  Description of Artificial Sequence: Synthetic polypeptide
  VH of XENP018931

SEQ ID NO: 14610 - protein, 107 aa, Artificial Sequence; identical to SEQ ID NO: 14520
  Description of Artificial Sequence: Synthetic polypeptide
  VL of XENP018931

SEQ ID NO: 14611 - protein, 5 aa, Artificial Sequence
  Description of Artificial Sequence: Synthetic peptide
  XENP018931 vhCDR1
NYWMN

SEQ ID NO: 14612 - protein, 19 aa, Artificial Sequence
  Description of Artificial Sequence: Synthetic peptide
  XENP018931 vhCDR2
EIRLKSNNYATHYAESVKG

SEQ ID NO: 14613 - protein, 11 aa, Artificial Sequence
  Description of Artificial Sequence: Synthetic peptide
  XENP018931 vhCDR3
YYGNYGGYFDV

SEQ ID NO: 14614 - protein, 11 aa, Artificial Sequence
  Description of Artificial Sequence: Synthetic peptide
  XENP018931 vlCDR1
RASQSVSNDVA

SEQ ID NO: 14615 - protein, 7 aa, Artificial Sequence
  Description of Artificial Sequence: Synthetic peptide
  XENP018931 vlCDR2
YASHRYT

SEQ ID NO: 14616 - protein, 9 aa, Artificial Sequence
  Description of Artificial Sequence: Synthetic peptide
  XENP018931 vlCDR3
QQDYSSPRT

SEQ ID NO: 14617 - protein, 249 aa, Artificial Sequence
  Description of Artificial Sequence: Synthetic polypeptide
  XENP018932 1G6_H3L4_scFv(GKPGS)4
EVQLLESGGGLVQPGGSLRLSCAASGFTFSNYWMNWVRQAPGKGLEWVSEIRLKSNNYATHYAESVKGRFTISRDDSKSTVYLQMNSLRAEDTAVYYCTRYYGNYGGYFDVWGAGTLVTVSSGKPGSGKPGSGKPGSGKPGSSIVMTQSPGTLSLSPGERATLSCRASQSVSNDVAWYQQKPGQSPRLLINYASHRYTGVPDRFTGSGYGTDFTLTISRLEPEDFAVYFCQQDYSSPRTFGGGTKVEIK

SEQ ID NO: 14618 - protein, 122 aa, Artificial Sequence; identical to SEQ ID NO: 14591
  Description of Artificial Sequence: Synthetic polypeptide
  VH of XENP018932

SEQ ID NO: 14619 - protein, 107 aa, Artificial Sequence; identical to SEQ ID NO: 14529
  Description of Artificial Sequence: Synthetic polypeptide
  VL of XENP018932

SEQ ID NO: 14620 - protein, 5 aa, Artificial Sequence
  Description of Artificial Sequence: Synthetic peptide
  XENP018932 vhCDR1
NYWMN

SEQ ID NO: 14621 - protein, 19 aa, Artificial Sequence
  Description of Artificial Sequence: Synthetic peptide
  XENP018932 vhCDR2
EIRLKSNNYATHYAESVKG

SEQ ID NO: 14622 - protein, 11 aa, Artificial Sequence
  Description of Artificial Sequence: Synthetic peptide
  XENP018932 vhCDR3
YYGNYGGYFDV

SEQ ID NO: 14623 - protein, 11 aa, Artificial Sequence
  Description of Artificial Sequence: Synthetic peptide
  XENP018932 vlCDR1
RASQSVSNDVA

SEQ ID NO: 14624 - protein, 7 aa, Artificial Sequence
  Description of Artificial Sequence: Synthetic peptide
  XENP018932 vlCDR2
YASHRYT

SEQ ID NO: 14625 - protein, 9 aa, Artificial Sequence
  Description of Artificial Sequence: Synthetic peptide
  XENP018932 vlCDR3
QQDYSSPRT

SEQ ID NO: 14626 - protein, 249 aa, Artificial Sequence
  Description of Artificial Sequence: Synthetic polypeptide
  XENP018933 1G6_H3L5_scFv(GKPGS)4
EVQLLESGGGLVQPGGSLRLSCAASGFTFSNYWMNWVRQAPGKGLEWVSEIRLKSNNYATHYAESVKGRFTISRDDSKSTVYLQMNSLRAEDTAVYYCTRYYGNYGGYFDVWGAGTLVTVSSGKPGSGKPGSGKPGSGKPGSSIVMTQSPDSLAVSLGERATINCKASQSVSNDVAWYQQKPGQSPKLLINYASHRYTGVPDRFTGSGYGTDFTLTISSLQAEDVAVYFCQQDYSSPRTFGGGTKVEIK

SEQ ID NO: 14627 - protein, 122 aa, Artificial Sequence; identical to SEQ ID NO: 14591
  Description of Artificial Sequence: Synthetic polypeptide
  VH of XENP018933

SEQ ID NO: 14628 - protein, 107 aa, Artificial Sequence; identical to SEQ ID NO: 14538
  Description of Artificial Sequence: Synthetic polypeptide
  VL of XENP018933

SEQ ID NO: 14629 - protein, 5 aa, Artificial Sequence
  Description of Artificial Sequence: Synthetic peptide
  XENP018933 vhCDR1
NYWMN

SEQ ID NO: 14630 - protein, 19 aa, Artificial Sequence
  Description of Artificial Sequence: Synthetic peptide
  XENP018933 vhCDR2
EIRLKSNNYATHYAESVKG

SEQ ID NO: 14631 - protein, 11 aa, Artificial Sequence
  Description of Artificial Sequence: Synthetic peptide
  XENP018933 vhCDR3
YYGNYGGYFDV

SEQ ID NO: 14632 - protein, 11 aa, Artificial Sequence
  Description of Artificial Sequence: Synthetic peptide
  XENP018933 vlCDR1
KASQSVSNDVA

SEQ ID NO: 14633 - protein, 7 aa, Artificial Sequence
  Description of Artificial Sequence: Synthetic peptide
  XENP018933 vlCDR2
YASHRYT

SEQ ID NO: 14634 - protein, 9 aa, Artificial Sequence
  Description of Artificial Sequence: Synthetic peptide
  XENP018933 vlCDR3
QQDYSSPRT

SEQ ID NO: 14635 - protein, 249 aa, Artificial Sequence
  Description of Artificial Sequence: Synthetic polypeptide
  XENP018934 1G6_H4L1_scFv(GKPGS)4
EVQLVESGGGLVQPGGSLKLSCAASGFTFSNYWMNWVRQASGKGLEWVGEIRLKSNNYATHYAESVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 14636 - protein, 122 aa, Artificial Sequence
  Description of Artificial Sequence: Synthetic polypeptide
  VH of XENP018934
EVQLVESGGGLVQPGGSLKLSCAASGFTFSNYWMNWVRQASGKGLEWVGEIRLKSNNYATHYAESVKGRFTISRDDSKSTVYLQMNSLKTEDTAVYYCTRYYGNYGGYFDVWGAGTLVTVSS

SEQ ID NO: 14637 - protein, 107 aa, Artificial Sequence; identical to SEQ ID NO: 10923
  Description of Artificial Sequence: Synthetic polypeptide
  VL of XENP018934

SEQ ID NO: 14638 - protein, 5 aa, Artificial Sequence
  Description of Artificial Sequence: Synthetic peptide
  XENP018934 vhCDR1
NYWMN

SEQ ID NO: 14639 - protein, 19 aa, Artificial Sequence
  Description of Artificial Sequence: Synthetic peptide
  XENP018934 vhCDR2
EIRLKSNNYATHYAESVKG

SEQ ID NO: 14640 - protein, 11 aa, Artificial Sequence
  Description of Artificial Sequence: Synthetic peptide
  XENP018934 vhCDR3
YYGNYGGYFDV

SEQ ID NO: 14641 - protein, 11 aa, Artificial Sequence
  Description of Artificial Sequence: Synthetic peptide
  XENP018934 vlCDR1
RASQSVSNDVA

SEQ ID NO: 14642 - protein, 7 aa, Artificial Sequence
  Description of Artificial Sequence: Synthetic peptide
  XENP018934 vlCDR2
YASHRYT

SEQ ID NO: 14643 - protein, 9 aa, Artificial Sequence
  Description of Artificial Sequence: Synthetic peptide
  XENP018934 vlCDR3
QQDYSSPRT

SEQ ID NO: 14644 - protein, 249 aa, Artificial Sequence
  Description of Artificial Sequence: Synthetic polypeptide
  XENP018935 1G6_H4L2_scFv(GKPGS)4
EVQLVESGGGLVQPGGSLKLSCAASGFTFSNYWMNWVRQASGKGLEWVGEIRLKSNNYATHYAESVKGRFTISRDDSKSTVYLQMNSLKTEDTAVYYCTRYYGNYGGYFDVWGAGTLVTVSSGKPGSGKPGSGKPGSGKPGSSIVMTQSPSSLSASVGDRVTITCRASQSVSNDVAWYQQKPGKSPKLLINYASHRYTGVPDRFTGSGYGTDFTLTISSLQPEDFATYFCQQDYSSPRTFGGGTKVEIK

SEQ ID NO: 14645 - protein, 122 aa, Artificial Sequence; identical to SEQ ID NO: 14636
  Description of Artificial Sequence: Synthetic polypeptide
  VH of XENP018935

SEQ ID NO: 14646 - protein, 107 aa, Artificial Sequence; identical to SEQ ID NO: 10932
  Description of Artificial Sequence: Synthetic polypeptide
  VL of XENP018935

SEQ ID NO: 14647 - protein, 5 aa, Artificial Sequence
  Description of Artificial Sequence: Synthetic peptide
  XENP018935 vhCDR1
NYWMN

SEQ ID NO: 14648 - protein, 19 aa, Artificial Sequence
  Description of Artificial Sequence: Synthetic peptide
  XENP018935 vhCDR2
EIRLKSNNYATHYAESVKG

SEQ ID NO: 14649 - protein, 11 aa, Artificial Sequence
  Description of Artificial Sequence: Synthetic peptide
  XENP018935 vhCDR3
YYGNYGGYFDV

SEQ ID NO: 14650 - protein, 11 aa, Artificial Sequence
  Description of Artificial Sequence: Synthetic peptide
  XENP018935 vlCDR1
RASQSVSNDVA

SEQ ID NO: 14651 - protein, 7 aa, Artificial Sequence
  Description of Artificial Sequence: Synthetic peptide
  XENP018935 vlCDR2
YASHRYT

SEQ ID NO: 14652 - protein, 9 aa, Artificial Sequence
  Description of Artificial Sequence: Synthetic peptide
  XENP018935 vlCDR3
QQDYSSPRT

SEQ ID NO: 14653 - protein, 249 aa, Artificial Sequence
  Description of Artificial Sequence: Synthetic polypeptide
  XENP018936 1G6_H4L3_scFv(GKPGS)4
EVQLVESGGGLVQPGGSLKLSCAASGFTFSNYWMNWVRQASGKGLEWVGEIRLKSNNYATHYAESVKGRFTISRDDSKSTVYLQMNSLKTEDTAVYYCTRYYGNYGGYFDVWGAGTLVTVSSGKPGSGKPGSGKPGSGKPGSSIVMTQSPLSLPVTPGEPASISCRASQSVSNDVAWYLQKPGQSPQLLINYASHRYTGVPDRFTGSGYGTDFTLKISRVEAEDVGVYFCQQDYSSPRTFGGGTKVEIK

SEQ ID NO: 14654 - protein, 122 aa, Artificial Sequence; identical to SEQ ID NO: 14636
  Description of Artificial Sequence: Synthetic polypeptide
  VH of XENP018936

SEQ ID NO: 14655 - protein, 107 aa, Artificial Sequence; identical to SEQ ID NO: 14520
  Description of Artificial Sequence: Synthetic polypeptide
  VL of XENP018936

SEQ ID NO: 14656 - protein, 5 aa, Artificial Sequence
  Description of Artificial Sequence: Synthetic peptide
  XENP018936 vhCDR1
NYWMN

SEQ ID NO: 14657 - protein, 19 aa, Artificial Sequence
  Description of Artificial Sequence: Synthetic peptide
  XENP018936 vhCDR2
EIRLKSNNYATHYAESVKG

SEQ ID NO: 14658 - protein, 11 aa, Artificial Sequence
  Description of Artificial Sequence: Synthetic peptide
  XENP018936 vhCDR3
YYGNYGGYFDV

SEQ ID NO: 14659 - protein, 11 aa, Artificial Sequence
  Description of Artificial Sequence: Synthetic peptide
  XENP018936 vlCDR1
RASQSVSNDVA

SEQ ID NO: 14660 - protein, 7 aa, Artificial Sequence
  Description of Artificial Sequence: Synthetic peptide
  XENP018936 vlCDR2
YASHRYT

SEQ ID NO: 14661 - protein, 9 aa, Artificial Sequence
  Description of Artificial Sequence: Synthetic peptide
  XENP018936 vlCDR3
QQDYSSPRT

SEQ ID NO: 14662 - protein, 249 aa, Artificial Sequence
  Description of Artificial Sequence: Synthetic polypeptide
  XENP018937 1G6_H4L4_scFv(GKPGS)4
EVQLVESGGGLVQPGGSLKLSCAASGFTFSNYWMNWVRQASGKGLEWVGEIRLKSNNYATHYAESVKGRFTISRDDSKSTVYLQMNSLKTEDTAVYYCTRYYGNYGGYFDVWGAGTLVTVSSGKPGSGKPGSGKPGSGKPGSSIVMTQSPGTLSLSPGERATLSCRASQSVSNDVAWYQQKPGQSPRLLINYASHRYTGVPDRFTGSGYGTDFTLTISRLEPEDFAVYFCQQDYSSPRTFGGGTKVEIK

SEQ ID NO: 14663 - protein, 122 aa, Artificial Sequence; identical to SEQ ID NO: 14636
  Description of Artificial Sequence: Synthetic polypeptide
  VH of XENP018937

SEQ ID NO: 14664 - protein, 107 aa, Artificial Sequence; identical to SEQ ID NO: 14529
  Description of Artificial Sequence: Synthetic polypeptide
  VL of XENP018937

SEQ ID NO: 14665 - protein, 5 aa, Artificial Sequence
  Description of Artificial Sequence: Synthetic peptide
  XENP018937 vhCDR1
NYWMN

SEQ ID NO: 14666 - protein, 19 aa, Artificial Sequence
  Description of Artificial Sequence: Synthetic peptide
  XENP018937 vhCDR2
EIRLKSNNYATHYAESVKG

SEQ ID NO: 14667 - protein, 11 aa, Artificial Sequence
  Description of Artificial Sequence: Synthetic peptide
  XENP018937 vhCDR3
YYGNYGGYFDV

SEQ ID NO: 14668 - protein, 11 aa, Artificial Sequence
  Description of Artificial Sequence: Synthetic peptide
  XENP018937 vlCDR1
RASQSVSNDVA

SEQ ID NO: 14669 - protein, 7 aa, Artificial Sequence
  Description of Artificial Sequence: Synthetic peptide
  XENP018937 vlCDR2
YASHRYT

SEQ ID NO: 14670 - protein, 9 aa, Artificial Sequence
  Description of Artificial Sequence: Synthetic peptide
  XENP018937 vlCDR3
QQDYSSPRT

SEQ ID NO: 14671 - protein, 249 aa, Artificial Sequence
  Description of Artificial Sequence: Synthetic polypeptide
  XENP018938 1G6_H4L5_scFv(GKPGS)4
EVQLVESGGGLVQPGGSLKLSCAASGFTFSNYWMNWVRQASGKGLEWVGEIRLKSNNYATHYAESVKGRFTISRDDSKSTVYLQMNSLKTEDTAVYYCTRYYGNYGGYFDVWGAGTLVTVSSGKPGSGKPGSGKPGSGKPGSSIVMTQSPDSLAVSLGERATINCKASQSVSNDVAWYQQKPGQSPKLLINYASHRYTGVPDRFTGSGYGTDFTLTISSLQAEDVAVYFCQQDYSSPRTFGGGTKVEIK

SEQ ID NO: 14672 - protein, 122 aa, Artificial Sequence; identical to SEQ ID NO: 14636
  Description of Artificial Sequence: Synthetic polypeptide
  VH of XENP018938

SEQ ID NO: 14673 - protein, 107 aa, Artificial Sequence; identical to SEQ ID NO: 14538
  Description of Artificial Sequence: Synthetic polypeptide
  VL of XENP018938

SEQ ID NO: 14674 - protein, 5 aa, Artificial Sequence
  Description of Artificial Sequence: Synthetic peptide
  XENP018938 vhCDR1
NYWMN

SEQ ID NO: 14675 - protein, 19 aa, Artificial Sequence
  Description of Artificial Sequence: Synthetic peptide
  XENP018938 vhCDR2
EIRLKSNNYATHYAESVKG

SEQ ID NO: 14676 - protein, 11 aa, Artificial Sequence
  Description of Artificial Sequence: Synthetic peptide
  XENP018938 vhCDR3
YYGNYGGYFDV

SEQ ID NO: 14677 - protein, 11 aa, Artificial Sequence
  Description of Artificial Sequence: Synthetic peptide
  XENP018938 vlCDR1
KASQSVSNDVA

SEQ ID NO: 14678 - protein, 7 aa, Artificial Sequence
  Description of Artificial Sequence: Synthetic peptide
  XENP018938 vlCDR2
YASHRYT

SEQ ID NO: 14679 - protein, 9 aa, Artificial Sequence
  Description of Artificial Sequence: Synthetic peptide
  XENP018938 vlCDR3
QQDYSSPRT

SEQ ID NO: 14680 - protein, 249 aa, Artificial Sequence
  Description of Artificial Sequence: Synthetic polypeptide
  XENP019064 1G6_H1.239_L1_scFv(GKPGS)4
EVQLKESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 14681 - protein, 122 aa, Artificial Sequence
  Description of Artificial Sequence: Synthetic polypeptide
  VH of XENP019064
EVQLKESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSS

SEQ ID NO: 14682 - protein, 107 aa, Artificial Sequence; identical to SEQ ID NO: 10923
  Description of Artificial Sequence: Synthetic polypeptide
  VL of XENP019064

SEQ ID NO: 14683 - protein, 5 aa, Artificial Sequence
  Description of Artificial Sequence: Synthetic peptide
  XENP019064 vhCDR1
NYWMN

SEQ ID NO: 14684 - protein, 19 aa, Artificial Sequence
  Description of Artificial Sequence: Synthetic peptide
  XENP019064 vhCDR2
EIRLKSNNYATHYAEPVKG

SEQ ID NO: 14685 - protein, 11 aa, Artificial Sequence
  Description of Artificial Sequence: Synthetic peptide
  XENP019064 vhCDR3
YYGNYGGYFDV

SEQ ID NO: 14686 - protein, 11 aa, Artificial Sequence
  Description of Artificial Sequence: Synthetic peptide
  XENP019064 vlCDR1
RASQSVSNDVA

SEQ ID NO: 14687 - protein, 7 aa, Artificial Sequence
  Description of Artificial Sequence: Synthetic peptide
  XENP019064 vlCDR2
YASHRYT

SEQ ID NO: 14688 - protein, 9 aa, Artificial Sequence
  Description of Artificial Sequence: Synthetic peptide
  XENP019064 vlCDR3
QQDYSSPRT

SEQ ID NO: 14689 - protein, 249 aa, Artificial Sequence
  Description of Artificial Sequence: Synthetic polypeptide
  XENP019065 1G6_H1.240_L1_scFv(GKPGS)4
EVQLVESGGGLVKPGESLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 14690 - protein, 122 aa, Artificial Sequence
  Description of Artificial Sequence: Synthetic polypeptide
  VH of XENP019065
EVQLVESGGGLVKPGESLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSS

SEQ ID NO: 14691 - protein, 107 aa, Artificial Sequence; identical to SEQ ID NO: 10923
  Description of Artificial Sequence: Synthetic polypeptide
  VL of XENP019065

SEQ ID NO: 14692 - protein, 5 aa, Artificial Sequence
  Description of Artificial Sequence: Synthetic peptide
  XENP019065 vhCDR1
NYWMN

SEQ ID NO: 14693 - protein, 19 aa, Artificial Sequence
  Description of Artificial Sequence: Synthetic peptide
  XENP019065 vhCDR2
EIRLKSNNYATHYAEPVKG

SEQ ID NO: 14694 - protein, 11 aa, Artificial Sequence
  Description of Artificial Sequence: Synthetic peptide
  XENP019065 vhCDR3
YYGNYGGYFDV

SEQ ID NO: 14695 - protein, 11 aa, Artificial Sequence
  Description of Artificial Sequence: Synthetic peptide
  XENP019065 vlCDR1
RASQSVSNDVA

SEQ ID NO: 14696 - protein, 7 aa, Artificial Sequence
  Description of Artificial Sequence: Synthetic peptide
  XENP019065 vlCDR2
YASHRYT

SEQ ID NO: 14697 - protein, 9 aa, Artificial Sequence
  Description of Artificial Sequence: Synthetic peptide
  XENP019065 vlCDR3
QQDYSSPRT

SEQ ID NO: 14698 - protein, 249 aa, Artificial Sequence
  Description of Artificial Sequence: Synthetic polypeptide
  XENP019066 1G6_H1.241_L1_scFv(GKPGS)4
EVQLVESGGGLVKPGGSLRLTCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 14699 - protein, 122 aa, Artificial Sequence
  Description of Artificial Sequence: Synthetic polypeptide
  VH of XENP019066
EVQLVESGGGLVKPGGSLRLTCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSS

SEQ ID NO: 14700 - protein, 107 aa, Artificial Sequence; identical to SEQ ID NO: 10923
  Description of Artificial Sequence: Synthetic polypeptide
  VL of XENP019066

SEQ ID NO: 14701 - protein, 5 aa, Artificial Sequence
  Description of Artificial Sequence: Synthetic peptide
  XENP019066 vhCDR1
NYWMN

SEQ ID NO: 14702 - protein, 19 aa, Artificial Sequence
  Description of Artificial Sequence: Synthetic peptide
  XENP019066 vhCDR2
EIRLKSNNYATHYAEPVKG

SEQ ID NO: 14703 - protein, 11 aa, Artificial Sequence
  Description of Artificial Sequence: Synthetic peptide
  XENP019066 vhCDR3
YYGNYGGYFDV

SEQ ID NO: 14704 - protein, 11 aa, Artificial Sequence
  Description of Artificial Sequence: Synthetic peptide
  XENP019066 vlCDR1
RASQSVSNDVA

SEQ ID NO: 14705 - protein, 7 aa, Artificial Sequence
  Description of Artificial Sequence: Synthetic peptide
  XENP019066 vlCDR2
YASHRYT

SEQ ID NO: 14706 - protein, 9 aa, Artificial Sequence
  Description of Artificial Sequence: Synthetic peptide
  XENP019066 vlCDR3
QQDYSSPRT

SEQ ID NO: 14707 - protein, 249 aa, Artificial Sequence
  Description of Artificial Sequence: Synthetic polypeptide
  XENP019067 1G6_H1.242_L1_scFv(GKPGS)4
EVQLVESGGGLVKPGGSLRLVCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 14708 - protein, 122 aa, Artificial Sequence
  Description of Artificial Sequence: Synthetic polypeptide
  VH of XENP019067
EVQLVESGGGLVKPGGSLRLVCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSS

SEQ ID NO: 14709 - protein, 107 aa, Artificial Sequence; identical to SEQ ID NO: 10923
  Description of Artificial Sequence: Synthetic polypeptide
  VL of XENP019067

SEQ ID NO: 14710 - protein, 5 aa, Artificial Sequence
  Description of Artificial Sequence: Synthetic peptide
  XENP019067 vhCDR1
NYWMN

SEQ ID NO: 14711 - protein, 19 aa, Artificial Sequence
  Description of Artificial Sequence: Synthetic peptide
  XENP019067 vhCDR2
EIRLKSNNYATHYAEPVKG

SEQ ID NO: 14712 - protein, 11 aa, Artificial Sequence
  Description of Artificial Sequence: Synthetic peptide
  XENP019067 vhCDR3
YYGNYGGYFDV

SEQ ID NO: 14713 - protein, 11 aa, Artificial Sequence
  Description of Artificial Sequence: Synthetic peptide
  XENP019067 vlCDR1
RASQSVSNDVA

SEQ ID NO: 14714 - protein, 7 aa, Artificial Sequence
  Description of Artificial Sequence: Synthetic peptide
  XENP019067 vlCDR2
YASHRYT

SEQ ID NO: 14715 - protein, 9 aa, Artificial Sequence
  Description of Artificial Sequence: Synthetic peptide
  XENP019067 vlCDR3
QQDYSSPRT

SEQ ID NO: 14716 - protein, 249 aa, Artificial Sequence
  Description of Artificial Sequence: Synthetic polypeptide
  XENP019068 1G6_H1.243_L1_scFv(GKPGS)4
EVQLVESGGGLVKPGGSLRLSCAASGFTLSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 14717 - protein, 122 aa, Artificial Sequence
  Description of Artificial Sequence: Synthetic polypeptide
  VH of XENP019068
EVQLVESGGGLVKPGGSLRLSCAASGFTLSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSS

SEQ ID NO: 14718 - protein, 107 aa, Artificial Sequence; identical to SEQ ID NO: 10923
  Description of Artificial Sequence: Synthetic polypeptide
  VL of XENP019068

SEQ ID NO: 14719 - protein, 5 aa, Artificial Sequence
  Description of Artificial Sequence: Synthetic peptide
  XENP019068 vhCDR1
NYWMN

SEQ ID NO: 14720 - protein, 19 aa, Artificial Sequence
  Description of Artificial Sequence: Synthetic peptide
  XENP019068 vhCDR2
EIRLKSNNYATHYAEPVKG

SEQ ID NO: 14721 - protein, 11 aa, Artificial Sequence
  Description of Artificial Sequence: Synthetic peptide
  XENP019068 vhCDR3
YYGNYGGYFDV

SEQ ID NO: 14722 - protein, 11 aa, Artificial Sequence
  Description of Artificial Sequence: Synthetic peptide
  XENP019068 vlCDR1
RASQSVSNDVA

SEQ ID NO: 14723 - protein, 7 aa, Artificial Sequence
  Description of Artificial Sequence: Synthetic peptide
  XENP019068 vlCDR2
YASHRYT

SEQ ID NO: 14724 - protein, 9 aa, Artificial Sequence
  Description of Artificial Sequence: Synthetic peptide
  XENP019068 vlCDR3
QQDYSSPRT

SEQ ID NO: 14725 - protein, 249 aa, Artificial Sequence
  Description of Artificial Sequence: Synthetic polypeptide
  XENP019069 1G6_H1.244_L1_scFv(GKPGS)4
EVQLVESGGGLVKPGGSLRLSCAASGFTFSNYWMNWVRQAPGKGLQWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 14726 - protein, 122 aa, Artificial Sequence
  Description of Artificial Sequence: Synthetic polypeptide
  VH of XENP019069
EVQLVESGGGLVKPGGSLRLSCAASGFTFSNYWMNWVRQAPGKGLQWVGEIRLKSNNYATHYAEPVKGRFTISRDDSKSTVYLQMNSLKTEDTAVYYCTRYYGNYGGYFDVWGAGTLVTVSS

SEQ ID NO: 14727 - protein, 107 aa, Artificial Sequence; identical to SEQ ID NO: 10923
  Description of Artificial Sequence: Synthetic polypeptide
  VL of XENP019069

SEQ ID NO: 14728 - protein, 5 aa, Artificial Sequence
  Description of Artificial Sequence: Synthetic peptide
  XENP019069 vhCDR1
NYWMN

SEQ ID NO: 14729 - protein, 19 aa, Artificial Sequence
  Description of Artificial Sequence: Synthetic peptide
  XENP019069 vhCDR2
EIRLKSNNYATHYAEPVKG

SEQ ID NO: 14730 - protein, 11 aa, Artificial Sequence
  Description of Artificial Sequence: Synthetic peptide
  XENP019069 vhCDR3
YYGNYGGYFDV

SEQ ID NO: 14731 - protein, 11 aa, Artificial Sequence
  Description of Artificial Sequence: Synthetic peptide
  XENP019069 vlCDR1
RASQSVSNDVA

SEQ ID NO: 14732 - protein, 7 aa, Artificial Sequence
  Description of Artificial Sequence: Synthetic peptide
  XENP019069 vlCDR2
YASHRYT

SEQ ID NO: 14733 - protein, 9 aa, Artificial Sequence
  Description of Artificial Sequence: Synthetic peptide
  XENP019069 vlCDR3
QQDYSSPRT

SEQ ID NO: 14734 - protein, 249 aa, Artificial Sequence
  Description of Artificial Sequence: Synthetic polypeptide
  XENP019070 1G6_H1.245_L1_scFv(GKPGS)4
EVQLVESGGGLVKPGGSLRLSCAASGFTFSNYWMNWVRQAPGKGLEWIGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 14735 - protein, 122 aa, Artificial Sequence
  Description of Artificial Sequence: Synthetic polypeptide
  VH of XENP019070
EVQLVESGGGLVKPGGSLRLSCAASGFTFSNYWMNWVRQAPGKGLEWIGEIRLKSNNYATHYAEPVKGRFTISRDDSKSTVYLQMNSLKTEDTAVYYCTRYYGNYGGYFDVWGAGTLVTVSS

SEQ ID NO: 14736 - protein, 107 aa, Artificial Sequence; identical to SEQ ID NO: 10923
  Description of Artificial Sequence: Synthetic polypeptide
  VL of XENP019070

SEQ ID NO: 14737 - protein, 5 aa, Artificial Sequence
  Description of Artificial Sequence: Synthetic peptide
  XENP019070 vhCDR1
NYWMN

SEQ ID NO: 14738 - protein, 19 aa, Artificial Sequence
  Description of Artificial Sequence: Synthetic peptide
  XENP019070 vhCDR2
EIRLKSNNYATHYAEPVKG

SEQ ID NO: 14739 - protein, 11 aa, Artificial Sequence
  Description of Artificial Sequence: Synthetic peptide
  XENP019070 vhCDR3
YYGNYGGYFDV

SEQ ID NO: 14740 - protein, 11 aa, Artificial Sequence
  Description of Artificial Sequence: Synthetic peptide
  XENP019070 vlCDR1
RASQSVSNDVA

SEQ ID NO: 14741 - protein, 7 aa, Artificial Sequence
  Description of Artificial Sequence: Synthetic peptide
  XENP019070 vlCDR2
YASHRYT

SEQ ID NO: 14742 - protein, 9 aa, Artificial Sequence
  Description of Artificial Sequence: Synthetic peptide
  XENP019070 vlCDR3
QQDYSSPRT

SEQ ID NO: 14743 - protein, 249 aa, Artificial Sequence
  Description of Artificial Sequence: Synthetic polypeptide
  XENP019071 1G6_H1.246_L1_scFv(GKPGS)4
EVQLVESGGGLVKPGGSLRLSCAASGFTFSNYWMNWVRQAPGKGLEWMGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 14744 - protein, 122 aa, Artificial Sequence
  Description of Artificial Sequence: Synthetic polypeptide
  VH of XENP019071
EVQLVESGGGLVKPGGSLRLSCAASGFTFSNYWMNWVRQAPGKGLEWMGEIRLKSNNYATHYAEPVKGRFTISRDDSKSTVYLQMNSLKTEDTAVYYCTRYYGNYGGYFDVWGAGTLVTVSS

SEQ ID NO: 14745 - protein, 107 aa, Artificial Sequence; identical to SEQ ID NO: 10923
  Description of Artificial Sequence: Synthetic polypeptide
  VL of XENP019071

SEQ ID NO: 14746 - protein, 5 aa, Artificial Sequence
  Description of Artificial Sequence: Synthetic peptide
  XENP019071 vhCDR1
NYWMN

SEQ ID NO: 14747 - protein, 19 aa, Artificial Sequence
  Description of Artificial Sequence: Synthetic peptide
  XENP019071 vhCDR2
EIRLKSNNYATHYAEPVKG

SEQ ID NO: 14748 - protein, 11 aa, Artificial Sequence
  Description of Artificial Sequence: Synthetic peptide
  XENP019071 vhCDR3
YYGNYGGYFDV

SEQ ID NO: 14749 - protein, 11 aa, Artificial Sequence
  Description of Artificial Sequence: Synthetic peptide
  XENP019071 vlCDR1
RASQSVSNDVA

SEQ ID NO: 14750 - protein, 7 aa, Artificial Sequence
  Description of Artificial Sequence: Synthetic peptide
  XENP019071 vlCDR2
YASHRYT

SEQ ID NO: 14751 - protein, 9 aa, Artificial Sequence
  Description of Artificial Sequence: Synthetic peptide
  XENP019071 vlCDR3
QQDYSSPRT

SEQ ID NO: 14752 - protein, 249 aa, Artificial Sequence
  Description of Artificial Sequence: Synthetic polypeptide
  XENP019072 1G6_H1.247_L1_scFv(GKPGS)4
EVQLVESGGGLVKPGGSLRLSCAASGFTFSNYWMNWVRQAPGKGLEWVGEIRLKSNNYATHYAEPFKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 14753 - protein, 122 aa, Artificial Sequence
  Description of Artificial Sequence: Synthetic polypeptide
  VH of XENP019072
EVQLVESGGGLVKPGGSLRLSCAASGFTFSNYWMNWVRQAPGKGLEWVGEIRLKSNNYATHYAEPFKGRFTISRDDSKSTVYLQMNSLKTEDTAVYYCTRYYGNYGGYFDVWGAGTLVTVSS

SEQ ID NO: 14754 - protein, 107 aa, Artificial Sequence; identical to SEQ ID NO: 10923
  Description of Artificial Sequence: Synthetic polypeptide
  VL of XENP019072

SEQ ID NO: 14755 - protein, 5 aa, Artificial Sequence
  Description of Artificial Sequence: Synthetic peptide
  XENP019072 vhCDR1
NYWMN

SEQ ID NO: 14756 - protein, 19 aa, Artificial Sequence
  Description of Artificial Sequence: Synthetic peptide
  XENP019072 vhCDR2
EIRLKSNNYATHYAEPFKG

SEQ ID NO: 14757 - protein, 11 aa, Artificial Sequence
  Description of Artificial Sequence: Synthetic peptide
  XENP019072 vhCDR3
YYGNYGGYFDV

SEQ ID NO: 14758 - protein, 11 aa, Artificial Sequence
  Description of Artificial Sequence: Synthetic peptide
  XENP019072 vlCDR1
RASQSVSNDVA

SEQ ID NO: 14759 - protein, 7 aa, Artificial Sequence
  Description of Artificial Sequence: Synthetic peptide
  XENP019072 vlCDR2
YASHRYT

SEQ ID NO: 14760 - protein, 9 aa, Artificial Sequence
  Description of Artificial Sequence: Synthetic peptide
  XENP019072 vlCDR3
QQDYSSPRT

SEQ ID NO: 14761 - protein, 249 aa, Artificial Sequence
  Description of Artificial Sequence: Synthetic polypeptide
  XENP019073 1G6_H1.248_L1_scFv(GKPGS)4
EVQLVESGGGLVKPGGSLRLSCAASGFTFSNYWMNWVRQAPGKGLEWVGEIRLKSNNYATHYAEPVKGRATISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 14762 - protein, 122 aa, Artificial Sequence
  Description of Artificial Sequence: Synthetic polypeptide
  VH of XENP019073
EVQLVESGGGLVKPGGSLRLSCAASGFTFSNYWMNWVRQAPGKGLEWVGEIRLKSNNYATHYAEPVKGRATISRDDSKSTVYLQMNSLKTEDTAVYYCTRYYGNYGGYFDVWGAGTLVTVSS

SEQ ID NO: 14763 - protein, 107 aa, Artificial Sequence; identical to SEQ ID NO: 10923
  Description of Artificial Sequence: Synthetic polypeptide
  VL of XENP019073

SEQ ID NO: 14764 - protein, 5 aa, Artificial Sequence
  Description of Artificial Sequence: Synthetic peptide
  XENP019073 vhCDR1
NYWMN

SEQ ID NO: 14765 - protein, 19 aa, Artificial Sequence
  Description of Artificial Sequence: Synthetic peptide
  XENP019073 vhCDR2
EIRLKSNNYATHYAEPVKG

SEQ ID NO: 14766 - protein, 11 aa, Artificial Sequence
  Description of Artificial Sequence: Synthetic peptide
  XENP019073 vhCDR3
YYGNYGGYFDV

SEQ ID NO: 14767 - protein, 11 aa, Artificial Sequence
  Description of Artificial Sequence: Synthetic peptide
  XENP019073 vlCDR1
RASQSVSNDVA

SEQ ID NO: 14768 - protein, 7 aa, Artificial Sequence
  Description of Artificial Sequence: Synthetic peptide
  XENP019073 vlCDR2
YASHRYT

SEQ ID NO: 14769 - protein, 9 aa, Artificial Sequence
  Description of Artificial Sequence: Synthetic peptide
  XENP019073 vlCDR3
QQDYSSPRT

SEQ ID NO: 14770 - protein, 249 aa, Artificial Sequence
  Description of Artificial Sequence: Synthetic polypeptide
  XENP019074 1G6_H1.249_L1_scFv(GKPGS)4
EVQLVESGGGLVKPGGSLRLSCAASGFTFSNYWMNWVRQAPGKGLEWVGEIRLKSNNYATHYAEPVKGRVTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 14771 - protein, 122 aa, Artificial Sequence
  Description of Artificial Sequence: Synthetic polypeptide
  VH of XENP019074
EVQLVESGGGLVKPGGSLRLSCAASGFTFSNYWMNWVRQAPGKGLEWVGEIRLKSNNYATHYAEPVKGRVTISRDDSKSTVYLQMNSLKTEDTAVYYCTRYYGNYGGYFDVWGAGTLVTVSS

SEQ ID NO: 14772 - protein, 107 aa, Artificial Sequence; identical to SEQ ID NO: 10923
  Description of Artificial Sequence: Synthetic polypeptide
  VL of XENP019074

SEQ ID NO: 14773 - protein, 5 aa, Artificial Sequence
  Description of Artificial Sequence: Synthetic peptide
  XENP019074 vhCDR1
NYWMN

SEQ ID NO: 14774 - protein, 19 aa, Artificial Sequence
  Description of Artificial Sequence: Synthetic peptide
  XENP019074 vhCDR2
EIRLKSNNYATHYAEPVKG

SEQ ID NO: 14775 - protein, 11 aa, Artificial Sequence
  Description of Artificial Sequence: Synthetic peptide
  XENP019074 vhCDR3
YYGNYGGYFDV

SEQ ID NO: 14776 - protein, 11 aa, Artificial Sequence
  Description of Artificial Sequence: Synthetic peptide
  XENP019074 vlCDR1
RASQSVSNDVA

SEQ ID NO: 14777 - protein, 7 aa, Artificial Sequence
  Description of Artificial Sequence: Synthetic peptide
  XENP019074 vlCDR2
YASHRYT

SEQ ID NO: 14778 - protein, 9 aa, Artificial Sequence
  Description of Artificial Sequence: Synthetic peptide
  XENP019074 vlCDR3
QQDYSSPRT

SEQ ID NO: 14779 - protein, 249 aa, Artificial Sequence
  Description of Artificial Sequence: Synthetic polypeptide
  XENP019075 1G6_H1.250_L1_scFv(GKPGS)4
EVQLVESGGGLVKPGGSLRLSCAASGFTFSNYWMNWVRQAPGKGLEWVGEIRLKSNNYATHYAEPVKGRFTISRDDSSSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 14780 - protein, 122 aa, Artificial Sequence
  Description of Artificial Sequence: Synthetic polypeptide
  VH of XENP019075
EVQLVESGGGLVKPGGSLRLSCAASGFTFSNYWMNWVRQAPGKGLEWVGEIRLKSNNYATHYAEPVKGRFTISRDDSSSTVYLQMNSLKTEDTAVYYCTRYYGNYGGYFDVWGAGTLVTVSS

SEQ ID NO: 14781 - protein, 107 aa, Artificial Sequence; identical to SEQ ID NO: 10923
  Description of Artificial Sequence: Synthetic polypeptide
  VL of XENP019075

SEQ ID NO: 14782 - protein, 5 aa, Artificial Sequence
  Description of Artificial Sequence: Synthetic peptide
  XENP019075 vhCDR1
NYWMN

SEQ ID NO: 14783 - protein, 19 aa, Artificial Sequence
  Description of Artificial Sequence: Synthetic peptide
  XENP019075 vhCDR2
EIRLKSNNYATHYAEPVKG

SEQ ID NO: 14784 - protein, 11 aa, Artificial Sequence
  Description of Artificial Sequence: Synthetic peptide
  XENP019075 vhCDR3
YYGNYGGYFDV

SEQ ID NO: 14785 - protein, 11 aa, Artificial Sequence
  Description of Artificial Sequence: Synthetic peptide
  XENP019075 vlCDR1
RASQSVSNDVA

SEQ ID NO: 14786 - protein, 7 aa, Artificial Sequence
  Description of Artificial Sequence: Synthetic peptide
  XENP019075 vlCDR2
YASHRYT

SEQ ID NO: 14787 - protein, 9 aa, Artificial Sequence
  Description of Artificial Sequence: Synthetic peptide
  XENP019075 vlCDR3
QQDYSSPRT

SEQ ID NO: 14788 - protein, 249 aa, Artificial Sequence
  Description of Artificial Sequence: Synthetic polypeptide
  XENP019076 1G6_H1.251_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSMVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 14789 - protein, 122 aa, Artificial Sequence
  Description of Artificial Sequence: Synthetic polypeptide
  VH of XENP019076
EVQLVESGGGLVKPGGSLRLSCAASGFTFSNYWMNWVRQAPGKGLEWVGEIRLKSNNYATHYAEPVKGRFTISRDDSKSMVYLQMNSLKTEDTAVYYCTRYYGNYGGYFDVWGAGTLVTVSS

SEQ ID NO: 14790 - protein, 107 aa, Artificial Sequence; identical to SEQ ID NO: 10923
  Description of Artificial Sequence: Synthetic polypeptide
  VL of XENP019076

SEQ ID NO: 14791 - protein, 5 aa, Artificial Sequence
  Description of Artificial Sequence: Synthetic peptide
  XENP019076 vhCDR1
NYWMN

SEQ ID NO: 14792 - protein, 19 aa, Artificial Sequence
  Description of Artificial Sequence: Synthetic peptide
  XENP019076 vhCDR2
EIRLKSNNYATHYAEPVKG

SEQ ID NO: 14793 - protein, 11 aa, Artificial Sequence
  Description of Artificial Sequence: Synthetic peptide
  XENP019076 vhCDR3
YYGNYGGYFDV

SEQ ID NO: 14794 - protein, 11 aa, Artificial Sequence
  Description of Artificial Sequence: Synthetic peptide
  XENP019076 vlCDR1
RASQSVSNDVA

SEQ ID NO: 14795 - protein, 7 aa, Artificial Sequence
  Description of Artificial Sequence: Synthetic peptide
  XENP019076 vlCDR2
YASHRYT

SEQ ID NO: 14796 - protein, 9 aa, Artificial Sequence
  Description of Artificial Sequence: Synthetic peptide
  XENP019076 vlCDR3
QQDYSSPRT

SEQ ID NO: 14797 - protein, 249 aa, Artificial Sequence
  Description of Artificial Sequence: Synthetic polypeptide
  XENP019077 1G6_H1.252_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSQVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 14798 - protein, 122 aa, Artificial Sequence
  Description of Artificial Sequence: Synthetic polypeptide
  VH of XENP019077
EVQLVESGGGLVKPGGSLRLSCAASGFTFSNYWMNWVRQAPGKGLEWVGEIRLKSNNYATHYAEPVKGRFTISRDDSKSQVYLQMNSLKTEDTAVYYCTRYYGNYGGYFDVWGAGTLVTVSS

SEQ ID NO: 14799 - protein, 107 aa, Artificial Sequence; identical to SEQ ID NO: 10923
  Description of Artificial Sequence: Synthetic polypeptide
  VL of XENP019077

SEQ ID NO: 14800 - protein, 5 aa, Artificial Sequence
  Description of Artificial Sequence: Synthetic peptide
  XENP019077 vhCDR1
NYWMN

SEQ ID NO: 14801 - protein, 19 aa, Artificial Sequence
  Description of Artificial Sequence: Synthetic peptide
  XENP019077 vhCDR2
EIRLKSNNYATHYAEPVKG

SEQ ID NO: 14802 - protein, 11 aa, Artificial Sequence
  Description of Artificial Sequence: Synthetic peptide
  XENP019077 vhCDR3
YYGNYGGYFDV

SEQ ID NO: 14803 - protein, 11 aa, Artificial Sequence
  Description of Artificial Sequence: Synthetic peptide
  XENP019077 vlCDR1
RASQSVSNDVA

SEQ ID NO: 14804 - protein, 7 aa, Artificial Sequence
  Description of Artificial Sequence: Synthetic peptide
  XENP019077 vlCDR2
YASHRYT

SEQ ID NO: 14805 - protein, 9 aa, Artificial Sequence
  Description of Artificial Sequence: Synthetic peptide
  XENP019077 vlCDR3
QQDYSSPRT

SEQ ID NO: 14806 - protein, 249 aa, Artificial Sequence
  Description of Artificial Sequence: Synthetic polypeptide
  XENP019078 1G6_H1.253_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVVLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 14807 - protein, 122 aa, Artificial Sequence
  Description of Artificial Sequence: Synthetic polypeptide
  VH of XENP019078
EVQLVESGGGLVKPGGSLRLSCAASGFTFSNYWMNWVRQAPGKGLEWVGEIRLKSNNYATHYAEPVKGRFTISRDDSKSTVVLQMNSLKTEDTAVYYCTRYYGNYGGYFDVWGAGTLVTVSS

SEQ ID NO: 14808 - protein, 107 aa, Artificial Sequence; identical to SEQ ID NO: 10923
  Description of Artificial Sequence: Synthetic polypeptide
  VL of XENP019078

SEQ ID NO: 14809 - protein, 5 aa, Artificial Sequence
  Description of Artificial Sequence: Synthetic peptide
  XENP019078 vhCDR1
NYWMN

SEQ ID NO: 14810 - protein, 19 aa, Artificial Sequence
  Description of Artificial Sequence: Synthetic peptide
  XENP019078 vhCDR2
EIRLKSNNYATHYAEPVKG

SEQ ID NO: 14811 - protein, 11 aa, Artificial Sequence
  Description of Artificial Sequence: Synthetic peptide
  XENP019078 vhCDR3
YYGNYGGYFDV

SEQ ID NO: 14812 - protein, 11 aa, Artificial Sequence
  Description of Artificial Sequence: Synthetic peptide
  XENP019078 vlCDR1
RASQSVSNDVA

SEQ ID NO: 14813 - protein, 7 aa, Artificial Sequence
  Description of Artificial Sequence: Synthetic peptide
  XENP019078 vlCDR2
YASHRYT

SEQ ID NO: 14814 - protein, 9 aa, Artificial Sequence
  Description of Artificial Sequence: Synthetic peptide
  XENP019078 vlCDR3
QQDYSSPRT

SEQ ID NO: 14815 - protein, 249 aa, Artificial Sequence
  Description of Artificial Sequence: Synthetic polypeptide
  XENP019079 1G6_H1.254_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLEMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 14816 - protein, 122 aa, Artificial Sequence
  Description of Artificial Sequence: Synthetic polypeptide
  VH of XENP019079
EVQLVESGGGLVKPGGSLRLSCAASGFTFSNYWMNWVRQAPGKGLEWVGEIRLKSNNYATHYAEPVKGRFTISRDDSKSTVYLEMNSLKTEDTAVYYCTRYYGNYGGYFDVWGAGTLVTVSS

SEQ ID NO: 14817 - protein, 107 aa, Artificial Sequence; identical to SEQ ID NO: 10923
  Description of Artificial Sequence: Synthetic polypeptide
  VL of XENP019079

SEQ ID NO: 14818 - protein, 5 aa, Artificial Sequence
  Description of Artificial Sequence: Synthetic peptide
  XENP019079 vhCDR1
NYWMN

SEQ ID NO: 14819 - protein, 19 aa, Artificial Sequence
  Description of Artificial Sequence: Synthetic peptide
  XENP019079 vhCDR2
EIRLKSNNYATHYAEPVKG

SEQ ID NO: 14820 - protein, 11 aa, Artificial Sequence
  Description of Artificial Sequence: Synthetic peptide
  XENP019079 vhCDR3
YYGNYGGYFDV

SEQ ID NO: 14821 - protein, 11 aa, Artificial Sequence
  Description of Artificial Sequence: Synthetic peptide
  XENP019079 vlCDR1
RASQSVSNDVA

SEQ ID NO: 14822 - protein, 7 aa, Artificial Sequence
  Description of Artificial Sequence: Synthetic peptide
  XENP019079 vlCDR2
YASHRYT

SEQ ID NO: 14823 - protein, 9 aa, Artificial Sequence
  Description of Artificial Sequence: Synthetic peptide
  XENP019079 vlCDR3
QQDYSSPRT

SEQ ID NO: 14824 - protein, 249 aa, Artificial Sequence
  Description of Artificial Sequence: Synthetic polypeptide
  XENP019080 1G6_H1.255_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSEKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 14825 - protein, 122 aa, Artificial Sequence
  Description of Artificial Sequence: Synthetic polypeptide
  VH of XENP019080
EVQLVESGGGLVKPGGSLRLSCAASGFTFSNYWMNWVRQAPGKGLEWVGEIRLKSNNYATHYAEPVKGRFTISRDDSKSTVYLQMNSEKTEDTAVYYCTRYYGNYGGYFDVWGAGTLVTVSS

SEQ ID NO: 14826 - protein, 107 aa, Artificial Sequence; identical to SEQ ID NO: 10923
  Description of Artificial Sequence: Synthetic polypeptide
  VL of XENP019080

SEQ ID NO: 14827 - protein, 5 aa, Artificial Sequence
  Description of Artificial Sequence: Synthetic peptide
  XENP019080 vhCDR1
NYWMN

SEQ ID NO: 14828 - protein, 19 aa, Artificial Sequence
  Description of Artificial Sequence: Synthetic peptide
  XENP019080 vhCDR2
EIRLKSNNYATHYAEPVKG

SEQ ID NO: 14829 - protein, 11 aa, Artificial Sequence
  Description of Artificial Sequence: Synthetic peptide
  XENP019080 vhCDR3
YYGNYGGYFDV

SEQ ID NO: 14830 - protein, 11 aa, Artificial Sequence
  Description of Artificial Sequence: Synthetic peptide
  XENP019080 vlCDR1
RASQSVSNDVA

SEQ ID NO: 14831 - protein, 7 aa, Artificial Sequence
  Description of Artificial Sequence: Synthetic peptide
  XENP019080 vlCDR2
YASHRYT

SEQ ID NO: 14832 - protein, 9 aa, Artificial Sequence
  Description of Artificial Sequence: Synthetic peptide
  XENP019080 vlCDR3
QQDYSSPRT

SEQ ID NO: 14833 - protein, 249 aa, Artificial Sequence
  Description of Artificial Sequence: Synthetic polypeptide
  XENP019081 1G6_H1.256_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSVKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 14834 - protein, 122 aa, Artificial Sequence
  Description of Artificial Sequence: Synthetic polypeptide
  VH of XENP019081
EVQLVESGGGLVKPGGSLRLSCAASGFTFSNYWMNWVRQAPGKGLEWVGEIRLKSNNYATHYAEPVKGRFTISRDDSKSTVYLQMNSVKTEDTAVYYCTRYYGNYGGYFDVWGAGTLVTVSS

SEQ ID NO: 14835 - protein, 107 aa, Artificial Sequence; identical to SEQ ID NO: 10923
  Description of Artificial Sequence: Synthetic polypeptide
  VL of XENP019081

SEQ ID NO: 14836 - protein, 5 aa, Artificial Sequence
  Description of Artificial Sequence: Synthetic peptide
  XENP019081 vhCDR1
NYWMN

SEQ ID NO: 14837 - protein, 19 aa, Artificial Sequence
  Description of Artificial Sequence: Synthetic peptide
  XENP019081 vhCDR2
EIRLKSNNYATHYAEPVKG

SEQ ID NO: 14838 - protein, 11 aa, Artificial Sequence
  Description of Artificial Sequence: Synthetic peptide
  XENP019081 vhCDR3
YYGNYGGYFDV

SEQ ID NO: 14839 - protein, 11 aa, Artificial Sequence
  Description of Artificial Sequence: Synthetic peptide
  XENP019081 vlCDR1
RASQSVSNDVA

SEQ ID NO: 14840 - protein, 7 aa, Artificial Sequence
  Description of Artificial Sequence: Synthetic peptide
  XENP019081 vlCDR2
YASHRYT

SEQ ID NO: 14841 - protein, 9 aa, Artificial Sequence
  Description of Artificial Sequence: Synthetic peptide
  XENP019081 vlCDR3
QQDYSSPRT

SEQ ID NO: 14842 - protein, 249 aa, Artificial Sequence
  Description of Artificial Sequence: Synthetic polypeptide
  XENP019082 1G6_H1.257_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGRGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 14843 - protein, 122 aa, Artificial Sequence
  Description of Artificial Sequence: Synthetic polypeptide
  VH of XENP019082
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGRGTLVTVSS

SEQ ID NO: 14844 - protein, 107 aa, Artificial Sequence; identical to SEQ ID NO: 10923
  Description of Artificial Sequence: Synthetic polypeptide
  VL of XENP019082

SEQ ID NO: 14845 - protein, 5 aa, Artificial Sequence
  Description of Artificial Sequence: Synthetic peptide
  XENP019082 vhCDR1
NYWMN

SEQ ID NO: 14846 - protein, 19 aa, Artificial Sequence
  Description of Artificial Sequence: Synthetic peptide
  XENP019082 vhCDR2
EIRLKSNNYATHYAEPVKG

SEQ ID NO: 14847 - protein, 11 aa, Artificial Sequence
  Description of Artificial Sequence: Synthetic peptide
  XENP019082 vhCDR3
YYGNYGGYFDV

SEQ ID NO: 14848 - protein, 11 aa, Artificial Sequence
  Description of Artificial Sequence: Synthetic peptide
  XENP019082 vlCDR1
RASQSVSNDVA

SEQ ID NO: 14849 - protein, 7 aa, Artificial Sequence
  Description of Artificial Sequence: Synthetic peptide
  XENP019082 vlCDR2
YASHRYT

SEQ ID NO: 14850 - protein, 9 aa, Artificial Sequence
  Description of Artificial Sequence: Synthetic peptide
  XENP019082 vlCDR3
QQDYSSPRT

SEQ ID NO: 14851 - protein, 249 aa, Artificial Sequence
  Description of Artificial Sequence: Synthetic polypeptide
  XENP019083 1G6_H1.258_L1_scFv(GKPGS)4
EVQLVESGGGLKKPGESLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 14852 - protein, 122 aa, Artificial Sequence
  Description of Artificial Sequence: Synthetic polypeptide
  VH of XENP019083
EVQLVESGGGLKKPGESLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSS

SEQ ID NO: 14853 - protein, 107 aa, Artificial Sequence; identical to SEQ ID NO: 10923
  Description of Artificial Sequence: Synthetic polypeptide
  VL of XENP019083

SEQ ID NO: 14854 - protein, 5 aa, Artificial Sequence
  Description of Artificial Sequence: Synthetic peptide
  XENP019083 vhCDR1
NYWMN

SEQ ID NO: 14855 - protein, 19 aa, Artificial Sequence
  Description of Artificial Sequence: Synthetic peptide
  XENP019083 vhCDR2
EIRLKSNNYATHYAEPVKG

SEQ ID NO: 14856 - protein, 11 aa, Artificial Sequence
  Description of Artificial Sequence: Synthetic peptide
  XENP019083 vhCDR3
YYGNYGGYFDV

SEQ ID NO: 14857 - protein, 11 aa, Artificial Sequence
  Description of Artificial Sequence: Synthetic peptide
  XENP019083 vlCDR1
RASQSVSNDVA

SEQ ID NO: 14858 - protein, 7 aa, Artificial Sequence
  Description of Artificial Sequence: Synthetic peptide
  XENP019083 vlCDR2
YASHRYT

SEQ ID NO: 14859 - protein, 9 aa, Artificial Sequence
  Description of Artificial Sequence: Synthetic peptide
  XENP019083 vlCDR3
QQDYSSPRT

SEQ ID NO: 14860 - protein, 249 aa, Artificial Sequence
  Description of Artificial Sequence: Synthetic polypeptide
  XENP019084 1G6_H1.259_L1_scFv(GKPGS)4
EVQLVESGGGLVKPGGSLRLSCAASGFTFSNYWMDWVRQAPGKGLEWVGEIRLKSNNYATHYAEPVKGRFTISRDDSKSTVYLQMNSLKTEDTAVYYCKRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 14861 - protein, 122 aa, Artificial Sequence
  Description of Artificial Sequence: Synthetic polypeptide
  VH of XENP019084
EVQLVESGGGLVKPGGSLRLSCAASGFTFSNYWMDWVRQAPGKGLEWVGEIRLKSNNYATHYAEPVKGRFTISRDDSKSTVYLQMNSLKTEDTAVYYCKRYYGNYGGYFDVWGAGTLVTVSS

SEQ ID NO: 14862 - protein, 107 aa, Artificial Sequence; identical to SEQ ID NO: 10923
  Description of Artificial Sequence: Synthetic polypeptide
  VL of XENP019084

SEQ ID NO: 14863 - protein, 5 aa, Artificial Sequence
  Description of Artificial Sequence: Synthetic peptide
  XENP019084 vhCDR1
NYWMD

SEQ ID NO: 14864 - protein, 19 aa, Artificial Sequence
  Description of Artificial Sequence: Synthetic peptide
  XENP019084 vhCDR2
EIRLKSNNYATHYAEPVKG

SEQ ID NO: 14865 - protein, 11 aa, Artificial Sequence
  Description of Artificial Sequence: Synthetic peptide
  XENP019084 vhCDR3
YYGNYGGYFDV

SEQ ID NO: 14866 - protein, 11 aa, Artificial Sequence
  Description of Artificial Sequence: Synthetic peptide
  XENP019084 vlCDR1
RASQSVSNDVA

SEQ ID NO: 14867 - protein, 7 aa, Artificial Sequence
  Description of Artificial Sequence: Synthetic peptide
  XENP019084 vlCDR2
YASHRYT

SEQ ID NO: 14868 - protein, 9 aa, Artificial Sequence
  Description of Artificial Sequence: Synthetic peptide
  XENP019084 vlCDR3
QQDYSSPRT

SEQ ID NO: 14869 - protein, 249 aa, Artificial Sequence
  Description of Artificial Sequence: Synthetic polypeptide
  XENP019085 1G6_H1.260_L1_scFv(GKPGS)4
EVQLVESGGGLVKPGESLRLSCAASGFTFSNYWMNWVRQAPGKGLEWVGEIRLKSNNYATHYAEPVKGRFTISRDDSKSTVYLQMNSRKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 14870 - protein, 122 aa, Artificial Sequence
  Description of Artificial Sequence: Synthetic polypeptide
  VH of XENP019085
EVQLVESGGGLVKPGESLRLSCAASGFTFSNYWMNWVRQAPGKGLEWVGEIRLKSNNYATHYAEPVKGRFTISRDDSKSTVYLQMNSRKTEDTAVYYCTRYYGNYGGYFDVWGAGTLVTVSS

SEQ ID NO: 14871 - protein, 107 aa, Artificial Sequence; identical to SEQ ID NO: 10923
  Description of Artificial Sequence: Synthetic polypeptide
  VL of XENP019085

SEQ ID NO: 14872 - protein, 5 aa, Artificial Sequence
  Description of Artificial Sequence: Synthetic peptide
  XENP019085 vhCDR1
NYWMN

SEQ ID NO: 14873 - protein, 19 aa, Artificial Sequence
  Description of Artificial Sequence: Synthetic peptide
  XENP019085 vhCDR2
EIRLKSNNYATHYAEPVKG

SEQ ID NO: 14874 - protein, 11 aa, Artificial Sequence
  Description of Artificial Sequence: Synthetic peptide
  XENP019085 vhCDR3
YYGNYGGYFDV

SEQ ID NO: 14875 - protein, 11 aa, Artificial Sequence
  Description of Artificial Sequence: Synthetic peptide
  XENP019085 vlCDR1
RASQSVSNDVA

SEQ ID NO: 14876 - protein, 7 aa, Artificial Sequence
  Description of Artificial Sequence: Synthetic peptide
  XENP019085 vlCDR2
YASHRYT

SEQ ID NO: 14877 - protein, 9 aa, Artificial Sequence
  Description of Artificial Sequence: Synthetic peptide
  XENP019085 vlCDR3
QQDYSSPRT

SEQ ID NO: 14878 - protein, 249 aa, Artificial Sequence
  Description of Artificial Sequence: Synthetic polypeptide
  XENP019086 1G6_H1.261_L1_scFv(GKPGS)4
EVQLVESGGGLVKPGGSLRLSCKASGFTFSNYWMNWVRQAPGKGLEWVGEIRLKSNNYATHYAEPVKGRFTISRDDSKDTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 14879 - protein, 122 aa, Artificial Sequence
  Description of Artificial Sequence: Synthetic polypeptide
  VH of XENP019086
EVQLVESGGGLVKPGGSLRLSCKASGFTFSNYWMNWVRQAPGKGLEWVGEIRLKSNNYATHYAEPVKGRFTISRDDSKDTVYLQMNSLKTEDTAVYYCTRYYGNYGGYFDVWGAGTLVTVSS

SEQ ID NO: 14880 - protein, 107 aa, Artificial Sequence; identical to SEQ ID NO: 10923
  Description of Artificial Sequence: Synthetic polypeptide
  VL of XENP019086

SEQ ID NO: 14881 - protein, 5 aa, Artificial Sequence
  Description of Artificial Sequence: Synthetic peptide
  XENP019086 vhCDR1
NYWMN

SEQ ID NO: 14882 - protein, 19 aa, Artificial Sequence
  Description of Artificial Sequence: Synthetic peptide
  XENP019086 vhCDR2
EIRLKSNNYATHYAEPVKG

SEQ ID NO: 14883 - protein, 11 aa, Artificial Sequence
  Description of Artificial Sequence: Synthetic peptide
  XENP019086 vhCDR3
YYGNYGGYFDV

SEQ ID NO: 14884 - protein, 11 aa, Artificial Sequence
  Description of Artificial Sequence: Synthetic peptide
  XENP019086 vlCDR1
RASQSVSNDVA

SEQ ID NO: 14885 - protein, 7 aa, Artificial Sequence
  Description of Artificial Sequence: Synthetic peptide
  XENP019086 vlCDR2
YASHRYT

SEQ ID NO: 14886 - protein, 9 aa, Artificial Sequence
  Description of Artificial Sequence: Synthetic peptide
  XENP019086 vlCDR3
QQDYSSPRT

SEQ ID NO: 14887 - protein, 249 aa, Artificial Sequence
  Description of Artificial Sequence: Synthetic polypeptide
  XENP019087 1G6_H1.262_L1_scFv(GKPGS)4
EVQLVESGGGLVKPGESLRLSCAASGFTFSNYWMNWVRQAPGKGLEWVGEIRLKSNNYATHYAEPVKGRFTISRDDSKSTVYLQMNRLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 14888 - protein, 122 aa, Artificial Sequence
  Description of Artificial Sequence: Synthetic polypeptide
  VH of XENP019087
EVQLVESGGGLVKPGESLRLSCAASGFTFSNYWMNWVRQAPGKGLEWVGEIRLKSNNYATHYAEPVKGRFTISRDDSKSTVYLQMNRLKTEDTAVYYCTRYYGNYGGYFDVWGAGTLVTVSS

SEQ ID NO: 14889 - protein, 107 aa, Artificial Sequence; identical to SEQ ID NO: 10923
  Description of Artificial Sequence: Synthetic polypeptide
  VL of XENP019087

SEQ ID NO: 14890 - protein, 5 aa, Artificial Sequence
  Description of Artificial Sequence: Synthetic peptide
  XENP019087 vhCDR1
NYWMN

SEQ ID NO: 14891 - protein, 19 aa, Artificial Sequence
  Description of Artificial Sequence: Synthetic peptide
  XENP019087 vhCDR2
EIRLKSNNYATHYAEPVKG

SEQ ID NO: 14892 - protein, 11 aa, Artificial Sequence
  Description of Artificial Sequence: Synthetic peptide
  XENP019087 vhCDR3
YYGNYGGYFDV

SEQ ID NO: 14893 - protein, 11 aa, Artificial Sequence
  Description of Artificial Sequence: Synthetic peptide
  XENP019087 vlCDR1
RASQSVSNDVA

SEQ ID NO: 14894 - protein, 7 aa, Artificial Sequence
  Description of Artificial Sequence: Synthetic peptide
  XENP019087 vlCDR2
YASHRYT

SEQ ID NO: 14895 - protein, 9 aa, Artificial Sequence
  Description of Artificial Sequence: Synthetic peptide
  XENP019087 vlCDR3
QQDYSSPRT

SEQ ID NO: 14896 - protein, 249 aa, Artificial Sequence
  Description of Artificial Sequence: Synthetic polypeptide
  XENP019088 1G6_H1.263_L1_scFv(GKPGS)4
EVQLVESGGGLVKPGGSLRLSCAASGFTFSNYWMNWVRQAPGKGLEWVGEIRLKSNNYATHYAEKVKGLFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 14897 - protein, 122 aa, Artificial Sequence
  Description of Artificial Sequence: Synthetic polypeptide
  VH of XENP019088
EVQLVESGGGLVKPGGSLRLSCAASGFTFSNYWMNWVRQAPGKGLEWVGEIRLKSNNYATHYAEKVKGLFTISRDDSKSTVYLQMNSLKTEDTAVYYCTRYYGNYGGYFDVWGAGTLVTVSS

SEQ ID NO: 14898 - protein, 107 aa, Artificial Sequence; identical to SEQ ID NO: 10923
  Description of Artificial Sequence: Synthetic polypeptide
  VL of XENP019088

SEQ ID NO: 14899 - protein, 5 aa, Artificial Sequence
  Description of Artificial Sequence: Synthetic peptide
  XENP019088 vhCDR1
NYWMN

SEQ ID NO: 14900 - protein, 19 aa, Artificial Sequence
  Description of Artificial Sequence: Synthetic peptide
  XENP019088 vhCDR2
EIRLKSNNYATHYAEKVKG

SEQ ID NO: 14901 - protein, 11 aa, Artificial Sequence
  Description of Artificial Sequence: Synthetic peptide
  XENP019088 vhCDR3
YYGNYGGYFDV

SEQ ID NO: 14902 - protein, 11 aa, Artificial Sequence
  Description of Artificial Sequence: Synthetic peptide
  XENP019088 vlCDR1
RASQSVSNDVA

SEQ ID NO: 14903 - protein, 7 aa, Artificial Sequence
  Description of Artificial Sequence: Synthetic peptide
  XENP019088 vlCDR2
YASHRYT

SEQ ID NO: 14904 - protein, 9 aa, Artificial Sequence
  Description of Artificial Sequence: Synthetic peptide
  XENP019088 vlCDR3
QQDYSSPRT

SEQ ID NO: 14905 - protein, 249 aa, Artificial Sequence
  Description of Artificial Sequence: Synthetic polypeptide
  XENP019089 1G6_H1.264_L1_scFv(GKPGS)4
EVQLVESGGGLVKPGGSLRLSCKASGDTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 14906 - protein, 122 aa, Artificial Sequence
  Description of Artificial Sequence: Synthetic polypeptide
  VH of XENP019089
EVQLVESGGGLVKPGGSLRLSCKASGDTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSS

SEQ ID NO: 14907 - protein, 107 aa, Artificial Sequence; identical to SEQ ID NO: 10923
  Description of Artificial Sequence: Synthetic polypeptide
  VL of XENP019089

SEQ ID NO: 14908 - protein, 5 aa, Artificial Sequence
  Description of Artificial Sequence: Synthetic peptide
  XENP019089 vhCDR1
NYWMN

SEQ ID NO: 14909 - protein, 19 aa, Artificial Sequence
  Description of Artificial Sequence: Synthetic peptide
  XENP019089 vhCDR2
EIRLKSNNYATHYAEPVKG

SEQ ID NO: 14910 - protein, 11 aa, Artificial Sequence
  Description of Artificial Sequence: Synthetic peptide
  XENP019089 vhCDR3
YYGNYGGYFDV

SEQ ID NO: 14911 - protein, 11 aa, Artificial Sequence
  Description of Artificial Sequence: Synthetic peptide
  XENP019089 vlCDR1
RASQSVSNDVA

SEQ ID NO: 14912 - protein, 7 aa, Artificial Sequence
  Description of Artificial Sequence: Synthetic peptide
  XENP019089 vlCDR2
YASHRYT

SEQ ID NO: 14913 - protein, 9 aa, Artificial Sequence
  Description of Artificial Sequence: Synthetic peptide
  XENP019089 vlCDR3
QQDYSSPRT

SEQ ID NO: 14914 - protein, 249 aa, Artificial Sequence
  Description of Artificial Sequence: Synthetic polypeptide
  XENP019090 1G6_H1.265_L1_scFv(GKPGS)4
EVQLVESGGGLVKPGESLRLSCAASGFTFSNYWMNWVRQAPGKGLEWVGEIRLKSNNYATHYAEPVKGRFTISRDDSKSTVYLKMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 14915 - protein, 122 aa, Artificial Sequence
  Description of Artificial Sequence: Synthetic polypeptide
  VH of XENP019090
EVQLVESGGGLVKPGESLRLSCAASGFTFSNYWMNWVRQAPGKGLEWVGEIRLKSNNYATHYAEPVKGRFTISRDDSKSTVYLKMNSLKTEDTAVYYCTRYYGNYGGYFDVWGAGTLVTVSS

SEQ ID NO: 14916 - protein, 107 aa, Artificial Sequence; identical to SEQ ID NO: 10923
  Description of Artificial Sequence: Synthetic polypeptide
  VL of XENP019090

SEQ ID NO: 14917 - protein, 5 aa, Artificial Sequence
  Description of Artificial Sequence: Synthetic peptide
  XENP019090 vhCDR1
NYWMN

SEQ ID NO: 14918 - protein, 19 aa, Artificial Sequence
  Description of Artificial Sequence: Synthetic peptide
  XENP019090 vhCDR2
EIRLKSNNYATHYAEPVKG

SEQ ID NO: 14919 - protein, 11 aa, Artificial Sequence
  Description of Artificial Sequence: Synthetic peptide
  XENP019090 vhCDR3
YYGNYGGYFDV

SEQ ID NO: 14920 - protein, 11 aa, Artificial Sequence
  Description of Artificial Sequence: Synthetic peptide
  XENP019090 vlCDR1
RASQSVSNDVA

SEQ ID NO: 14921 - protein, 7 aa, Artificial Sequence
  Description of Artificial Sequence: Synthetic peptide
  XENP019090 vlCDR2
YASHRYT

SEQ ID NO: 14922 - protein, 9 aa, Artificial Sequence
  Description of Artificial Sequence: Synthetic peptide
  XENP019090 vlCDR3
QQDYSSPRT

SEQ ID NO: 14923 - protein, 249 aa, Artificial Sequence
  Description of Artificial Sequence: Synthetic polypeptide
  XENP019091 1G6_H1.266_L1_scFv(GKPGS)4
EVQLVESGGGLVKPGGSLRLSCAASGFTFSNYWMNWVRQAPGKGLEWVGEIRLKSNNYATHYAQPVKDRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 14924 - protein, 122 aa, Artificial Sequence
  Description of Artificial Sequence: Synthetic polypeptide
  VH of XENP019091
EVQLVESGGGLVKPGGSLRLSCAASGFTFSNYWMNWVRQAPGKGLEWVGEIRLKSNNYATHYAQPVKDRFTISRDDSKSTVYLQMNSLKTEDTAVYYCTRYYGNYGGYFDVWGAGTLVTVSS

SEQ ID NO: 14925 - protein, 107 aa, Artificial Sequence; identical to SEQ ID NO: 10923
  Description of Artificial Sequence: Synthetic polypeptide
  VL of XENP019091

SEQ ID NO: 14926 - protein, 5 aa, Artificial Sequence
  Description of Artificial Sequence: Synthetic peptide
  XENP019091 vhCDR1
NYWMN

SEQ ID NO: 14927 - protein, 19 aa, Artificial Sequence
  Description of Artificial Sequence: Synthetic peptide
  XENP019091 vhCDR2
EIRLKSNNYATHYAQPVKD

SEQ ID NO: 14928 - protein, 11 aa, Artificial Sequence
  Description of Artificial Sequence: Synthetic peptide
  XENP019091 vhCDR3
YYGNYGGYFDV

SEQ ID NO: 14929 - protein, 11 aa, Artificial Sequence
  Description of Artificial Sequence: Synthetic peptide
  XENP019091 vlCDR1
RASQSVSNDVA

SEQ ID NO: 14930 - protein, 7 aa, Artificial Sequence
  Description of Artificial Sequence: Synthetic peptide
  XENP019091 vlCDR2
YASHRYT

SEQ ID NO: 14931 - protein, 9 aa, Artificial Sequence
  Description of Artificial Sequence: Synthetic peptide
  XENP019091 vlCDR3
QQDYSSPRT

SEQ ID NO: 14932 - protein, 249 aa, Artificial Sequence
  Description of Artificial Sequence: Synthetic polypeptide
  XENP019092 1G6_H1.267_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLEMNSRKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 14933 - protein, 122 aa, Artificial Sequence
  Description of Artificial Sequence: Synthetic polypeptide
  VH of XENP019092
EVQLVESGGGLVKPGGSLRLSCAASGFTFSNYWMNWVRQAPGKGLEWVGEIRLKSNNYATHYAEPVKGRFTISRDDSKSTVYLEMNSRKTEDTAVYYCTRYYGNYGGYFDVWGAGTLVTVSS

SEQ ID NO: 14934 - protein, 107 aa, Artificial Sequence; identical to SEQ ID NO: 10923
  Description of Artificial Sequence: Synthetic polypeptide
  VL of XENP019092

SEQ ID NO: 14935 - protein, 5 aa, Artificial Sequence
  Description of Artificial Sequence: Synthetic peptide
  XENP019092 vhCDR1
NYWMN

SEQ ID NO: 14936 - protein, 19 aa, Artificial Sequence
  Description of Artificial Sequence: Synthetic peptide
  XENP019092 vhCDR2
EIRLKSNNYATHYAEPVKG

SEQ ID NO: 14937 - protein, 11 aa, Artificial Sequence
  Description of Artificial Sequence: Synthetic peptide
  XENP019092 vhCDR3
YYGNYGGYFDV

SEQ ID NO: 14938 - protein, 11 aa, Artificial Sequence
  Description of Artificial Sequence: Synthetic peptide
  XENP019092 vlCDR1
RASQSVSNDVA

SEQ ID NO: 14939 - protein, 7 aa, Artificial Sequence
  Description of Artificial Sequence: Synthetic peptide
  XENP019092 vlCDR2
YASHRYT

SEQ ID NO: 14940 - protein, 9 aa, Artificial Sequence
  Description of Artificial Sequence: Synthetic peptide
  XENP019092 vlCDR3
QQDYSSPRT

SEQ ID NO: 14941 - protein, 249 aa, Artificial Sequence
  Description of Artificial Sequence: Synthetic polypeptide
  XENP019093 1G6_H1.268_L1_scFv(GKPGS)4
EVQLVESGGGLVKPGESLRLSCAASGFTFSNYWMNWVRQAPGKGLEWVGEIRLKSNNYATHYAEPVKGRFTISRDDSKSTVYLQMRSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 14942 - protein, 122 aa, Artificial Sequence
  Description of Artificial Sequence: Synthetic polypeptide
  VH of XENP019093
EVQLVESGGGLVKPGESLRLSCAASGFTFSNYWMNWVRQAPGKGLEWVGEIRLKSNNYATHYAEPVKGRFTISRDDSKSTVYLQMRSLKTEDTAVYYCTRYYGNYGGYFDVWGAGTLVTVSS

SEQ ID NO: 14943 - protein, 107 aa, Artificial Sequence; identical to SEQ ID NO: 10923
  Description of Artificial Sequence: Synthetic polypeptide
  VL of XENP019093

SEQ ID NO: 14944 - protein, 5 aa, Artificial Sequence
  Description of Artificial Sequence: Synthetic peptide
  XENP019093 vhCDR1
NYWMN

SEQ ID NO: 14945 - protein, 19 aa, Artificial Sequence
  Description of Artificial Sequence: Synthetic peptide
  XENP019093 vhCDR2
EIRLKSNNYATHYAEPVKG

SEQ ID NO: 14946 - protein, 11 aa, Artificial Sequence
  Description of Artificial Sequence: Synthetic peptide
  XENP019093 vhCDR3
YYGNYGGYFDV

SEQ ID NO: 14947 - protein, 11 aa, Artificial Sequence
  Description of Artificial Sequence: Synthetic peptide
  XENP019093 vlCDR1
RASQSVSNDVA

SEQ ID NO: 14948 - protein, 7 aa, Artificial Sequence
  Description of Artificial Sequence: Synthetic peptide
  XENP019093 vlCDR2
YASHRYT

SEQ ID NO: 14949 - protein, 9 aa, Artificial Sequence
  Description of Artificial Sequence: Synthetic peptide
  XENP019093 vlCDR3
QQDYSSPRT

SEQ ID NO: 14950 - protein, 249 aa, Artificial Sequence
  Description of Artificial Sequence: Synthetic polypeptide
  XENP019094 1G6_H1.269_L1_scFv(GKPGS)4
EVQLVESGGGLVKPGGSLRLSCAASGFTFSNFWMNWVRQAPGKGLEWVGEIRLYSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 14951 - protein, 122 aa, Artificial Sequence
  Description of Artificial Sequence: Synthetic polypeptide
  VH of XENP019094
EVQLVESGGGLVKPGGSLRLSCAASGFTFSNFWMNWVRQAPGKGLEWVGEIRLYSNNYATHYAEPVKGRFTISRDDSKSTVYLQMNSLKTEDTAVYYCTRYYGNYGGYFDVWGAGTLVTVSS

SEQ ID NO: 14952 - protein, 107 aa, Artificial Sequence; identical to SEQ ID NO: 10923
  Description of Artificial Sequence: Synthetic polypeptide
  VL of XENP019094

SEQ ID NO: 14953 - protein, 5 aa, Artificial Sequence
  Description of Artificial Sequence: Synthetic peptide
  XENP019094 vhCDR1
NFWMN

SEQ ID NO: 14954 - protein, 19 aa, Artificial Sequence
  Description of Artificial Sequence: Synthetic peptide
  XENP019094 vhCDR2
EIRLYSNNYATHYAEPVKG

SEQ ID NO: 14955 - protein, 11 aa, Artificial Sequence
  Description of Artificial Sequence: Synthetic peptide
  XENP019094 vhCDR3
YYGNYGGYFDV

SEQ ID NO: 14956 - protein, 11 aa, Artificial Sequence
  Description of Artificial Sequence: Synthetic peptide
  XENP019094 vlCDR1
RASQSVSNDVA

SEQ ID NO: 14957 - protein, 7 aa, Artificial Sequence
  Description of Artificial Sequence: Synthetic peptide
  XENP019094 vlCDR2
YASHRYT

SEQ ID NO: 14958 - protein, 9 aa, Artificial Sequence
  Description of Artificial Sequence: Synthetic peptide
  XENP019094 vlCDR3
QQDYSSPRT

SEQ ID NO: 14959 - protein, 249 aa, Artificial Sequence
  Description of Artificial Sequence: Synthetic polypeptide
  XENP019095 1G6_H1.270_L1_scFv(GKPGS)4
EVQLVESGGGLVKPGGSLRLSCAASGFTFSNYWMNWVRQAPGKGLEWVGEIRWYSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 14960 - protein, 122 aa, Artificial Sequence
  Description of Artificial Sequence: Synthetic polypeptide
  VH of XENP019095
EVQLVESGGGLVKPGGSLRLSCAASGFTFSNYWMNWVRQAPGKGLEWVGEIRWYSNNYATHYAEPVKGRFTISRDDSKSTVYLQMNSLKTEDTAVYYCTRYYGNYGGYFDVWGAGTLVTVSS

SEQ ID NO: 14961 - protein, 107 aa, Artificial Sequence; identical to SEQ ID NO: 10923
  Description of Artificial Sequence: Synthetic polypeptide
  VL of XENP019095

SEQ ID NO: 14962 - protein, 5 aa, Artificial Sequence
  Description of Artificial Sequence: Synthetic peptide
  XENP019095 vhCDR1
NYWMN

SEQ ID NO: 14963 - protein, 19 aa, Artificial Sequence
  Description of Artificial Sequence: Synthetic peptide
  XENP019095 vhCDR2
EIRWYSNNYATHYAEPVKG

SEQ ID NO: 14964 - protein, 11 aa, Artificial Sequence
  Description of Artificial Sequence: Synthetic peptide
  XENP019095 vhCDR3
YYGNYGGYFDV

SEQ ID NO: 14965 - protein, 11 aa, Artificial Sequence
  Description of Artificial Sequence: Synthetic peptide
  XENP019095 vlCDR1
RASQSVSNDVA

SEQ ID NO: 14966 - protein, 7 aa, Artificial Sequence
  Description of Artificial Sequence: Synthetic peptide
  XENP019095 vlCDR2
YASHRYT

SEQ ID NO: 14967 - protein, 9 aa, Artificial Sequence
  Description of Artificial Sequence: Synthetic peptide
  XENP019095 vlCDR3
QQDYSSPRT

SEQ ID NO: 14968 - protein, 249 aa, Artificial Sequence
  Description of Artificial Sequence: Synthetic polypeptide
  XENP019096 1G6_H1.271_L1_scFv(GKPGS)4
EVQLVESGGGLVKPGGSLRLSCAASGFTFSNYWMNWVRQAPGKGLEWVGEIRLYSNNYATHYAEPVKGRFTISRDDSKSTLYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 14969 - protein, 122 aa, Artificial Sequence
  Description of Artificial Sequence: Synthetic polypeptide
  VH of XENP019096
EVQLVESGGGLVKPGGSLRLSCAASGFTFSNYWMNWVRQAPGKGLEWVGEIRLYSNNYATHYAEPVKGRFTISRDDSKSTLYLQMNSLKTEDTAVYYCTRYYGNYGGYFDVWGAGTLVTVSS

SEQ ID NO: 14970 - protein, 107 aa, Artificial Sequence; identical to SEQ ID NO: 10923
  Description of Artificial Sequence: Synthetic polypeptide
  VL of XENP019096

SEQ ID NO: 14971 - protein, 5 aa, Artificial Sequence
  Description of Artificial Sequence: Synthetic peptide
  XENP019096 vhCDR1
NYWMN

SEQ ID NO: 14972 - protein, 19 aa, Artificial Sequence
  Description of Artificial Sequence: Synthetic peptide
  XENP019096 vhCDR2
EIRLYSNNYATHYAEPVKG

SEQ ID NO: 14973 - protein, 11 aa, Artificial Sequence
  Description of Artificial Sequence: Synthetic peptide
  XENP019096 vhCDR3
YYGNYGGYFDV

SEQ ID NO: 14974 - protein, 11 aa, Artificial Sequence
  Description of Artificial Sequence: Synthetic peptide
  XENP019096 vlCDR1
RASQSVSNDVA

SEQ ID NO: 14975 - protein, 7 aa, Artificial Sequence
  Description of Artificial Sequence: Synthetic peptide
  XENP019096 vlCDR2
YASHRYT

SEQ ID NO: 14976 - protein, 9 aa, Artificial Sequence
  Description of Artificial Sequence: Synthetic peptide
  XENP019096 vlCDR3
QQDYSSPRT

SEQ ID NO: 14977 - protein, 249 aa, Artificial Sequence
  Description of Artificial Sequence: Synthetic polypeptide
  XENP019101 1G6_H1.272_L1_scFv(GKPGS)4
EVQLVESGGGLVKPGGSLRLSCAASGFTFSNFWMNWVRQAPGKGLEWVGEIRLYSNNYATHYAEPVKGRFTISRDDSKSTLYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 14978 - protein, 122 aa, Artificial Sequence
  Description of Artificial Sequence: Synthetic polypeptide
  VH of XENP019101
EVQLVESGGGLVKPGGSLRLSCAASGFTFSNFWMNWVRQAPGKGLEWVGEIRLYSNNYATHYAEPVKGRFTISRDDSKSTLYLQMNSLKTEDTAVYYCTRYYGNYGGYFDVWGAGTLVTVSS

SEQ ID NO: 14979 - protein, 107 aa, Artificial Sequence; identical to SEQ ID NO: 10923
  Description of Artificial Sequence: Synthetic polypeptide
  VL of XENP019101

SEQ ID NO: 14980 - protein, 5 aa, Artificial Sequence
  Description of Artificial Sequence: Synthetic peptide
  XENP019101 vhCDR1
NFWMN

SEQ ID NO: 14981 - protein, 19 aa, Artificial Sequence
  Description of Artificial Sequence: Synthetic peptide
  XENP019101 vhCDR2
EIRLYSNNYATHYAEPVKG

SEQ ID NO: 14982 - protein, 11 aa, Artificial Sequence
  Description of Artificial Sequence: Synthetic peptide
  XENP019101 vhCDR3
YYGNYGGYFDV

SEQ ID NO: 14983 - protein, 11 aa, Artificial Sequence
  Description of Artificial Sequence: Synthetic peptide
  XENP019101 vlCDR1
RASQSVSNDVA

SEQ ID NO: 14984 - protein, 7 aa, Artificial Sequence
  Description of Artificial Sequence: Synthetic peptide
  XENP019101 vlCDR2
YASHRYT

SEQ ID NO: 14985 - protein, 9 aa, Artificial Sequence
  Description of Artificial Sequence: Synthetic peptide
  XENP019101 vlCDR3
QQDYSSPRT

SEQ ID NO: 14986 - protein, 249 aa, Artificial Sequence
  Description of Artificial Sequence: Synthetic polypeptide
  XENP019102 1G6_H1.273_L1_scFv(GKPGS)4
EVQLVESGGGLVKPGGSLRLSCAASGFTFSNFWMNWVRQAPGKGLEWVGEIRWKSNNYATHYAEPVKGRFTISRDDSKSTLYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 14987 - protein, 122 aa, Artificial Sequence
  Description of Artificial Sequence: Synthetic polypeptide
  VH of XENP019102
EVQLVESGGGLVKPGGSLRLSCAASGFTFSNFWMNWVRQAPGKGLEWVGEIRWKSNNYATHYAEPVKGRFTISRDDSKSTLYLQMNSLKTEDTAVYYCTRYYGNYGGYFDVWGAGTLVTVSS

SEQ ID NO: 14988 - protein, 107 aa, Artificial Sequence; identical to SEQ ID NO: 10923
  Description of Artificial Sequence: Synthetic polypeptide
  VL of XENP019102

SEQ ID NO: 14989 - protein, 5 aa, Artificial Sequence
  Description of Artificial Sequence: Synthetic peptide
  XENP019102 vhCDR1
NFWMN

SEQ ID NO: 14990 - protein, 19 aa, Artificial Sequence
  Description of Artificial Sequence: Synthetic peptide
  XENP019102 vhCDR2
EIRWKSNNYATHYAEPVKG

SEQ ID NO: 14991 - protein, 11 aa, Artificial Sequence
  Description of Artificial Sequence: Synthetic peptide
  XENP019102 vhCDR3
YYGNYGGYFDV

SEQ ID NO: 14992 - protein, 11 aa, Artificial Sequence
  Description of Artificial Sequence: Synthetic peptide
  XENP019102 vlCDR1
RASQSVSNDVA

SEQ ID NO: 14993 - protein, 7 aa, Artificial Sequence
  Description of Artificial Sequence: Synthetic peptide
  XENP019102 vlCDR2
YASHRYT

SEQ ID NO: 14994 - protein, 9 aa, Artificial Sequence
  Description of Artificial Sequence: Synthetic peptide
  XENP019102 vlCDR3
QQDYSSPRT

SEQ ID NO: 14995 - protein, 249 aa, Artificial Sequence
  Description of Artificial Sequence: Synthetic polypeptide
  XENP019103 1G6_H1.274_L1_scFv(GKPGS)4
EVQLVESGGGLVKPGGSLRLSCAASGFTFSNFWMNWVRQAPGKGLEWVGEIRLKKNNYATHYAEPVKGRFTISRDDSKSTLYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 14996 - protein, 122 aa, Artificial Sequence
  Description of Artificial Sequence: Synthetic polypeptide
  VH of XENP019103
EVQLVESGGGLVKPGGSLRLSCAASGFTFSNFWMNWVRQAPGKGLEWVGEIRLKKNNYATHYAEPVKGRFTISRDDSKSTLYLQMNSLKTEDTAVYYCTRYYGNYGGYFDVWGAGTLVTVSS

SEQ ID NO: 14997 - protein, 107 aa, Artificial Sequence; identical to SEQ ID NO: 10923
  Description of Artificial Sequence: Synthetic polypeptide
  VL of XENP019103

SEQ ID NO: 14998 - protein, 5 aa, Artificial Sequence
  Description of Artificial Sequence: Synthetic peptide
  XENP019103 vhCDR1
NFWMN

SEQ ID NO: 14999 - protein, 19 aa, Artificial Sequence
  Description of Artificial Sequence: Synthetic peptide
  XENP019103 vhCDR2
EIRLKKNNYATHYAEPVKG

SEQ ID NO: 15000 - protein, 11 aa, Artificial Sequence
  Description of Artificial Sequence: Synthetic peptide
  XENP019103 vhCDR3
YYGNYGGYFDV

SEQ ID NO: 15001 - protein, 11 aa, Artificial Sequence
  Description of Artificial Sequence: Synthetic peptide
  XENP019103 vlCDR1
RASQSVSNDVA

SEQ ID NO: 15002 - protein, 7 aa, Artificial Sequence
  Description of Artificial Sequence: Synthetic peptide
  XENP019103 vlCDR2
YASHRYT

SEQ ID NO: 15003 - protein, 9 aa, Artificial Sequence
  Description of Artificial Sequence: Synthetic peptide
  XENP019103 vlCDR3
QQDYSSPRT

SEQ ID NO: 15004 - protein, 249 aa, Artificial Sequence
  Description of Artificial Sequence: Synthetic polypeptide
  XENP019104 1G6_H1.275_L1_scFv(GKPGS)4
EVQLVESGGGLVKPGGSLRLSCAASGFTFSNFWMNWVRQAPGKGLEWVGEIRWYSNNYATHYAEPVKGRFTISRDDSKSTLYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 15005 - protein, 122 aa, Artificial Sequence
  Description of Artificial Sequence: Synthetic polypeptide
  VH of XENP019104
EVQLVESGGGLVKPGGSLRLSCAASGFTFSNFWMNWVRQAPGKGLEWVGEIRWYSNNYATHYAEPVKGRFTISRDDSKSTLYLQMNSLKTEDTAVYYCTRYYGNYGGYFDVWGAGTLVTVSS

SEQ ID NO: 15006 - protein, 107 aa, Artificial Sequence; identical to SEQ ID NO: 10923
  Description of Artificial Sequence: Synthetic polypeptide
  VL of XENP019104

SEQ ID NO: 15007 - protein, 5 aa, Artificial Sequence
  Description of Artificial Sequence: Synthetic peptide
  XENP019104 vhCDR1
NFWMN

SEQ ID NO: 15008 - protein, 19 aa, Artificial Sequence
  Description of Artificial Sequence: Synthetic peptide
  XENP019104 vhCDR2
EIRWYSNNYATHYAEPVKG

SEQ ID NO: 15009 - protein, 11 aa, Artificial Sequence
  Description of Artificial Sequence: Synthetic peptide
  XENP019104 vhCDR3
YYGNYGGYFDV

SEQ ID NO: 15010 - protein, 11 aa, Artificial Sequence
  Description of Artificial Sequence: Synthetic peptide
  XENP019104 vlCDR1
RASQSVSNDVA

SEQ ID NO: 15011 - protein, 7 aa, Artificial Sequence
  Description of Artificial Sequence: Synthetic peptide
  XENP019104 vlCDR2
YASHRYT

SEQ ID NO: 15012 - protein, 9 aa, Artificial Sequence
  Description of Artificial Sequence: Synthetic peptide
  XENP019104 vlCDR3
QQDYSSPRT

SEQ ID NO: 15013 - protein, 249 aa, Artificial Sequence
  Description of Artificial Sequence: Synthetic polypeptide
  XENP019105 1G6_H1.276_L1_scFv(GKPGS)4
EVQLVESGGGLVQPGGSLKLSCAASGFTFSNYWMNWVRQAPGKGLEWVGEIRLKSNNYATHYAASVKGRFTISRDDSKSTLYLQMNSLKTEDTAVYYCTRYYGNYGGYFDVWGQGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 15014 - protein, 122 aa, Artificial Sequence
  Description of Artificial Sequence: Synthetic polypeptide
  VH of XENP019105
EVQLVESGGGLVQPGGSLKLSCAASGFTFSNYWMNWVRQAPGKGLEWVGEIRLKSNNYATHYAASVKGRFTISRDDSKSTLYLQMNSLKTEDTAVYYCTRYYGNYGGYFDVWGQGTLVTVSS

SEQ ID NO: 15015 - protein, 107 aa, Artificial Sequence; identical to SEQ ID NO: 10923
  Description of Artificial Sequence: Synthetic polypeptide
  VL of XENP019105

SEQ ID NO: 15016 - protein, 5 aa, Artificial Sequence
  Description of Artificial Sequence: Synthetic peptide
  XENP019105 vhCDR1
NYWMN

SEQ ID NO: 15017 - protein, 19 aa, Artificial Sequence
  Description of Artificial Sequence: Synthetic peptide
  XENP019105 vhCDR2
EIRLKSNNYATHYAASVKG

SEQ ID NO: 15018 - protein, 11 aa, Artificial Sequence
  Description of Artificial Sequence: Synthetic peptide
  XENP019105 vhCDR3
YYGNYGGYFDV

SEQ ID NO: 15019 - protein, 11 aa, Artificial Sequence
  Description of Artificial Sequence: Synthetic peptide
  XENP019105 vlCDR1
RASQSVSNDVA

SEQ ID NO: 15020 - protein, 7 aa, Artificial Sequence
  Description of Artificial Sequence: Synthetic peptide
  XENP019105 vlCDR2
YASHRYT

SEQ ID NO: 15021 - protein, 9 aa, Artificial Sequence
  Description of Artificial Sequence: Synthetic peptide
  XENP019105 vlCDR3
QQDYSSPRT

SEQ ID NO: 15022 - protein, 249 aa, Artificial Sequence
  Description of Artificial Sequence: Synthetic polypeptide
  XENP019106 1G6_H1.277_L1_scFv(GKPGS)4
EVQLVESGGGLVKPGGSLKLSCAASGFTFSNYWMNWVRQAPGKGLEWVGEIRLKSNNYATHYADSVKGRFTISRDDSKSTLYLQMNSLKTEDTAVYYCTRYYGNYGGYFDVWGQGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 15023 - protein, 122 aa, Artificial Sequence
  Description of Artificial Sequence: Synthetic polypeptide
  VH of XENP019106
EVQLVESGGGLVKPGGSLKLSCAASGFTFSNYWMNWVRQAPGKGLEWVGEIRLKSNNYATHYADSVKGRFTISRDDSKSTLYLQMNSLKTEDTAVYYCTRYYGNYGGYFDVWGQGTLVTVSS

SEQ ID NO: 15024 - protein, 107 aa, Artificial Sequence; identical to SEQ ID NO: 10923
  Description of Artificial Sequence: Synthetic polypeptide
  VL of XENP019106

SEQ ID NO: 15025 - protein, 5 aa, Artificial Sequence
  Description of Artificial Sequence: Synthetic peptide
  XENP019106 vhCDR1
NYWMN

SEQ ID NO: 15026 - protein, 19 aa, Artificial Sequence
  Description of Artificial Sequence: Synthetic peptide
  XENP019106 vhCDR2
EIRLKSNNYATHYADSVKG

SEQ ID NO: 15027 - protein, 11 aa, Artificial Sequence
  Description of Artificial Sequence: Synthetic peptide
  XENP019106 vhCDR3
YYGNYGGYFDV

SEQ ID NO: 15028 - protein, 11 aa, Artificial Sequence
  Description of Artificial Sequence: Synthetic peptide
  XENP019106 vlCDR1
RASQSVSNDVA

SEQ ID NO: 15029 - protein, 7 aa, Artificial Sequence
  Description of Artificial Sequence: Synthetic peptide
  XENP019106 vlCDR2
YASHRYT

SEQ ID NO: 15030 - protein, 9 aa, Artificial Sequence
  Description of Artificial Sequence: Synthetic peptide
  XENP019106 vlCDR3
QQDYSSPRT

SEQ ID NO: 15031 - protein, 249 aa, Artificial Sequence
  Description of Artificial Sequence: Synthetic polypeptide
  XENP019107 1G6_H1_L1.146_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLAVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 15032 - protein, 122 aa, Artificial Sequence; identical to SEQ ID NO: 10922
  Description of Artificial Sequence: Synthetic polypeptide
  VH of XENP019107

SEQ ID NO: 15033 - protein, 107 aa, Artificial Sequence
  Description of Artificial Sequence: Synthetic polypeptide
  VL of XENP019107
SIVMTQSPATLAVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 15034 - protein, 5 aa, Artificial Sequence
  Description of Artificial Sequence: Synthetic peptide
  XENP019107 vhCDR1
NYWMN

SEQ ID NO: 15035 - protein, 19 aa, Artificial Sequence
  Description of Artificial Sequence: Synthetic peptide
  XENP019107 vhCDR2
EIRLKSNNYATHYAEPVKG

SEQ ID NO: 15036 - protein, 11 aa, Artificial Sequence
  Description of Artificial Sequence: Synthetic peptide
  XENP019107 vhCDR3
YYGNYGGYFDV

SEQ ID NO: 15037 - protein, 11 aa, Artificial Sequence
  Description of Artificial Sequence: Synthetic peptide
  XENP019107 vlCDR1
RASQSVSNDVA

SEQ ID NO: 15038 - protein, 7 aa, Artificial Sequence
  Description of Artificial Sequence: Synthetic peptide
  XENP019107 vlCDR2
YASHRYT

SEQ ID NO: 15039 - protein, 9 aa, Artificial Sequence
  Description of Artificial Sequence: Synthetic peptide
  XENP019107 vlCDR3
QQDYSSPRT

SEQ ID NO: 15040 - protein, 249 aa, Artificial Sequence
  Description of Artificial Sequence: Synthetic polypeptide
  XENP019108 1G6_H1_L1.147_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLPVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 15041 - protein, 122 aa, Artificial Sequence; identical to SEQ ID NO: 10922
  Description of Artificial Sequence: Synthetic polypeptide
  VH of XENP019108

SEQ ID NO: 15042 - protein, 107 aa, Artificial Sequence
  Description of Artificial Sequence: Synthetic polypeptide
  VL of XENP019108
SIVMTQSPATLPVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 15043 - protein, 5 aa, Artificial Sequence
  Description of Artificial Sequence: Synthetic peptide
  XENP019108 vhCDR1
NYWMN

SEQ ID NO: 15044 - protein, 19 aa, Artificial Sequence
  Description of Artificial Sequence: Synthetic peptide
  XENP019108 vhCDR2
EIRLKSNNYATHYAEPVKG

SEQ ID NO: 15045 - protein, 11 aa, Artificial Sequence
  Description of Artificial Sequence: Synthetic peptide
  XENP019108 vhCDR3
YYGNYGGYFDV

SEQ ID NO: 15046 - protein, 11 aa, Artificial Sequence
  Description of Artificial Sequence: Synthetic peptide
  XENP019108 vlCDR1
RASQSVSNDVA

SEQ ID NO: 15047 - protein, 7 aa, Artificial Sequence
  Description of Artificial Sequence: Synthetic peptide
  XENP019108 vlCDR2
YASHRYT

SEQ ID NO: 15048 - protein, 9 aa, Artificial Sequence
  Description of Artificial Sequence: Synthetic peptide
  XENP019108 vlCDR3
QQDYSSPRT

SEQ ID NO: 15049 - protein, 249 aa, Artificial Sequence
  Description of Artificial Sequence: Synthetic polypeptide
  XENP019109 1G6_H1_L1.148_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSASPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 15050 - protein, 122 aa, Artificial Sequence; identical to SEQ ID NO: 10922
  Description of Artificial Sequence: Synthetic polypeptide
  VH of XENP019109

SEQ ID NO: 15051 - protein, 107 aa, Artificial Sequence
  Description of Artificial Sequence: Synthetic polypeptide
  VL of XENP019109
SIVMTQSPATLSASPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 15052 - protein, 5 aa, Artificial Sequence
  Description of Artificial Sequence: Synthetic peptide
  XENP019109 vhCDR1
NYWMN

SEQ ID NO: 15053 - protein, 19 aa, Artificial Sequence
  Description of Artificial Sequence: Synthetic peptide
  XENP019109 vhCDR2
EIRLKSNNYATHYAEPVKG

SEQ ID NO: 15054 - protein, 11 aa, Artificial Sequence
  Description of Artificial Sequence: Synthetic peptide
  XENP019109 vhCDR3
YYGNYGGYFDV

SEQ ID NO: 15055 - protein, 11 aa, Artificial Sequence
  Description of Artificial Sequence: Synthetic peptide
  XENP019109 vlCDR1
RASQSVSNDVA

SEQ ID NO: 15056 - protein, 7 aa, Artificial Sequence
  Description of Artificial Sequence: Synthetic peptide
  XENP019109 vlCDR2
YASHRYT

SEQ ID NO: 15057 - protein, 9 aa, Artificial Sequence
  Description of Artificial Sequence: Synthetic peptide
  XENP019109 vlCDR3
QQDYSSPRT

SEQ ID NO: 15058 - protein, 249 aa, Artificial Sequence
  Description of Artificial Sequence: Synthetic polypeptide
  XENP019110 1G6_H1_L1.149_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERASLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 15059 - protein, 122 aa, Artificial Sequence; identical to SEQ ID NO: 10922
  Description of Artificial Sequence: Synthetic polypeptide
  VH of XENP019110

SEQ ID NO: 15060 - protein, 107 aa, Artificial Sequence
  Description of Artificial Sequence: Synthetic polypeptide
  VL of XENP019110
SIVMTQSPATLSVSPGERASLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 15061 - protein, 5 aa, Artificial Sequence
  Description of Artificial Sequence: Synthetic peptide
  XENP019110 vhCDR1
NYWMN

SEQ ID NO: 15062 - protein, 19 aa, Artificial Sequence
  Description of Artificial Sequence: Synthetic peptide
  XENP019110 vhCDR2
EIRLKSNNYATHYAEPVKG

SEQ ID NO: 15063 - protein, 11 aa, Artificial Sequence
  Description of Artificial Sequence: Synthetic peptide
  XENP019110 vhCDR3
YYGNYGGYFDV

SEQ ID NO: 15064 - protein, 11 aa, Artificial Sequence
  Description of Artificial Sequence: Synthetic peptide
  XENP019110 vlCDR1
RASQSVSNDVA

SEQ ID NO: 15065 - protein, 7 aa, Artificial Sequence
  Description of Artificial Sequence: Synthetic peptide
  XENP019110 vlCDR2
YASHRYT

SEQ ID NO: 15066 - protein, 9 aa, Artificial Sequence
  Description of Artificial Sequence: Synthetic peptide
  XENP019110 vlCDR3
QQDYSSPRT

SEQ ID NO: 15067 - protein, 249 aa, Artificial Sequence
  Description of Artificial Sequence: Synthetic polypeptide
  XENP019111 1G6_H1_L1.150_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLKCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 15068 - protein, 122 aa, Artificial Sequence; identical to SEQ ID NO: 10922
  Description of Artificial Sequence: Synthetic polypeptide
  VH of XENP019111

SEQ ID NO: 15069 - protein, 107 aa, Artificial Sequence
  Description of Artificial Sequence: Synthetic polypeptide
  VL of XENP019111
SIVMTQSPATLSVSPGERATLKCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 15070 - protein, 5 aa, Artificial Sequence
  Description of Artificial Sequence: Synthetic peptide
  XENP019111 vhCDR1
NYWMN

SEQ ID NO: 15071 - protein, 19 aa, Artificial Sequence
  Description of Artificial Sequence: Synthetic peptide
  XENP019111 vhCDR2
EIRLKSNNYATHYAEPVKG

SEQ ID NO: 15072 - protein, 11 aa, Artificial Sequence
  Description of Artificial Sequence: Synthetic peptide
  XENP019111 vhCDR3
YYGNYGGYFDV

SEQ ID NO: 15073 - protein, 11 aa, Artificial Sequence
  Description of Artificial Sequence: Synthetic peptide
  XENP019111 vlCDR1
RASQSVSNDVA

SEQ ID NO: 15074 - protein, 7 aa, Artificial Sequence
  Description of Artificial Sequence: Synthetic peptide
  XENP019111 vlCDR2
YASHRYT

SEQ ID NO: 15075 - protein, 9 aa, Artificial Sequence
  Description of Artificial Sequence: Synthetic peptide
  XENP019111 vlCDR3
QQDYSSPRT

SEQ ID NO: 15076 - protein, 249 aa, Artificial Sequence
  Description of Artificial Sequence: Synthetic polypeptide
  XENP019112 1G6_H1_L1.151_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPEQSPRLLINYASHRYTGVPDRFTGSGYGTEFTLTISSLQSEDFAVYFCQQDYSSPRTFGGGTKVEIK

SEQ ID NO: 15077 - protein, 122 aa, Artificial Sequence; identical to SEQ ID NO: 10922
  Description of Artificial Sequence: Synthetic polypeptide
  VH of XENP019112

SEQ ID NO: 15078 - protein, 107 aa, Artificial Sequence
  Description of Artificial Sequence: Synthetic polypeptide
  VL of XENP019112
SIVMTQSPATLSVSPGERATLSCRASQSVSNDVAWYQQKPEQSPRLLINYASHRYTGVPDRFTGSGYGTEFTLTISSLQSEDFAVYFCQQDYSSPRTFGGGTKVEIK

SEQ ID NO: 15079 - protein, 5 aa, Artificial Sequence
  Description of Artificial Sequence: Synthetic peptide
  XENP019112 vhCDR1
NYWMN

SEQ ID NO: 15080 - protein, 19 aa, Artificial Sequence
  Description of Artificial Sequence: Synthetic peptide
  XENP019112 vhCDR2
EIRLKSNNYATHYAEPVKG

SEQ ID NO: 15081 - protein, 11 aa, Artificial Sequence
  Description of Artificial Sequence: Synthetic peptide
  XENP019112 vhCDR3
YYGNYGGYFDV

SEQ ID NO: 15082 - protein, 11 aa, Artificial Sequence
  Description of Artificial Sequence: Synthetic peptide
  XENP019112 vlCDR1
RASQSVSNDVA

SEQ ID NO: 15083 - protein, 7 aa, Artificial Sequence
  Description of Artificial Sequence: Synthetic peptide
  XENP019112 vlCDR2
YASHRYT

SEQ ID NO: 15084 - protein, 9 aa, Artificial Sequence
  Description of Artificial Sequence: Synthetic peptide
  XENP019112 vlCDR3
QQDYSSPRT

SEQ ID NO: 15085 - protein, 249 aa, Artificial Sequence
  Description of Artificial Sequence: Synthetic polypeptide
  XENP019113 1G6_H1_L1.152_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGESPRLLINYASHRYTGVPDRFTGSGYGTEFTLTISSLQSEDFAVYFCQQDYSSPRTFGGGTKVEIK

SEQ ID NO: 15086 - protein, 122 aa, Artificial Sequence; identical to SEQ ID NO: 10922
  Description of Artificial Sequence: Synthetic polypeptide
  VH of XENP019113

SEQ ID NO: 15087 - protein, 107 aa, Artificial Sequence
  Description of Artificial Sequence: Synthetic polypeptide
  VL of XENP019113
SIVMTQSPATLSVSPGERATLSCRASQSVSNDVAWYQQKPGESPRLLINYASHRYTGVPDRFTGSGYGTEFTLTISSLQSEDFAVYFCQQDYSSPRTFGGGTKVEIK

SEQ ID NO: 15088 - protein, 5 aa, Artificial Sequence
  Description of Artificial Sequence: Synthetic peptide
  XENP019113 vhCDR1
NYWMN

SEQ ID NO: 15089 - protein, 19 aa, Artificial Sequence
  Description of Artificial Sequence: Synthetic peptide
  XENP019113 vhCDR2
EIRLKSNNYATHYAEPVKG

SEQ ID NO: 15090 - protein, 11 aa, Artificial Sequence
  Description of Artificial Sequence: Synthetic peptide
  XENP019113 vhCDR3
YYGNYGGYFDV

SEQ ID NO: 15091 - protein, 11 aa, Artificial Sequence
  Description of Artificial Sequence: Synthetic peptide
  XENP019113 vlCDR1
RASQSVSNDVA

SEQ ID NO: 15092 - protein, 7 aa, Artificial Sequence
  Description of Artificial Sequence: Synthetic peptide
  XENP019113 vlCDR2
YASHRYT

SEQ ID NO: 15093 - protein, 9 aa, Artificial Sequence
  Description of Artificial Sequence: Synthetic peptide
  XENP019113 vlCDR3
QQDYSSPRT

SEQ ID NO: 15094 - protein, 249 aa, Artificial Sequence
  Description of Artificial Sequence: Synthetic polypeptide
  XENP019114 1G6_H1_L1.153_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRVLINYASHRYTGVPDRFTGSGYGTEFTLTISSLQSEDFAVYFCQQDYSSPRTFGGGTKVEIK

SEQ ID NO: 15095 - protein, 122 aa, Artificial Sequence; identical to SEQ ID NO: 10922
  Description of Artificial Sequence: Synthetic polypeptide
  VH of XENP019114

SEQ ID NO: 15096 - protein, 107 aa, Artificial Sequence
  Description of Artificial Sequence: Synthetic polypeptide
  VL of XENP019114
SIVMTQSPATLSVSPGERATLSCRASQSVSNDVAWYQQKPGQSPRVLINYASHRYTGVPDRFTGSGYGTEFTLTISSLQSEDFAVYFCQQDYSSPRTFGGGTKVEIK

SEQ ID NO: 15097 - protein, 5 aa, Artificial Sequence
  Description of Artificial Sequence: Synthetic peptide
  XENP019114 vhCDR1
NYWMN

SEQ ID NO: 15098 - protein, 19 aa, Artificial Sequence
  Description of Artificial Sequence: Synthetic peptide
  XENP019114 vhCDR2
EIRLKSNNYATHYAEPVKG

SEQ ID NO: 15099 - protein, 11 aa, Artificial Sequence
  Description of Artificial Sequence: Synthetic peptide
  XENP019114 vhCDR3
YYGNYGGYFDV

SEQ ID NO: 15100 - protein, 11 aa, Artificial Sequence
  Description of Artificial Sequence: Synthetic peptide
  XENP019114 vlCDR1
RASQSVSNDVA

SEQ ID NO: 15101 - protein, 7 aa, Artificial Sequence
  Description of Artificial Sequence: Synthetic peptide
  XENP019114 vlCDR2
YASHRYT

SEQ ID NO: 15102 - protein, 9 aa, Artificial Sequence
  Description of Artificial Sequence: Synthetic peptide
  XENP019114 vlCDR3
QQDYSSPRT

SEQ ID NO: 15103 - protein, 249 aa, Artificial Sequence
  Description of Artificial Sequence: Synthetic polypeptide
  XENP019115 1G6_H1_L1.154_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLVNYASHRYTGVPDRFTGSGYGTEFTLTISSLQSEDFAVYFCQQDYSSPRTFGGGTKVEIK

SEQ ID NO: 15104 - protein, 122 aa, Artificial Sequence; identical to SEQ ID NO: 10922
  Description of Artificial Sequence: Synthetic polypeptide
  VH of XENP019115

SEQ ID NO: 15105 - protein, 107 aa, Artificial Sequence
  Description of Artificial Sequence: Synthetic polypeptide
  VL of XENP019115
SIVMTQSPATLSVSPGERATLSCRASQSVSNDVAWYQQKPGQSPRLLVNYASHRYTGVPDRFTGSGYGTEFTLTISSLQSEDFAVYFCQQDYSSPRTFGGGTKVEIK

SEQ ID NO: 15106 - protein, 5 aa, Artificial Sequence
  Description of Artificial Sequence: Synthetic peptide
  XENP019115 vhCDR1
NYWMN

SEQ ID NO: 15107 - protein, 19 aa, Artificial Sequence
  Description of Artificial Sequence: Synthetic peptide
  XENP019115 vhCDR2
EIRLKSNNYATHYAEPVKG

SEQ ID NO: 15108 - protein, 11 aa, Artificial Sequence
  Description of Artificial Sequence: Synthetic peptide
  XENP019115 vhCDR3
YYGNYGGYFDV

SEQ ID NO: 15109 - protein, 11 aa, Artificial Sequence
  Description of Artificial Sequence: Synthetic peptide
  XENP019115 vlCDR1
RASQSVSNDVA

SEQ ID NO: 15110 - protein, 9 aa, Artificial Sequence
  Description of Artificial Sequence: Synthetic peptide
  XENP019115 vlCDR2
VNYASHRYT

SEQ ID NO: 15111 - protein, 9 aa, Artificial Sequence
  Description of Artificial Sequence: Synthetic peptide
  XENP019115 vlCDR3
QQDYSSPRT

SEQ ID NO: 15112 - protein, 249 aa, Artificial Sequence
  Description of Artificial Sequence: Synthetic polypeptide
  XENP019116 1G6_H1_L1.155_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYANHRYTGVPDRFTGSGYGTEFTLTISSLQSEDFAVYFCQQDYSSPRTFGGGTKVEIK

SEQ ID NO: 15113 - protein, 122 aa, Artificial Sequence; identical to SEQ ID NO: 10922
  Description of Artificial Sequence: Synthetic polypeptide
  VH of XENP019116

SEQ ID NO: 15114 - protein, 107 aa, Artificial Sequence
  Description of Artificial Sequence: Synthetic polypeptide
  VL of XENP019116
SIVMTQSPATLSVSPGERATLSCRASQSVSNDVAWYQQKPGQSPRLLINYANHRYTGVPDRFTGSGYGTEFTLTISSLQSEDFAVYFCQQDYSSPRTFGGGTKVEIK

SEQ ID NO: 15115 - protein, 5 aa, Artificial Sequence
  Description of Artificial Sequence: Synthetic peptide
  XENP019116 vhCDR1
NYWMN

SEQ ID NO: 15116 - protein, 19 aa, Artificial Sequence
  Description of Artificial Sequence: Synthetic peptide
  XENP019116 vhCDR2
EIRLKSNNYATHYAEPVKG

SEQ ID NO: 15117 - protein, 11 aa, Artificial Sequence
  Description of Artificial Sequence: Synthetic peptide
  XENP019116 vhCDR3
YYGNYGGYFDV

SEQ ID NO: 15118 - protein, 11 aa, Artificial Sequence
  Description of Artificial Sequence: Synthetic peptide
  XENP019116 vlCDR1
RASQSVSNDVA

SEQ ID NO: 15119 - protein, 7 aa, Artificial Sequence
  Description of Artificial Sequence: Synthetic peptide
  XENP019116 vlCDR2
YANHRYT

SEQ ID NO: 15120 - protein, 9 aa, Artificial Sequence
  Description of Artificial Sequence: Synthetic peptide
  XENP019116 vlCDR3
QQDYSSPRT

SEQ ID NO: 15121 - protein, 249 aa, Artificial Sequence
  Description of Artificial Sequence: Synthetic polypeptide
  XENP019117 1G6_H1_L1.156_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLESEDFAVYFCQQDYSSPRTFGGGTKVEIK

SEQ ID NO: 15122 - protein, 122 aa, Artificial Sequence; identical to SEQ ID NO: 10922
  Description of Artificial Sequence: Synthetic polypeptide
  VH of XENP019117

SEQ ID NO: 15123 - protein, 107 aa, Artificial Sequence
  Description of Artificial Sequence: Synthetic polypeptide
  VL of XENP019117
SIVMTQSPATLSVSPGERATLSCRASQSVSNDVAWYQQKPGQSPRLLINYASHRYTGVPDRFTGSGYGTEFTLTISSLESEDFAVYFCQQDYSSPRTFGGGTKVEIK

SEQ ID NO: 15124 - protein, 5 aa, Artificial Sequence
  Description of Artificial Sequence: Synthetic peptide
  XENP019117 vhCDR1
NYWMN

SEQ ID NO: 15125 - protein, 19 aa, Artificial Sequence
  Description of Artificial Sequence: Synthetic peptide
  XENP019117 vhCDR2
EIRLKSNNYATHYAEPVKG

SEQ ID NO: 15126 - protein, 11 aa, Artificial Sequence
  Description of Artificial Sequence: Synthetic peptide
  XENP019117 vhCDR3
YYGNYGGYFDV

SEQ ID NO: 15127 - protein, 11 aa, Artificial Sequence
  Description of Artificial Sequence: Synthetic peptide
  XENP019117 vlCDR1
RASQSVSNDVA

SEQ ID NO: 15128 - protein, 7 aa, Artificial Sequence
  Description of Artificial Sequence: Synthetic peptide
  XENP019117 vlCDR2
YASHRYT

SEQ ID NO: 15129 - protein, 9 aa, Artificial Sequence
  Description of Artificial Sequence: Synthetic peptide
  XENP019117 vlCDR3
QQDYSSPRT

SEQ ID NO: 15130 - protein, 249 aa, Artificial Sequence
  Description of Artificial Sequence: Synthetic polypeptide
  XENP019118 1G6_H1_L1.157_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLKSEDFAVYFCQQDYSSPRTFGGGTKVEIK

SEQ ID NO: 15131 - protein, 122 aa, Artificial Sequence; identical to SEQ ID NO: 10922
  Description of Artificial Sequence: Synthetic polypeptide
  VH of XENP019118

SEQ ID NO: 15132 - protein, 107 aa, Artificial Sequence
  Description of Artificial Sequence: Synthetic polypeptide
  VL of XENP019118
SIVMTQSPATLSVSPGERATLSCRASQSVSNDVAWYQQKPGQSPRLLINYASHRYTGVPDRFTGSGYGTEFTLTISSLKSEDFAVYFCQQDYSSPRTFGGGTKVEIK

SEQ ID NO: 15133 - protein, 5 aa, Artificial Sequence
  Description of Artificial Sequence: Synthetic peptide
  XENP019118 vhCDR1
NYWMN

SEQ ID NO: 15134 - protein, 19 aa, Artificial Sequence
  Description of Artificial Sequence: Synthetic peptide
  XENP019118 vhCDR2
EIRLKSNNYATHYAEPVKG

SEQ ID NO: 15135 - protein, 11 aa, Artificial Sequence
  Description of Artificial Sequence: Synthetic peptide
  XENP019118 vhCDR3
YYGNYGGYFDV

SEQ ID NO: 15136 - protein, 11 aa, Artificial Sequence
  Description of Artificial Sequence: Synthetic peptide
  XENP019118 vlCDR1
RASQSVSNDVA

SEQ ID NO: 15137 - protein, 7 aa, Artificial Sequence
  Description of Artificial Sequence: Synthetic peptide
  XENP019118 vlCDR2
YASHRYT

SEQ ID NO: 15138 - protein, 9 aa, Artificial Sequence
  Description of Artificial Sequence: Synthetic peptide
  XENP019118 vlCDR3
QQDYSSPRT

SEQ ID NO: 15139 - protein, 249 aa, Artificial Sequence
  Description of Artificial Sequence: Synthetic polypeptide
  XENP019119 1G6_H1_L1.158_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFGVYFCQQDYSSPRTFGGGTKVEIK

SEQ ID NO: 15140 - protein, 122 aa, Artificial Sequence; identical to SEQ ID NO: 10922
  Description of Artificial Sequence: Synthetic polypeptide
  VH of XENP019119

SEQ ID NO: 15141 - protein, 107 aa, Artificial Sequence
  Description of Artificial Sequence: Synthetic polypeptide
  VL of XENP019119
SIVMTQSPATLSVSPGERATLSCRASQSVSNDVAWYQQKPGQSPRLLINYASHRYTGVPDRFTGSGYGTEFTLTISSLQSEDFGVYFCQQDYSSPRTFGGGTKVEIK

SEQ ID NO: 15142 - protein, 5 aa, Artificial Sequence
  Description of Artificial Sequence: Synthetic peptide
  XENP019119 vhCDR1
NYWMN

SEQ ID NO: 15143 - protein, 19 aa, Artificial Sequence
  Description of Artificial Sequence: Synthetic peptide
  XENP019119 vhCDR2
EIRLKSNNYATHYAEPVKG

SEQ ID NO: 15144 - protein, 11 aa, Artificial Sequence
  Description of Artificial Sequence: Synthetic peptide
  XENP019119 vhCDR3
YYGNYGGYFDV

SEQ ID NO: 15145 - protein, 11 aa, Artificial Sequence
  Description of Artificial Sequence: Synthetic peptide
  XENP019119 vlCDR1
RASQSVSNDVA

SEQ ID NO: 15146 - protein, 7 aa, Artificial Sequence
  Description of Artificial Sequence: Synthetic peptide
  XENP019119 vlCDR2
YASHRYT

SEQ ID NO: 15147 - protein, 9 aa, Artificial Sequence
  Description of Artificial Sequence: Synthetic peptide
  XENP019119 vlCDR3
QQDYSSPRT

SEQ ID NO: 15148 - protein, 249 aa, Artificial Sequence
  Description of Artificial Sequence: Synthetic polypeptide
  XENP019120 1G6_H1_L1.159_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCKQDYSSPRTFGGGTKVEIK

SEQ ID NO: 15149 - protein, 122 aa, Artificial Sequence; identical to SEQ ID NO: 10922
  Description of Artificial Sequence: Synthetic polypeptide
  VH of XENP019120

SEQ ID NO: 15150 - protein, 107 aa, Artificial Sequence
  Description of Artificial Sequence: Synthetic polypeptide
  VL of XENP019120
SIVMTQSPATLSVSPGERATLSCRASQSVSNDVAWYQQKPGQSPRLLINYASHRYTGVPDRFTGSGYGTEFTLTISSLQSEDFAVYFCKQDYSSPRTFGGGTKVEIK

SEQ ID NO: 15151 - protein, 5 aa, Artificial Sequence
  Description of Artificial Sequence: Synthetic peptide
  XENP019120 vhCDR1
NYWMN

SEQ ID NO: 15152 - protein, 19 aa, Artificial Sequence
  Description of Artificial Sequence: Synthetic peptide
  XENP019120 vhCDR2
EIRLKSNNYATHYAEPVKG

SEQ ID NO: 15153 - protein, 11 aa, Artificial Sequence
  Description of Artificial Sequence: Synthetic peptide
  XENP019120 vhCDR3
YYGNYGGYFDV

SEQ ID NO: 15154 - protein, 11 aa, Artificial Sequence
  Description of Artificial Sequence: Synthetic peptide
  XENP019120 vlCDR1
RASQSVSNDVA

SEQ ID NO: 15155 - protein, 7 aa, Artificial Sequence
  Description of Artificial Sequence: Synthetic peptide
  XENP019120 vlCDR2
YASHRYT

SEQ ID NO: 15156 - protein, 9 aa, Artificial Sequence
  Description of Artificial Sequence: Synthetic peptide
  XENP019120 vlCDR3
KQDYSSPRT

SEQ ID NO: 15157 - protein, 249 aa, Artificial Sequence
  Description of Artificial Sequence: Synthetic polypeptide
  XENP019121 1G6_H1_L1.160_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQKDYSSPRTFGGGTKVEIK

SEQ ID NO: 15158 - protein, 122 aa, Artificial Sequence; identical to SEQ ID NO: 10922
  Description of Artificial Sequence: Synthetic polypeptide
  VH of XENP019121

SEQ ID NO: 15159 - protein, 107 aa, Artificial Sequence
  Description of Artificial Sequence: Synthetic polypeptide
  VL of XENP019121
SIVMTQSPATLSVSPGERATLSCRASQSVSNDVAWYQQKPGQSPRLLINYASHRYTGVPDRFTGSGYGTEFTLTISSLQSEDFAVYFCQKDYSSPRTFGGGTKVEIK

SEQ ID NO: 15160 - protein, 5 aa, Artificial Sequence
  Description of Artificial Sequence: Synthetic peptide
  XENP019121 vhCDR1
NYWMN

SEQ ID NO: 15161 - protein, 19 aa, Artificial Sequence
  Description of Artificial Sequence: Synthetic peptide
  XENP019121 vhCDR2
EIRLKSNNYATHYAEPVKG

SEQ ID NO: 15162 - protein, 11 aa, Artificial Sequence
  Description of Artificial Sequence: Synthetic peptide
  XENP019121 vhCDR3
YYGNYGGYFDV

SEQ ID NO: 15163 - protein, 11 aa, Artificial Sequence
  Description of Artificial Sequence: Synthetic peptide
  XENP019121 vlCDR1
RASQSVSNDVA

SEQ ID NO: 15164 - protein, 7 aa, Artificial Sequence
  Description of Artificial Sequence: Synthetic peptide
  XENP019121 vlCDR2
YASHRYT

SEQ ID NO: 15165 - protein, 9 aa, Artificial Sequence
  Description of Artificial Sequence: Synthetic peptide
  XENP019121 vlCDR3
QKDYSSPRT

SEQ ID NO: 15166 - protein, 249 aa, Artificial Sequence
  Description of Artificial Sequence: Synthetic polypeptide
  XENP019122 1G6_H1_L1.161_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQNDYSSPRTFGGGTKVEIK

SEQ ID NO: 15167 - protein, 122 aa, Artificial Sequence; identical to SEQ ID NO: 10922
  Description of Artificial Sequence: Synthetic polypeptide
  VH of XENP019122

SEQ ID NO: 15168 - protein, 107 aa, Artificial Sequence
  Description of Artificial Sequence: Synthetic polypeptide
  VL of XENP019122
SIVMTQSPATLSVSPGERATLSCRASQSVSNDVAWYQQKPGQSPRLLINYASHRYTGVPDRFTGSGYGTEFTLTISSLQSEDFAVYFCQNDYSSPRTFGGGTKVEIK

SEQ ID NO: 15169 - protein, 5 aa, Artificial Sequence
  Description of Artificial Sequence: Synthetic peptide
  XENP019122 vhCDR1
NYWMN

SEQ ID NO: 15170 - protein, 19 aa, Artificial Sequence
  Description of Artificial Sequence: Synthetic peptide
  XENP019122 vhCDR2
EIRLKSNNYATHYAEPVKG

SEQ ID NO: 15171 - protein, 11 aa, Artificial Sequence
  Description of Artificial Sequence: Synthetic peptide
  XENP019122 vhCDR3
YYGNYGGYFDV

SEQ ID NO: 15172 - protein, 11 aa, Artificial Sequence
  Description of Artificial Sequence: Synthetic peptide
  XENP019122 vlCDR1
RASQSVSNDVA

SEQ ID NO: 15173 - protein, 7 aa, Artificial Sequence
  Description of Artificial Sequence: Synthetic peptide
  XENP019122 vlCDR2
YASHRYT

SEQ ID NO: 15174 - protein, 9 aa, Artificial Sequence
  Description of Artificial Sequence: Synthetic peptide
  XENP019122 vlCDR3
QNDYSSPRT

SEQ ID NO: 15175 - protein, 249 aa, Artificial Sequence
  Description of Artificial Sequence: Synthetic polypeptide
  XENP019123 1G6_H1_L1.162_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQRDYSSPRTFGGGTKVEIK

SEQ ID NO: 15176 - protein, 122 aa, Artificial Sequence; identical to SEQ ID NO: 10922
  Description of Artificial Sequence: Synthetic polypeptide
  VH of XENP019123

SEQ ID NO: 15177 - protein, 107 aa, Artificial Sequence
  Description of Artificial Sequence: Synthetic polypeptide
  VL of XENP019123
SIVMTQSPATLSVSPGERATLSCRASQSVSNDVAWYQQKPGQSPRLLINYASHRYTGVPDRFTGSGYGTEFTLTISSLQSEDFAVYFCQRDYSSPRTFGGGTKVEIK

SEQ ID NO: 15178 - protein, 5 aa, Artificial Sequence
  Description of Artificial Sequence: Synthetic peptide
  XENP019123 vhCDR1
NYWMN

SEQ ID NO: 15179 - protein, 19 aa, Artificial Sequence
  Description of Artificial Sequence: Synthetic peptide
  XENP019123 vhCDR2
EIRLKSNNYATHYAEPVKG

SEQ ID NO: 15180 - protein, 11 aa, Artificial Sequence
  Description of Artificial Sequence: Synthetic peptide
  XENP019123 vhCDR3
YYGNYGGYFDV

SEQ ID NO: 15181 - protein, 11 aa, Artificial Sequence
  Description of Artificial Sequence: Synthetic peptide
  XENP019123 vlCDR1
RASQSVSNDVA

SEQ ID NO: 15182 - protein, 7 aa, Artificial Sequence
  Description of Artificial Sequence: Synthetic peptide
  XENP019123 vlCDR2
YASHRYT

SEQ ID NO: 15183 - protein, 9 aa, Artificial Sequence
  Description of Artificial Sequence: Synthetic peptide
  XENP019123 vlCDR3
QRDYSSPRT

SEQ ID NO: 15184 - protein, 249 aa, Artificial Sequence
  Description of Artificial Sequence: Synthetic polypeptide
  XENP019124 1G6_H1_L1.163_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGEPATLSCRASQSVSNDVAWYQQKPGQSPRLLINYASHRYTGVPDRFTGSGYGTEFTLTISRLQSEDFAVYFCQQDYSSPRTFGGGTKVEIK

SEQ ID NO: 15185 - protein, 122 aa, Artificial Sequence; identical to SEQ ID NO: 10922
  Description of Artificial Sequence: Synthetic polypeptide
  VH of XENP019124

SEQ ID NO: 15186 - protein, 107 aa, Artificial Sequence
  Description of Artificial Sequence: Synthetic polypeptide
  VL of XENP019124
SIVMTQSPATLSVSPGEPATLSCRASQSVSNDVAWYQQKPGQSPRLLINYASHRYTGVPDRFTGSGYGTEFTLTISRLQSEDFAVYFCQQDYSSPRTFGGGTKVEIK

SEQ ID NO: 15187 - protein, 5 aa, Artificial Sequence
  Description of Artificial Sequence: Synthetic peptide
  XENP019124 vhCDR1
NYWMN

SEQ ID NO: 15188 - protein, 19 aa, Artificial Sequence
  Description of Artificial Sequence: Synthetic peptide
  XENP019124 vhCDR2
EIRLKSNNYATHYAEPVKG

SEQ ID NO: 15189 - protein, 11 aa, Artificial Sequence
  Description of Artificial Sequence: Synthetic peptide
  XENP019124 vhCDR3
YYGNYGGYFDV

SEQ ID NO: 15190 - protein, 11 aa, Artificial Sequence
  Description of Artificial Sequence: Synthetic peptide
  XENP019124 vlCDR1
RASQSVSNDVA

SEQ ID NO: 15191 - protein, 7 aa, Artificial Sequence
  Description of Artificial Sequence: Synthetic peptide
  XENP019124 vlCDR2
YASHRYT

SEQ ID NO: 15192 - protein, 9 aa, Artificial Sequence
  Description of Artificial Sequence: Synthetic peptide
  XENP019124 vlCDR3
QQDYSSPRT

SEQ ID NO: 15193 - protein, 249 aa, Artificial Sequence
  Description of Artificial Sequence: Synthetic polypeptide
  XENP019125 1G6_H1_L1.164_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASESVSNDVAWYQQKPGQSPRLLINYASHRYTGVPDRFTGSGYGTEFTLTISSLQSEDFAVYFCQKDYSSPRTFGGGTKVEIK

SEQ ID NO: 15194 - protein, 122 aa, Artificial Sequence; identical to SEQ ID NO: 10922
  Description of Artificial Sequence: Synthetic polypeptide
  VH of XENP019125

SEQ ID NO: 15195 - protein, 107 aa, Artificial Sequence
  Description of Artificial Sequence: Synthetic polypeptide
  VL of XENP019125
SIVMTQSPATLSVSPGERATLSCRASESVSNDVAWYQQKPGQSPRLLINYASHRYTGVPDRFTGSGYGTEFTLTISSLQSEDFAVYFCQKDYSSPRTFGGGTKVEIK

SEQ ID NO: 15196 - protein, 5 aa, Artificial Sequence
  Description of Artificial Sequence: Synthetic peptide
  XENP019125 vhCDR1
NYWMN

SEQ ID NO: 15197 - protein, 19 aa, Artificial Sequence
  Description of Artificial Sequence: Synthetic peptide
  XENP019125 vhCDR2
EIRLKSNNYATHYAEPVKG

SEQ ID NO: 15198 - protein, 11 aa, Artificial Sequence
  Description of Artificial Sequence: Synthetic peptide
  XENP019125 vhCDR3
YYGNYGGYFDV

SEQ ID NO: 15199 - protein, 11 aa, Artificial Sequence
  Description of Artificial Sequence: Synthetic peptide
  XENP019125 vlCDR1
RASESVSNDVA

SEQ ID NO: 15200 - protein, 7 aa, Artificial Sequence
  Description of Artificial Sequence: Synthetic peptide
  XENP019125 vlCDR2
YASHRYT

SEQ ID NO: 15201 - protein, 9 aa, Artificial Sequence
  Description of Artificial Sequence: Synthetic peptide
  XENP019125 vlCDR3
QKDYSSPRT

SEQ ID NO: 15202 - protein, 249 aa, Artificial Sequence
  Description of Artificial Sequence: Synthetic polypeptide
  XENP019126 1G6_H1_L1.165_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASESVSNDVAWYQQKPGQSPRLLINYASHRYTGVPDRFTGSGYGTEFTLTISSLQSEDFAVYFCQQDYKSPRTFGGGTKVEIK

SEQ ID NO: 15203 - protein, 122 aa, Artificial Sequence; identical to SEQ ID NO: 10922
  Description of Artificial Sequence: Synthetic polypeptide
  VH of XENP019126

SEQ ID NO: 15204 - protein, 107 aa, Artificial Sequence
  Description of Artificial Sequence: Synthetic polypeptide
  VL of XENP019126
SIVMTQSPATLSVSPGERATLSCRASESVSNDVAWYQQKPGQSPRLLINYASHRYTGVPDRFTGSGYGTEFTLTISSLQSEDFAVYFCQQDYKSPRTFGGGTKVEIK

SEQ ID NO: 15205 - protein, 5 aa, Artificial Sequence
  Description of Artificial Sequence: Synthetic peptide
  XENP019126 vhCDR1
NYWMN

SEQ ID NO: 15206 - protein, 19 aa, Artificial Sequence
  Description of Artificial Sequence: Synthetic peptide
  XENP019126 vhCDR2
EIRLKSNNYATHYAEPVKG

SEQ ID NO: 15207 - protein, 11 aa, Artificial Sequence
  Description of Artificial Sequence: Synthetic peptide
  XENP019126 vhCDR3
YYGNYGGYFDV

SEQ ID NO: 15208 - protein, 11 aa, Artificial Sequence
  Description of Artificial Sequence: Synthetic peptide
  XENP019126 vlCDR1
RASESVSNDVA

SEQ ID NO: 15209 - protein, 7 aa, Artificial Sequence
  Description of Artificial Sequence: Synthetic peptide
  XENP019126 vlCDR2
YASHRYT

SEQ ID NO: 15210 - protein, 9 aa, Artificial Sequence
  Description of Artificial Sequence: Synthetic peptide
  XENP019126 vlCDR3
QQDYKSPRT

SEQ ID NO: 15211 - protein, 249 aa, Artificial Sequence
  Description of Artificial Sequence: Synthetic polypeptide
  XENP019127 1G6_H1_L1.166_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYRQKPEQSPRLLINYASHRYTGVPDRFTGSGYGTEFTLTISSLQSEDFAVYFCQQDYSSPRTFGGGTKVEIK

SEQ ID NO: 15212 - protein, 122 aa, Artificial Sequence; identical to SEQ ID NO: 10922
  Description of Artificial Sequence: Synthetic polypeptide
  VH of XENP019127

SEQ ID NO: 15213 - protein, 107 aa, Artificial Sequence
  Description of Artificial Sequence: Synthetic polypeptide
  VL of XENP019127
SIVMTQSPATLSVSPGERATLSCRASQSVSNDVAWYRQKPEQSPRLLINYASHRYTGVPDRFTGSGYGTEFTLTISSLQSEDFAVYFCQQDYSSPRTFGGGTKVEIK

SEQ ID NO: 15214 - protein, 5 aa, Artificial Sequence
  Description of Artificial Sequence: Synthetic peptide
  XENP019127 vhCDR1
NYWMN

SEQ ID NO: 15215 - protein, 19 aa, Artificial Sequence
  Description of Artificial Sequence: Synthetic peptide
  XENP019127 vhCDR2
EIRLKSNNYATHYAEPVKG

SEQ ID NO: 15216 - protein, 11 aa, Artificial Sequence
  Description of Artificial Sequence: Synthetic peptide
  XENP019127 vhCDR3
YYGNYGGYFDV

SEQ ID NO: 15217 - protein, 11 aa, Artificial Sequence
  Description of Artificial Sequence: Synthetic peptide
  XENP019127 vlCDR1
RASQSVSNDVA

SEQ ID NO: 15218 - protein, 7 aa, Artificial Sequence
  Description of Artificial Sequence: Synthetic peptide
  XENP019127 vlCDR2
YASHRYT

SEQ ID NO: 15219 - protein, 9 aa, Artificial Sequence
  Description of Artificial Sequence: Synthetic peptide
  XENP019127 vlCDR3
QQDYSSPRT

SEQ ID NO: 15220 - protein, 249 aa, Artificial Sequence
  Description of Artificial Sequence: Synthetic polypeptide
  XENP019128 1G6_H1_L1.167_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYRQKPGESPRLLINYASHRYTGVPDRFTGSGYGTEFTLTISSLQSEDFAVYFCQQDYSSPRTFGGGTKVEIK

SEQ ID NO: 15221 - protein, 122 aa, Artificial Sequence; identical to SEQ ID NO: 10922
  Description of Artificial Sequence: Synthetic polypeptide
  VH of XENP019128

SEQ ID NO: 15222 - protein, 107 aa, Artificial Sequence
  Description of Artificial Sequence: Synthetic polypeptide
  VL of XENP019128
SIVMTQSPATLSVSPGERATLSCRASQSVSNDVAWYRQKPGESPRLLINYASHRYTGVPDRFTGSGYGTEFTLTISSLQSEDFAVYFCQQDYSSPRTFGGGTKVEIK

SEQ ID NO: 15223 - protein, 5 aa, Artificial Sequence
  Description of Artificial Sequence: Synthetic peptide
  XENP019128 vhCDR1
NYWMN

SEQ ID NO: 15224 - protein, 19 aa, Artificial Sequence
  Description of Artificial Sequence: Synthetic peptide
  XENP019128 vhCDR2
EIRLKSNNYATHYAEPVKG

SEQ ID NO: 15225 - protein, 11 aa, Artificial Sequence
  Description of Artificial Sequence: Synthetic peptide
  XENP019128 vhCDR3
YYGNYGGYFDV

SEQ ID NO: 15226 - protein, 11 aa, Artificial Sequence
  Description of Artificial Sequence: Synthetic peptide
  XENP019128 vlCDR1
RASQSVSNDVA

SEQ ID NO: 15227 - protein, 7 aa, Artificial Sequence
  Description of Artificial Sequence: Synthetic peptide
  XENP019128 vlCDR2
YASHRYT

SEQ ID NO: 15228 - protein, 9 aa, Artificial Sequence
  Description of Artificial Sequence: Synthetic peptide
  XENP019128 vlCDR3
QQDYSSPRT

SEQ ID NO: 15229 - protein, 249 aa, Artificial Sequence
  Description of Artificial Sequence: Synthetic polypeptide
  XENP019129 1G6_H1_L1.168_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASWRYTGVPDRFTGSGYGTEFTLTISSLQSEDFAVYFCQQDFSSPRTFGGGTKVEIK

SEQ ID NO: 15230 - protein, 122 aa, Artificial Sequence; identical to SEQ ID NO: 10922
  Description of Artificial Sequence: Synthetic polypeptide
  VH of XENP019129

SEQ ID NO: 15231 - protein, 107 aa, Artificial Sequence
  Description of Artificial Sequence: Synthetic polypeptide
  VL of XENP019129
SIVMTQSPATLSVSPGERATLSCRASQSVSNDVAWYQQKPGQSPRLLINYASWRYTGVPDRFTGSGYGTEFTLTISSLQSEDFAVYFCQQDFSSPRTFGGGTKVEIK

SEQ ID NO: 15232 - protein, 5 aa, Artificial Sequence
  Description of Artificial Sequence: Synthetic peptide
  XENP019129 vhCDR1
NYWMN

SEQ ID NO: 15233 - protein, 19 aa, Artificial Sequence
  Description of Artificial Sequence: Synthetic peptide
  XENP019129 vhCDR2
EIRLKSNNYATHYAEPVKG

SEQ ID NO: 15234 - protein, 11 aa, Artificial Sequence
  Description of Artificial Sequence: Synthetic peptide
  XENP019129 vhCDR3
YYGNYGGYFDV

SEQ ID NO: 15235 - protein, 11 aa, Artificial Sequence
  Description of Artificial Sequence: Synthetic peptide
  XENP019129 vlCDR1
RASQSVSNDVA

SEQ ID NO: 15236 - protein, 7 aa, Artificial Sequence
  Description of Artificial Sequence: Synthetic peptide
  XENP019129 vlCDR2
YASWRYT

SEQ ID NO: 15237 - protein, 9 aa, Artificial Sequence
  Description of Artificial Sequence: Synthetic peptide
  XENP019129 vlCDR3
QQDFSSPRT

SEQ ID NO: 15238 - protein, 249 aa, Artificial Sequence
  Description of Artificial Sequence: Synthetic polypeptide
  XENP019130 1G6_H1_L1.169_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASWRYTGVPDRFTGSGYGTEFTLTISSLQSEDFAVYFCQQDWSSPRTFGGGTKVEIK

SEQ ID NO: 15239 - protein, 122 aa, Artificial Sequence; identical to SEQ ID NO: 10922
  Description of Artificial Sequence: Synthetic polypeptide
  VH of XENP019130

SEQ ID NO: 15240 - protein, 107 aa, Artificial Sequence
  Description of Artificial Sequence: Synthetic polypeptide
  VL of XENP019130
SIVMTQSPATLSVSPGERATLSCRASQSVSNDVAWYQQKPGQSPRLLINYASWRYTGVPDRFTGSGYGTEFTLTISSLQSEDFAVYFCQQDWSSPRTFGGGTKVEIK

SEQ ID NO: 15241 - protein, 5 aa, Artificial Sequence
  Description of Artificial Sequence: Synthetic peptide
  XENP019130 vhCDR1
NYWMN

SEQ ID NO: 15242 - protein, 19 aa, Artificial Sequence
  Description of Artificial Sequence: Synthetic peptide
  XENP019130 vhCDR2
EIRLKSNNYATHYAEPVKG

SEQ ID NO: 15243 - protein, 11 aa, Artificial Sequence
  Description of Artificial Sequence: Synthetic peptide
  XENP019130 vhCDR3
YYGNYGGYFDV

SEQ ID NO: 15244 - protein, 11 aa, Artificial Sequence
  Description of Artificial Sequence: Synthetic peptide
  XENP019130 vlCDR1
RASQSVSNDVA

SEQ ID NO: 15245 - protein, 7 aa, Artificial Sequence
  Description of Artificial Sequence: Synthetic peptide
  XENP019130 vlCDR2
YASWRYT

SEQ ID NO: 15246 - protein, 9 aa, Artificial Sequence
  Description of Artificial Sequence: Synthetic peptide
  XENP019130 vlCDR3
QQDWSSPRT

SEQ ID NO: 15247 - protein, 249 aa, Artificial Sequence
  Description of Artificial Sequence: Synthetic polypeptide
  XENP019131 1G6_H1_L1.170_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASWRYTGVPDRFTGSGYGTEFTLTISSLQSEDFAVYFCQQDGSSPRTFGGGTKVEIK

SEQ ID NO: 15248 - protein, 122 aa, Artificial Sequence; identical to SEQ ID NO: 10922
  Description of Artificial Sequence: Synthetic polypeptide
  VH of XENP019131

SEQ ID NO: 15249 - protein, 107 aa, Artificial Sequence
  Description of Artificial Sequence: Synthetic polypeptide
  VL of XENP019131
SIVMTQSPATLSVSPGERATLSCRASQSVSNDVAWYQQKPGQSPRLLINYASWRYTGVPDRFTGSGYGTEFTLTISSLQSEDFAVYFCQQDGSSPRTFGGGTKVEIK

SEQ ID NO: 15250 - protein, 5 aa, Artificial Sequence
  Description of Artificial Sequence: Synthetic peptide
  XENP019131 vhCDR1
NYWMN

SEQ ID NO: 15251 - protein, 19 aa, Artificial Sequence
  Description of Artificial Sequence: Synthetic peptide
  XENP019131 vhCDR2
EIRLKSNNYATHYAEPVKG

SEQ ID NO: 15252 - protein, 11 aa, Artificial Sequence
  Description of Artificial Sequence: Synthetic peptide
  XENP019131 vhCDR3
YYGNYGGYFDV

SEQ ID NO: 15253 - protein, 11 aa, Artificial Sequence
  Description of Artificial Sequence: Synthetic peptide
  XENP019131 vlCDR1
RASQSVSNDVA

SEQ ID NO: 15254 - protein, 7 aa, Artificial Sequence
  Description of Artificial Sequence: Synthetic peptide
  XENP019131 vlCDR2
YASWRYT

SEQ ID NO: 15255 - protein, 9 aa, Artificial Sequence
  Description of Artificial Sequence: Synthetic peptide
  XENP019131 vlCDR3
QQDGSSPRT

SEQ ID NO: 15256 - protein, 249 aa, Artificial Sequence
  Description of Artificial Sequence: Synthetic polypeptide
  XENP019132 1G6_H1_L1.171_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTSVPDRFTGSGYGTEFTLTISSLQSEDFAVYFCQQDWSSPRTFGGGTKVEIK

SEQ ID NO: 15257 - protein, 122 aa, Artificial Sequence; identical to SEQ ID NO: 10922
  Description of Artificial Sequence: Synthetic polypeptide
  VH of XENP019132

SEQ ID NO: 15258 - protein, 107 aa, Artificial Sequence
  Description of Artificial Sequence: Synthetic polypeptide
  VL of XENP019132
SIVMTQSPATLSVSPGERATLSCRASQSVSNDVAWYQQKPGQSPRLLINYASHRYTSVPDRFTGSGYGTEFTLTISSLQSEDFAVYFCQQDWSSPRTFGGGTKVEIK

SEQ ID NO: 15259 - protein, 5 aa, Artificial Sequence
  Description of Artificial Sequence: Synthetic peptide
  XENP019132 vhCDR1
NYWMN

SEQ ID NO: 15260 - protein, 19 aa, Artificial Sequence
  Description of Artificial Sequence: Synthetic peptide
  XENP019132 vhCDR2
EIRLKSNNYATHYAEPVKG

SEQ ID NO: 15261 - protein, 11 aa, Artificial Sequence
  Description of Artificial Sequence: Synthetic peptide
  XENP019132 vhCDR3
YYGNYGGYFDV

SEQ ID NO: 15262 - protein, 11 aa, Artificial Sequence
  Description of Artificial Sequence: Synthetic peptide
  XENP019132 vlCDR1
RASQSVSNDVA

SEQ ID NO: 15263 - protein, 7 aa, Artificial Sequence
  Description of Artificial Sequence: Synthetic peptide
  XENP019132 vlCDR2
YASHRYT

SEQ ID NO: 15264 - protein, 9 aa, Artificial Sequence
  Description of Artificial Sequence: Synthetic peptide
  XENP019132 vlCDR3
QQDWSSPRT

SEQ ID NO: 15265 - protein, 249 aa, Artificial Sequence
  Description of Artificial Sequence: Synthetic polypeptide
  XENP019133 1G6_H1_L1.172_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTSVPDRFTGSGYGTEFTLTISSLQSEDFAVYFCQQDFSSPRTFGGGTKVEIK

SEQ ID NO: 15266 - protein, 122 aa, Artificial Sequence; identical to SEQ ID NO: 10922
  Description of Artificial Sequence: Synthetic polypeptide
  VH of XENP019133

SEQ ID NO: 15267 - protein, 107 aa, Artificial Sequence
  Description of Artificial Sequence: Synthetic polypeptide
  VL of XENP019133
SIVMTQSPATLSVSPGERATLSCRASQSVSNDVAWYQQKPGQSPRLLINYASHRYTSVPDRFTGSGYGTEFTLTISSLQSEDFAVYFCQQDFSSPRTFGGGTKVEIK

SEQ ID NO: 15268 - protein, 5 aa, Artificial Sequence
  Description of Artificial Sequence: Synthetic peptide
  XENP019133 vhCDR1
NYWMN

SEQ ID NO: 15269 - protein, 19 aa, Artificial Sequence
  Description of Artificial Sequence: Synthetic peptide
  XENP019133 vhCDR2
EIRLKSNNYATHYAEPVKG

SEQ ID NO: 15270 - protein, 11 aa, Artificial Sequence
  Description of Artificial Sequence: Synthetic peptide
  XENP019133 vhCDR3
YYGNYGGYFDV

SEQ ID NO: 15271 - protein, 11 aa, Artificial Sequence
  Description of Artificial Sequence: Synthetic peptide
  XENP019133 vlCDR1
RASQSVSNDVA

SEQ ID NO: 15272 - protein, 7 aa, Artificial Sequence
  Description of Artificial Sequence: Synthetic peptide
  XENP019133 vlCDR2
YASHRYT

SEQ ID NO: 15273 - protein, 9 aa, Artificial Sequence
  Description of Artificial Sequence: Synthetic peptide
  XENP019133 vlCDR3
QQDFSSPRT

SEQ ID NO: 15274 - protein, 249 aa, Artificial Sequence
  Description of Artificial Sequence: Synthetic polypeptide
  XENP019134 1G6_H1_L1.173_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDFGSPRTFGGGTKVEIK

SEQ ID NO: 15275 - protein, 122 aa, Artificial Sequence; identical to SEQ ID NO: 10922
  Description of Artificial Sequence: Synthetic polypeptide
  VH of XENP019134

SEQ ID NO: 15276 - protein, 107 aa, Artificial Sequence
  Description of Artificial Sequence: Synthetic polypeptide
  VL of XENP019134
SIVMTQSPATLSVSPGERATLSCRASQSVSNDVAWYQQKPGQSPRLLINYASHRYTGVPDRFTGSGYGTEFTLTISSLQSEDFAVYFCQQDFGSPRTFGGGTKVEIK

SEQ ID NO: 15277 - protein, 5 aa, Artificial Sequence
  Description of Artificial Sequence: Synthetic peptide
  XENP019134 vhCDR1
NYWMN

SEQ ID NO: 15278 - protein, 19 aa, Artificial Sequence
  Description of Artificial Sequence: Synthetic peptide
  XENP019134 vhCDR2
EIRLKSNNYATHYAEPVKG

SEQ ID NO: 15279 - protein, 11 aa, Artificial Sequence
  Description of Artificial Sequence: Synthetic peptide
  XENP019134 vhCDR3
YYGNYGGYFDV

SEQ ID NO: 15280 - protein, 11 aa, Artificial Sequence
  Description of Artificial Sequence: Synthetic peptide
  XENP019134 vlCDR1
RASQSVSNDVA

SEQ ID NO: 15281 - protein, 7 aa, Artificial Sequence
  Description of Artificial Sequence: Synthetic peptide
  XENP019134 vlCDR2
YASHRYT

SEQ ID NO: 15282 - protein, 9 aa, Artificial Sequence
  Description of Artificial Sequence: Synthetic peptide
  XENP019134 vlCDR3
QQDFGSPRT

SEQ ID NO: 15283 - protein, 249 aa, Artificial Sequence
  Description of Artificial Sequence: Synthetic polypeptide
  XENP019135 1G6_H1_L1.174_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDWGSPRTFGGGTKVEIK

SEQ ID NO: 15284 - protein, 122 aa, Artificial Sequence; identical to SEQ ID NO: 10922
  Description of Artificial Sequence: Synthetic polypeptide
  VH of XENP019135

SEQ ID NO: 15285 - protein, 107 aa, Artificial Sequence
  Description of Artificial Sequence: Synthetic polypeptide
  VL of XENP019135
SIVMTQSPATLSVSPGERATLSCRASQSVSNDVAWYQQKPGQSPRLLINYASHRYTGVPDRFTGSGYGTEFTLTISSLQSEDFAVYFCQQDWGSPRTFGGGTKVEIK

SEQ ID NO: 15286 - protein, 5 aa, Artificial Sequence
  Description of Artificial Sequence: Synthetic peptide
  XENP019135 vhCDR1
NYWMN

SEQ ID NO: 15287 - protein, 19 aa, Artificial Sequence
  Description of Artificial Sequence: Synthetic peptide
  XENP019135 vhCDR2
EIRLKSNNYATHYAEPVKG

SEQ ID NO: 15288 - protein, 11 aa, Artificial Sequence
  Description of Artificial Sequence: Synthetic peptide
  XENP019135 vhCDR3
YYGNYGGYFDV

SEQ ID NO: 15289 - protein, 11 aa, Artificial Sequence
  Description of Artificial Sequence: Synthetic peptide
  XENP019135 vlCDR1
RASQSVSNDVA

SEQ ID NO: 15290 - protein, 7 aa, Artificial Sequence
  Description of Artificial Sequence: Synthetic peptide
  XENP019135 vlCDR2
YASHRYT

SEQ ID NO: 15291 - protein, 9 aa, Artificial Sequence
  Description of Artificial Sequence: Synthetic peptide
  XENP019135 vlCDR3
QQDWGSPRT

SEQ ID NO: 15292 - protein, 249 aa, Artificial Sequence
  Description of Artificial Sequence: Synthetic polypeptide
  XENP019136 1G6_H1_L1.175_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVGNDVAWYQQKPGQSPRLLINYASHRYTSVPDRFTGSGYGTEFTLTISSLQSEDFAVYFCQQDWSSPRTFGGGTKVEIK

SEQ ID NO: 15293 - protein, 122 aa, Artificial Sequence; identical to SEQ ID NO: 10922
  Description of Artificial Sequence: Synthetic polypeptide
  VH of XENP019136

SEQ ID NO: 15294 - protein, 107 aa, Artificial Sequence
  Description of Artificial Sequence: Synthetic polypeptide
  VL of XENP019136
SIVMTQSPATLSVSPGERATLSCRASQSVGNDVAWYQQKPGQSPRLLINYASHRYTSVPDRFTGSGYGTEFTLTISSLQSEDFAVYFCQQDWSSPRTFGGGTKVEIK

SEQ ID NO: 15295 - protein, 5 aa, Artificial Sequence
  Description of Artificial Sequence: Synthetic peptide
  XENP019136 vhCDR1
NYWMN

SEQ ID NO: 15296 - protein, 19 aa, Artificial Sequence
  Description of Artificial Sequence: Synthetic peptide
  XENP019136 vhCDR2
EIRLKSNNYATHYAEPVKG

SEQ ID NO: 15297 - protein, 11 aa, Artificial Sequence
  Description of Artificial Sequence: Synthetic peptide
  XENP019136 vhCDR3
YYGNYGGYFDV

SEQ ID NO: 15298 - protein, 11 aa, Artificial Sequence
  Description of Artificial Sequence: Synthetic peptide
  XENP019136 vlCDR1
RASQSVGNDVA

SEQ ID NO: 15299 - protein, 7 aa, Artificial Sequence
  Description of Artificial Sequence: Synthetic peptide
  XENP019136 vlCDR2
YASHRYT

SEQ ID NO: 15300 - protein, 9 aa, Artificial Sequence
  Description of Artificial Sequence: Synthetic peptide
  XENP019136 vlCDR3
QQDWSSPRT

SEQ ID NO: 15301 - protein, 249 aa, Artificial Sequence
  Description of Artificial Sequence: Synthetic polypeptide
  XENP019137 1G6_H1_L1.176_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVGNDVAWYQQKPGQSPRLLINYASWRYTSVPDRFTGSGYGTEFTLTISSLQSEDFAVYFCQQDYSSPRTFGGGTKVEIK

SEQ ID NO: 15302 - protein, 122 aa, Artificial Sequence; identical to SEQ ID NO: 10922
  Description of Artificial Sequence: Synthetic polypeptide
  VH of XENP019137

SEQ ID NO: 15303 - protein, 107 aa, Artificial Sequence
  Description of Artificial Sequence: Synthetic polypeptide
  VL of XENP019137
SIVMTQSPATLSVSPGERATLSCRASQSVGNDVAWYQQKPGQSPRLLINYASWRYTSVPDRFTGSGYGTEFTLTISSLQSEDFAVYFCQQDYSSPRTFGGGTKVEIK

SEQ ID NO: 15304 - protein, 5 aa, Artificial Sequence
  Description of Artificial Sequence: Synthetic peptide
  XENP019137 vhCDR1
NYWMN

SEQ ID NO: 15305 - protein, 19 aa, Artificial Sequence
  Description of Artificial Sequence: Synthetic peptide
  XENP019137 vhCDR2
EIRLKSNNYATHYAEPVKG

SEQ ID NO: 15306 - protein, 11 aa, Artificial Sequence
  Description of Artificial Sequence: Synthetic peptide
  XENP019137 vhCDR3
YYGNYGGYFDV

SEQ ID NO: 15307 - protein, 11 aa, Artificial Sequence
  Description of Artificial Sequence: Synthetic peptide
  XENP019137 vlCDR1
RASQSVGNDVA

SEQ ID NO: 15308 - protein, 7 aa, Artificial Sequence
  Description of Artificial Sequence: Synthetic peptide
  XENP019137 vlCDR2
YASWRYT

SEQ ID NO: 15309 - protein, 9 aa, Artificial Sequence
  Description of Artificial Sequence: Synthetic peptide
  XENP019137 vlCDR3
QQDYSSPRT

SEQ ID NO: 15310 - protein, 249 aa, Artificial Sequence
  Description of Artificial Sequence: Synthetic polypeptide
  XENP019138 1G6_H1_L1.177_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVGNDVAWYQQKPGQSPRLLINYASHRYTSVPDRFTGSGYGTEFTLTISSLQSEDFAVYFCQQDFSSPRTFGGGTKVEIK

SEQ ID NO: 15311 - protein, 122 aa, Artificial Sequence; identical to SEQ ID NO: 10922
  Description of Artificial Sequence: Synthetic polypeptide
  VH of XENP019138

SEQ ID NO: 15312 - protein, 107 aa, Artificial Sequence
  Description of Artificial Sequence: Synthetic polypeptide
  VL of XENP019138
SIVMTQSPATLSVSPGERATLSCRASQSVGNDVAWYQQKPGQSPRLLINYASHRYTSVPDRFTGSGYGTEFTLTISSLQSEDFAVYFCQQDFSSPRTFGGGTKVEIK

SEQ ID NO: 15313 - protein, 5 aa, Artificial Sequence
  Description of Artificial Sequence: Synthetic peptide
  XENP019138 vhCDR1
NYWMN

SEQ ID NO: 15314 - protein, 19 aa, Artificial Sequence
  Description of Artificial Sequence: Synthetic peptide
  XENP019138 vhCDR2
EIRLKSNNYATHYAEPVKG

SEQ ID NO: 15315 - protein, 11 aa, Artificial Sequence
  Description of Artificial Sequence: Synthetic peptide
  XENP019138 vhCDR3
YYGNYGGYFDV

SEQ ID NO: 15316 - protein, 11 aa, Artificial Sequence
  Description of Artificial Sequence: Synthetic peptide
  XENP019138 vlCDR1
RASQSVGNDVA

SEQ ID NO: 15317 - protein, 7 aa, Artificial Sequence
  Description of Artificial Sequence: Synthetic peptide
  XENP019138 vlCDR2
YASHRYT

SEQ ID NO: 15318 - protein, 9 aa, Artificial Sequence
  Description of Artificial Sequence: Synthetic peptide
  XENP019138 vlCDR3
QQDFSSPRT

SEQ ID NO: 15319 - protein, 249 aa, Artificial Sequence
  Description of Artificial Sequence: Synthetic polypeptide
  XENP019139 1G6_H1_L1.178_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVGNDVAWYQQKPGQSPRLLINYASHRYTSVPDRFTGSGYGTEFTLTISSLQSEDFAVYFCQQDGSSPRTFGGGTKVEIK

SEQ ID NO: 15320 - protein, 122 aa, Artificial Sequence; identical to SEQ ID NO: 10922
  Description of Artificial Sequence: Synthetic polypeptide
  VH of XENP019139

SEQ ID NO: 15321 - protein, 107 aa, Artificial Sequence
  Description of Artificial Sequence: Synthetic polypeptide
  VL of XENP019139
SIVMTQSPATLSVSPGERATLSCRASQSVGNDVAWYQQKPGQSPRLLINYASHRYTSVPDRFTGSGYGTEFTLTISSLQSEDFAVYFCQQDGSSPRTFGGGTKVEIK

SEQ ID NO: 15322 - protein, 5 aa, Artificial Sequence
  Description of Artificial Sequence: Synthetic peptide
  XENP019139 vhCDR1
NYWMN

SEQ ID NO: 15323 - protein, 19 aa, Artificial Sequence
  Description of Artificial Sequence: Synthetic peptide
  XENP019139 vhCDR2
EIRLKSNNYATHYAEPVKG

SEQ ID NO: 15324 - protein, 11 aa, Artificial Sequence
  Description of Artificial Sequence: Synthetic peptide
  XENP019139 vhCDR3
YYGNYGGYFDV

SEQ ID NO: 15325 - protein, 11 aa, Artificial Sequence
  Description of Artificial Sequence: Synthetic peptide
  XENP019139 vlCDR1
RASQSVGNDVA

SEQ ID NO: 15326 - protein, 7 aa, Artificial Sequence
  Description of Artificial Sequence: Synthetic peptide
  XENP019139 vlCDR2
YASHRYT

SEQ ID NO: 15327 - protein, 9 aa, Artificial Sequence
  Description of Artificial Sequence: Synthetic peptide
  XENP019139 vlCDR3
QQDGSSPRT

SEQ ID NO: 15328 - protein, 249 aa, Artificial Sequence
  Description of Artificial Sequence: Synthetic polypeptide
  XENP019140 1G6_H1_L1.179_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASWRYTSVPDRFTGSGYGTEFTLTISSLQSEDFAVYFCQQDFSSPRTFGGGTKVEIK

SEQ ID NO: 15329 - protein, 122 aa, Artificial Sequence; identical to SEQ ID NO: 10922
  Description of Artificial Sequence: Synthetic polypeptide
  VH of XENP019140

SEQ ID NO: 15330 - protein, 107 aa, Artificial Sequence
  Description of Artificial Sequence: Synthetic polypeptide
  VL of XENP019140
SIVMTQSPATLSVSPGERATLSCRASQSVSNDVAWYQQKPGQSPRLLINYASWRYTSVPDRFTGSGYGTEFTLTISSLQSEDFAVYFCQQDFSSPRTFGGGTKVEIK

SEQ ID NO: 15331 - protein, 5 aa, Artificial Sequence
  Description of Artificial Sequence: Synthetic peptide
  XENP019140 vhCDR1
NYWMN

SEQ ID NO: 15332 - protein, 19 aa, Artificial Sequence
  Description of Artificial Sequence: Synthetic peptide
  XENP019140 vhCDR2
EIRLKSNNYATHYAEPVKG

SEQ ID NO: 15333 - protein, 11 aa, Artificial Sequence
  Description of Artificial Sequence: Synthetic peptide
  XENP019140 vhCDR3
YYGNYGGYFDV

SEQ ID NO: 15334 - protein, 11 aa, Artificial Sequence
  Description of Artificial Sequence: Synthetic peptide
  XENP019140 vlCDR1
RASQSVSNDVA

SEQ ID NO: 15335 - protein, 7 aa, Artificial Sequence
  Description of Artificial Sequence: Synthetic peptide
  XENP019140 vlCDR2
YASWRYT

SEQ ID NO: 15336 - protein, 9 aa, Artificial Sequence
  Description of Artificial Sequence: Synthetic peptide
  XENP019140 vlCDR3
QQDFSSPRT

SEQ ID NO: 15337 - protein, 249 aa, Artificial Sequence
  Description of Artificial Sequence: Synthetic polypeptide
  XENP019141 1G6_H1_L1.180_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASWRYTSVPDRFTGSGYGTEFTLTISSLQSEDFAVYFCQQDWSSPRTFGGGTKVEIK

SEQ ID NO: 15338 - protein, 122 aa, Artificial Sequence; identical to SEQ ID NO: 10922
  Description of Artificial Sequence: Synthetic polypeptide
  VH of XENP019141

SEQ ID NO: 15339 - protein, 107 aa, Artificial Sequence
  Description of Artificial Sequence: Synthetic polypeptide
  VL of XENP019141
SIVMTQSPATLSVSPGERATLSCRASQSVSNDVAWYQQKPGQSPRLLINYASWRYTSVPDRFTGSGYGTEFTLTISSLQSEDFAVYFCQQDWSSPRTFGGGTKVEIK

SEQ ID NO: 15340 - protein, 5 aa, Artificial Sequence
  Description of Artificial Sequence: Synthetic peptide
  XENP019141 vhCDR1
NYWMN

SEQ ID NO: 15341 - protein, 19 aa, Artificial Sequence
  Description of Artificial Sequence: Synthetic peptide
  XENP019141 vhCDR2
EIRLKSNNYATHYAEPVKG

SEQ ID NO: 15342 - protein, 11 aa, Artificial Sequence
  Description of Artificial Sequence: Synthetic peptide
  XENP019141 vhCDR3
YYGNYGGYFDV

SEQ ID NO: 15343 - protein, 11 aa, Artificial Sequence
  Description of Artificial Sequence: Synthetic peptide
  XENP019141 vlCDR1
RASQSVSNDVA

SEQ ID NO: 15344 - protein, 7 aa, Artificial Sequence
  Description of Artificial Sequence: Synthetic peptide
  XENP019141 vlCDR2
YASWRYT

SEQ ID NO: 15345 - protein, 9 aa, Artificial Sequence
  Description of Artificial Sequence: Synthetic peptide
  XENP019141 vlCDR3
QQDWSSPRT

SEQ ID NO: 15346 - protein, 249 aa, Artificial Sequence
  Description of Artificial Sequence: Synthetic polypeptide
  XENP019142 1G6_H1_L1.181_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASWRYTSVPDRFTGSGYGTEFTLTISSLQSEDFAVYFCQQDGSSPRTFGGGTKVEIK

SEQ ID NO: 15347 - protein, 122 aa, Artificial Sequence; identical to SEQ ID NO: 10922
  Description of Artificial Sequence: Synthetic polypeptide
  VH of XENP019142

SEQ ID NO: 15348 - protein, 107 aa, Artificial Sequence
  Description of Artificial Sequence: Synthetic polypeptide
  VL of XENP019142
SIVMTQSPATLSVSPGERATLSCRASQSVSNDVAWYQQKPGQSPRLLINYASWRYTSVPDRFTGSGYGTEFTLTISSLQSEDFAVYFCQQDGSSPRTFGGGTKVEIK

SEQ ID NO: 15349 - protein, 5 aa, Artificial Sequence
  Description of Artificial Sequence: Synthetic peptide
  XENP019142 vhCDR1
NYWMN

SEQ ID NO: 15350 - protein, 19 aa, Artificial Sequence
  Description of Artificial Sequence: Synthetic peptide
  XENP019142 vhCDR2
EIRLKSNNYATHYAEPVKG

SEQ ID NO: 15351 - protein, 11 aa, Artificial Sequence
  Description of Artificial Sequence: Synthetic peptide
  XENP019142 vhCDR3
YYGNYGGYFDV

SEQ ID NO: 15352 - protein, 11 aa, Artificial Sequence
  Description of Artificial Sequence: Synthetic peptide
  XENP019142 vlCDR1
RASQSVSNDVA

SEQ ID NO: 15353 - protein, 7 aa, Artificial Sequence
  Description of Artificial Sequence: Synthetic peptide
  XENP019142 vlCDR2
YASWRYT

SEQ ID NO: 15354 - protein, 9 aa, Artificial Sequence
  Description of Artificial Sequence: Synthetic peptide
  XENP019142 vlCDR3
QQDGSSPRT

SEQ ID NO: 15355 - protein, 249 aa, Artificial Sequence
  Description of Artificial Sequence: Synthetic polypeptide
  XENP019143 1G6_H1_L1.182_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVGNDVAWYQQKPGQSPRLLINYASWRYTSVPDRFTGSGYGTEFTLTISSLQSEDFAVYFCQQDWSSPRTFGGGTKVEIK

SEQ ID NO: 15356 - protein, 122 aa, Artificial Sequence; identical to SEQ ID NO: 10922
  Description of Artificial Sequence: Synthetic polypeptide
  VH of XENP019143

SEQ ID NO: 15357 - protein, 107 aa, Artificial Sequence
  Description of Artificial Sequence: Synthetic polypeptide
  VL of XENP019143
SIVMTQSPATLSVSPGERATLSCRASQSVGNDVAWYQQKPGQSPRLLINYASWRYTSVPDRFTGSGYGTEFTLTISSLQSEDFAVYFCQQDWSSPRTFGGGTKVEIK

SEQ ID NO: 15358 - protein, 5 aa, Artificial Sequence
  Description of Artificial Sequence: Synthetic peptide
  XENP019143 vhCDR1
NYWMN

SEQ ID NO: 15359 - protein, 19 aa, Artificial Sequence
  Description of Artificial Sequence: Synthetic peptide
  XENP019143 vhCDR2
EIRLKSNNYATHYAEPVKG

SEQ ID NO: 15360 - protein, 11 aa, Artificial Sequence
  Description of Artificial Sequence: Synthetic peptide
  XENP019143 vhCDR3
YYGNYGGYFDV

SEQ ID NO: 15361 - protein, 11 aa, Artificial Sequence
  Description of Artificial Sequence: Synthetic peptide
  XENP019143 vlCDR1
RASQSVGNDVA

SEQ ID NO: 15362 - protein, 7 aa, Artificial Sequence
  Description of Artificial Sequence: Synthetic peptide
  XENP019143 vlCDR2
YASWRYT

SEQ ID NO: 15363 - protein, 9 aa, Artificial Sequence
  Description of Artificial Sequence: Synthetic peptide
  XENP019143 vlCDR3
QQDWSSPRT

SEQ ID NO: 15364 - protein, 249 aa, Artificial Sequence
  Description of Artificial Sequence: Synthetic polypeptide
  XENP019144 1G6_H1_L1.183_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVGNDVAWYQQKPGQSPRLLINYASWRYTSVPDRFTGSGYGTEFTLTISSLQSEDFAVYFCQQDFSSPRTFGGGTKVEIK

SEQ ID NO: 15365 - protein, 122 aa, Artificial Sequence; identical to SEQ ID NO: 10922
  Description of Artificial Sequence: Synthetic polypeptide
  VH of XENP019144

SEQ ID NO: 15366 - protein, 107 aa, Artificial Sequence
  Description of Artificial Sequence: Synthetic polypeptide
  VL of XENP019144
SIVMTQSPATLSVSPGERATLSCRASQSVGNDVAWYQQKPGQSPRLLINYASWRYTSVPDRFTGSGYGTEFTLTISSLQSEDFAVYFCQQDFSSPRTFGGGTKVEIK

SEQ ID NO: 15367 - protein, 5 aa, Artificial Sequence
  Description of Artificial Sequence: Synthetic peptide
  XENP019144 vhCDR1
NYWMN

SEQ ID NO: 15368 - protein, 19 aa, Artificial Sequence
  Description of Artificial Sequence: Synthetic peptide
  XENP019144 vhCDR2
EIRLKSNNYATHYAEPVKG

SEQ ID NO: 15369 - protein, 11 aa, Artificial Sequence
  Description of Artificial Sequence: Synthetic peptide
  XENP019144 vhCDR3
YYGNYGGYFDV

SEQ ID NO: 15370 - protein, 11 aa, Artificial Sequence
  Description of Artificial Sequence: Synthetic peptide
  XENP019144 vlCDR1
RASQSVGNDVA

SEQ ID NO: 15371 - protein, 7 aa, Artificial Sequence
  Description of Artificial Sequence: Synthetic peptide
  XENP019144 vlCDR2
YASWRYT

SEQ ID NO: 15372 - protein, 9 aa, Artificial Sequence
  Description of Artificial Sequence: Synthetic peptide
  XENP019144 vlCDR3
QQDFSSPRT

SEQ ID NO: 15373 - protein, 249 aa, Artificial Sequence
  Description of Artificial Sequence: Synthetic polypeptide
  XENP019145 1G6_H1_L1.184_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVGNDVAWYQQKPGQSPRLLINYASWRYTSVPDRFTGSGYGTEFTLTISSLQSEDFAVYFCQQDGSSPRTFGGGTKVEIK

SEQ ID NO: 15374 - protein, 122 aa, Artificial Sequence; identical to SEQ ID NO: 10922
  Description of Artificial Sequence: Synthetic polypeptide
  VH of XENP019145

SEQ ID NO: 15375 - protein, 107 aa, Artificial Sequence
  Description of Artificial Sequence: Synthetic polypeptide
  VL of XENP019145
SIVMTQSPATLSVSPGERATLSCRASQSVGNDVAWYQQKPGQSPRLLINYASWRYTSVPDRFTGSGYGTEFTLTISSLQSEDFAVYFCQQDGSSPRTFGGGTKVEIK

SEQ ID NO: 15376 - protein, 5 aa, Artificial Sequence
  Description of Artificial Sequence: Synthetic peptide
  XENP019145 vhCDR1
NYWMN

SEQ ID NO: 15377 - protein, 19 aa, Artificial Sequence
  Description of Artificial Sequence: Synthetic peptide
  XENP019145 vhCDR2
EIRLKSNNYATHYAEPVKG

SEQ ID NO: 15378 - protein, 11 aa, Artificial Sequence
  Description of Artificial Sequence: Synthetic peptide
  XENP019145 vhCDR3
YYGNYGGYFDV

SEQ ID NO: 15379 - protein, 11 aa, Artificial Sequence
  Description of Artificial Sequence: Synthetic peptide
  XENP019145 vlCDR1
RASQSVGNDVA

SEQ ID NO: 15380 - protein, 7 aa, Artificial Sequence
  Description of Artificial Sequence: Synthetic peptide
  XENP019145 vlCDR2
YASWRYT

SEQ ID NO: 15381 - protein, 9 aa, Artificial Sequence
  Description of Artificial Sequence: Synthetic peptide
  XENP019145 vlCDR3
QQDGSSPRT

SEQ ID NO: 15382 - protein, 249 aa, Artificial Sequence
  Description of Artificial Sequence: Synthetic polypeptide
  XENP019146 1G6_H1_L1.185_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSEIVMTQSPATLSVSPGERATLSCRASQSVSNDLAWYQQKPGQSPRLLINYASHRYTGVPARFSGSGYGTEFTLTISSLQSEDFAVYYCQQDYSSPRTFGGGTKVEIK

SEQ ID NO: 15383 - protein, 122 aa, Artificial Sequence; identical to SEQ ID NO: 10922
  Description of Artificial Sequence: Synthetic polypeptide
  VH of XENP019146

SEQ ID NO: 15384 - protein, 107 aa, Artificial Sequence
  Description of Artificial Sequence: Synthetic polypeptide
  VL of XENP019146
EIVMTQSPATLSVSPGERATLSCRASQSVSNDLAWYQQKPGQSPRLLINYASHRYTGVPARFSGSGYGTEFTLTISSLQSEDFAVYYCQQDYSSPRTFGGGTKVEIK

SEQ ID NO: 15385 - protein, 5 aa, Artificial Sequence
  Description of Artificial Sequence: Synthetic peptide
  XENP019146 vhCDR1
NYWMN

SEQ ID NO: 15386 - protein, 19 aa, Artificial Sequence
  Description of Artificial Sequence: Synthetic peptide
  XENP019146 vhCDR2
EIRLKSNNYATHYAEPVKG

SEQ ID NO: 15387 - protein, 11 aa, Artificial Sequence
  Description of Artificial Sequence: Synthetic peptide
  XENP019146 vhCDR3
YYGNYGGYFDV

SEQ ID NO: 15388 - protein, 11 aa, Artificial Sequence
  Description of Artificial Sequence: Synthetic peptide
  XENP019146 vlCDR1
RASQSVSNDLA

SEQ ID NO: 15389 - protein, 7 aa, Artificial Sequence
  Description of Artificial Sequence: Synthetic peptide
  XENP019146 vlCDR2
YASHRYT

SEQ ID NO: 15390 - protein, 9 aa, Artificial Sequence
  Description of Artificial Sequence: Synthetic peptide
  XENP019146 vlCDR3
QQDYSSPRT

SEQ ID NO: 15391 - protein, 249 aa, Artificial Sequence
  Description of Artificial Sequence: Synthetic polypeptide
  XENP019147 1G6_H1_L1.186_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSDIVMTQSPATLSVSPGERATLSCRASQSVSNDLAWYQQKPGQSPRLLINYASHRYTGVPDRFSGSGYGTEFTLTISSLQSEDFAVYYCQQDYSSPRTFGGGTKVEIK

SEQ ID NO: 15392 - protein, 122 aa, Artificial Sequence; identical to SEQ ID NO: 10922
  Description of Artificial Sequence: Synthetic polypeptide
  VH of XENP019147

SEQ ID NO: 15393 - protein, 107 aa, Artificial Sequence
  Description of Artificial Sequence: Synthetic polypeptide
  VL of XENP019147
DIVMTQSPATLSVSPGERATLSCRASQSVSNDLAWYQQKPGQSPRLLINYASHRYTGVPDRFSGSGYGTEFTLTISSLQSEDFAVYYCQQDYSSPRTFGGGTKVEIK

SEQ ID NO: 15394 - protein, 5 aa, Artificial Sequence
  Description of Artificial Sequence: Synthetic peptide
  XENP019147 vhCDR1
NYWMN

SEQ ID NO: 15395 - protein, 19 aa, Artificial Sequence
  Description of Artificial Sequence: Synthetic peptide
  XENP019147 vhCDR2
EIRLKSNNYATHYAEPVKG

SEQ ID NO: 15396 - protein, 11 aa, Artificial Sequence
  Description of Artificial Sequence: Synthetic peptide
  XENP019147 vhCDR3
YYGNYGGYFDV

SEQ ID NO: 15397 - protein, 11 aa, Artificial Sequence
  Description of Artificial Sequence: Synthetic peptide
  XENP019147 vlCDR1
RASQSVSNDLA

SEQ ID NO: 15398 - protein, 7 aa, Artificial Sequence
  Description of Artificial Sequence: Synthetic peptide
  XENP019147 vlCDR2
YASHRYT

SEQ ID NO: 15399 - protein, 9 aa, Artificial Sequence
  Description of Artificial Sequence: Synthetic peptide
  XENP019147 vlCDR3
QQDYSSPRT

SEQ ID NO: 15400 - protein, 249 aa, Artificial Sequence
  Description of Artificial Sequence: Synthetic polypeptide
  XENP019148 1G6_H1.257_L1.152_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGRGTLVTVSSGKPGSGKPGSGKPGSGKPGSSIVMTQSPATLSVSPGERATLSCRASQSVSNDVAWYQQKPGESPRLLINYASHRYTGVPDRFTGSGYGTEFTLTISSLQSEDFAVYFCQQDYSSPRTFGGGTKVEIK

SEQ ID NO: 15401 - protein, 122 aa, Artificial Sequence; identical to SEQ ID NO: 14843
  Description of Artificial Sequence: Synthetic polypeptide
  VH of XENP019148

SEQ ID NO: 15402 - protein, 107 aa, Artificial Sequence; identical to SEQ ID NO: 15087
  Description of Artificial Sequence: Synthetic polypeptide
  VL of XENP019148

SEQ ID NO: 15403 - protein, 5 aa, Artificial Sequence
  Description of Artificial Sequence: Synthetic peptide
  XENP019148 vhCDR1
NYWMN

SEQ ID NO: 15404 - protein, 19 aa, Artificial Sequence
  Description of Artificial Sequence: Synthetic peptide
  XENP019148 vhCDR2
EIRLKSNNYATHYAEPVKG

SEQ ID NO: 15405 - protein, 11 aa, Artificial Sequence
  Description of Artificial Sequence: Synthetic peptide
  XENP019148 vhCDR3
YYGNYGGYFDV

SEQ ID NO: 15406 - protein, 11 aa, Artificial Sequence
  Description of Artificial Sequence: Synthetic peptide
  XENP019148 vlCDR1
RASQSVSNDVA

SEQ ID NO: 15407 - protein, 7 aa, Artificial Sequence
  Description of Artificial Sequence: Synthetic peptide
  XENP019148 vlCDR2
YASHRYT

SEQ ID NO: 15408 - protein, 9 aa, Artificial Sequence
  Description of Artificial Sequence: Synthetic peptide
  XENP019148 vlCDR3
QQDYSSPRT

SEQ ID NO: 15409 - protein, 249 aa, Artificial Sequence
  Description of Artificial Sequence: Synthetic polypeptide
  XENP019149 1G6_H1.257_L1.151_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGRGTLVTVSSGKPGSGKPGSGKPGSGKPGSSIVMTQSPATLSVSPGERATLSCRASQSVSNDVAWYQQKPEQSPRLLINYASHRYTGVPDRFTGSGYGTEFTLTISSLQSEDFAVYFCQQDYSSPRTFGGGTKVEIK

SEQ ID NO: 15410 - protein, 122 aa, Artificial Sequence; identical to SEQ ID NO: 14843
  Description of Artificial Sequence: Synthetic polypeptide
  VH of XENP019149

SEQ ID NO: 15411 - protein, 107 aa, Artificial Sequence; identical to SEQ ID NO: 15078
  Description of Artificial Sequence: Synthetic polypeptide
  VL of XENP019149

SEQ ID NO: 15412 - protein, 5 aa, Artificial Sequence
  Description of Artificial Sequence: Synthetic peptide
  XENP019149 vhCDR1
NYWMN

SEQ ID NO: 15413 - protein, 19 aa, Artificial Sequence
  Description of Artificial Sequence: Synthetic peptide
  XENP019149 vhCDR2
EIRLKSNNYATHYAEPVKG

SEQ ID NO: 15414 - protein, 11 aa, Artificial Sequence
  Description of Artificial Sequence: Synthetic peptide
  XENP019149 vhCDR3
YYGNYGGYFDV

SEQ ID NO: 15415 - protein, 11 aa, Artificial Sequence
  Description of Artificial Sequence: Synthetic peptide
  XENP019149 vlCDR1
RASQSVSNDVA

SEQ ID NO: 15416 - protein, 7 aa, Artificial Sequence
  Description of Artificial Sequence: Synthetic peptide
  XENP019149 vlCDR2
YASHRYT

SEQ ID NO: 15417 - protein, 9 aa, Artificial Sequence
  Description of Artificial Sequence: Synthetic peptide
  XENP019149 vlCDR3
QQDYSSPRT

SEQ ID NO: 15418 - protein, 249 aa, Artificial Sequence
  Description of Artificial Sequence: Synthetic polypeptide
  XENP019150 1G6_H1.139_L1.134_scFv(GKPGS)4
EVQLVESGGGLVKPGGSLRLSCAASGFTFSNYWMNWVRQAPGKGLEWVGEIRLKSNNYATDYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYKSPRTFGGGTKVEIK

SEQ ID NO: 15419 - protein, 122 aa, Artificial Sequence; identical to SEQ ID NO: 12278
  Description of Artificial Sequence: Synthetic polypeptide
  VH of XENP019150

SEQ ID NO: 15420 - protein, 107 aa, Artificial Sequence; identical to SEQ ID NO: 14376
  Description of Artificial Sequence: Synthetic polypeptide
  VL of XENP019150

SEQ ID NO: 15421 - protein, 5 aa, Artificial Sequence
  Description of Artificial Sequence: Synthetic peptide
  XENP019150 vhCDR1
NYWMN

SEQ ID NO: 15422 - protein, 19 aa, Artificial Sequence
  Description of Artificial Sequence: Synthetic peptide
  XENP019150 vhCDR2
EIRLKSNNYATDYAEPVKG

SEQ ID NO: 15423 - protein, 11 aa, Artificial Sequence
  Description of Artificial Sequence: Synthetic peptide
  XENP019150 vhCDR3
YYGNYGGYFDV

SEQ ID NO: 15424 - protein, 11 aa, Artificial Sequence
  Description of Artificial Sequence: Synthetic peptide
  XENP019150 vlCDR1
RASQSVSNDVA

SEQ ID NO: 15425 - protein, 7 aa, Artificial Sequence
  Description of Artificial Sequence: Synthetic peptide
  XENP019150 vlCDR2
YASHRYT

SEQ ID NO: 15426 - protein, 9 aa, Artificial Sequence
  Description of Artificial Sequence: Synthetic peptide
  XENP019150 vlCDR3
QQDYKSPRT

SEQ ID NO: 15427 - protein, 249 aa, Artificial Sequence
  Description of Artificial Sequence: Synthetic polypeptide
  XENP019151 1G6_H1.48_L1.187_scFv(GKPGS)4
EVQLVESGGGLVKPGGSLRLSCAASGFTFSNYWMNWVRKAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGESPRLLINYASHRYTGVPDRFTGSGYGTEFTLTISSLQSEDFAVYFCQQDYSSPRTFGGGTKVEIK

SEQ ID NO: 15428 - protein, 122 aa, Artificial Sequence; identical to SEQ ID NO: 11462
  Description of Artificial Sequence: Synthetic polypeptide
  VH of XENP019151

SEQ ID NO: 15429 - protein, 107 aa, Artificial Sequence; identical to SEQ ID NO: 15087
  Description of Artificial Sequence: Synthetic polypeptide
  VL of XENP019151

SEQ ID NO: 15430 - protein, 11 aa, Artificial Sequence
  Description of Artificial Sequence: Synthetic peptide
  XENP019151 vlCDR1
RASQSVSNDVA

SEQ ID NO: 15431 - protein, 7 aa, Artificial Sequence
  Description of Artificial Sequence: Synthetic peptide
  XENP019151 vlCDR2
YASHRYT

SEQ ID NO: 15432 - protein, 9 aa, Artificial Sequence
  Description of Artificial Sequence: Synthetic peptide
  XENP019151 vlCDR3
QQDYSSPRT

SEQ ID NO: 15433 - protein, 249 aa, Artificial Sequence
  Description of Artificial Sequence: Synthetic polypeptide
  XENP019152 1G6_H1.48_L1.151_scFv(GKPGS)4
EVQLVESGGGLVKPGGSLRLSCAASGFTFSNYWMNWVRKAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPEQSPRLLINYASHRYTGVPDRFTGSGYGTEFTLTISSLQSEDFAVYFCQQDYSSPRTFGGGTKVEIK

SEQ ID NO: 15434 - protein, 122 aa, Artificial Sequence; identical to SEQ ID NO: 11462
  Description of Artificial Sequence: Synthetic polypeptide
  VH of XENP019152

SEQ ID NO: 15435 - protein, 107 aa, Artificial Sequence; identical to SEQ ID NO: 15078
  Description of Artificial Sequence: Synthetic polypeptide
  VL of XENP019152

SEQ ID NO: 15436 - protein, 11 aa, Artificial Sequence
  Description of Artificial Sequence: Synthetic peptide
  XENP019152 vlCDR1
RASQSVSNDVA

SEQ ID NO: 15437 - protein, 7 aa, Artificial Sequence
  Description of Artificial Sequence: Synthetic peptide
  XENP019152 vlCDR2
YASHRYT

SEQ ID NO: 15438 - protein, 9 aa, Artificial Sequence
  Description of Artificial Sequence: Synthetic peptide
  XENP019152 vlCDR3
QQDYSSPRT

SEQ ID NO: 15439 - protein, 249 aa, Artificial Sequence
  Description of Artificial Sequence: Synthetic polypeptide
  XENP019153 1G6_H1.43_L1.159_scFv(GKPGS)4
EVQLVESGGGLVKPGGSLRLSCAASGFTFSNYWMDWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCKQDYSSPRTFGGGTKVEIK

SEQ ID NO: 15440 - protein, 122 aa, Artificial Sequence; identical to SEQ ID NO: 11417
  Description of Artificial Sequence: Synthetic polypeptide
  VH of XENP019153

SEQ ID NO: 15441 - protein, 107 aa, Artificial Sequence; identical to SEQ ID NO: 15150
  Description of Artificial Sequence: Synthetic polypeptide
  VL of XENP019153

SEQ ID NO: 15442 - protein, 5 aa, Artificial Sequence
  Description of Artificial Sequence: Synthetic peptide
  XENP019153 vhCDR1
NYWMD

SEQ ID NO: 15443 - protein, 19 aa, Artificial Sequence
  Description of Artificial Sequence: Synthetic peptide
  XENP019153 vhCDR2
EIRLKSNNYATHYAEPVKG

SEQ ID NO: 15444 - protein, 11 aa, Artificial Sequence
  Description of Artificial Sequence: Synthetic peptide
  XENP019153 vhCDR3
YYGNYGGYFDV

SEQ ID NO: 15445 - protein, 11 aa, Artificial Sequence
  Description of Artificial Sequence: Synthetic peptide
  XENP019153 vlCDR1
RASQSVSNDVA

SEQ ID NO: 15446 - protein, 7 aa, Artificial Sequence
  Description of Artificial Sequence: Synthetic peptide
  XENP019153 vlCDR2
YASHRYT

SEQ ID NO: 15447 - protein, 9 aa, Artificial Sequence
  Description of Artificial Sequence: Synthetic peptide
  XENP019153 vlCDR3
KQDYSSPRT

SEQ ID NO: 15448 - protein, 249 aa, Artificial Sequence
  Description of Artificial Sequence: Synthetic polypeptide
  XENP019154 1G6_H1.90_L1.119_scFv(GKPGS)4
EVQLVESGGGLVKPGGSLRLSCAASGFTFSNYWMNWVRQAPGKGLEWVGEIRLYSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDWSSPRTFGGGTKVEIK

SEQ ID NO: 15449 - protein, 122 aa, Artificial Sequence; identical to SEQ ID NO: 11837
  Description of Artificial Sequence: Synthetic polypeptide
  VH of XENP019154

SEQ ID NO: 15450 - protein, 107 aa, Artificial Sequence; identical to SEQ ID NO: 14241
  Description of Artificial Sequence: Synthetic polypeptide
  VL of XENP019154

SEQ ID NO: 15451 - protein, 5 aa, Artificial Sequence
  Description of Artificial Sequence: Synthetic peptide
  XENP019154 vhCDR1
NYWMN

SEQ ID NO: 15452 - protein, 19 aa, Artificial Sequence
  Description of Artificial Sequence: Synthetic peptide
  XENP019154 vhCDR2
EIRLYSNNYATHYAEPVKG

SEQ ID NO: 15453 - protein, 11 aa, Artificial Sequence
  Description of Artificial Sequence: Synthetic peptide
  XENP019154 vhCDR3
YYGNYGGYFDV

SEQ ID NO: 15454 - protein, 11 aa, Artificial Sequence
  Description of Artificial Sequence: Synthetic peptide
  XENP019154 vlCDR1
RASQSVSNDVA

SEQ ID NO: 15455 - protein, 7 aa, Artificial Sequence
  Description of Artificial Sequence: Synthetic peptide
  XENP019154 vlCDR2
YASHRYT

SEQ ID NO: 15456 - protein, 9 aa, Artificial Sequence
  Description of Artificial Sequence: Synthetic peptide
  XENP019154 vlCDR3
QQDWSSPRT

SEQ ID NO: 15457 - protein, 249 aa, Artificial Sequence
  Description of Artificial Sequence: Synthetic polypeptide
  XENP019155 1G6_H1.90_L1.23_scFv(GKPGS)4
EVQLVESGGGLVKPGGSLRLSCAASGFTFSNYWMNWVRQAPGKGLEWVGEIRLYSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVGNDVAWYQQKPGQSPRLLINYASHRYTGVPDRFTGSGYGTEFTLTISSLQSEDFAVYFCQQDYSSPRTFGGGTKVEIK

SEQ ID NO: 15458 - protein, 122 aa, Artificial Sequence; identical to SEQ ID NO: 11837
  Description of Artificial Sequence: Synthetic polypeptide
  VH of XENP019155

SEQ ID NO: 15459 - protein, 107 aa, Artificial Sequence; identical to SEQ ID NO: 13377
  Description of Artificial Sequence: Synthetic polypeptide
  VL of XENP019155

SEQ ID NO: 15460 - protein, 5 aa, Artificial Sequence
  Description of Artificial Sequence: Synthetic peptide
  XENP019155 vhCDR1
NYWMN

SEQ ID NO: 15461 - protein, 19 aa, Artificial Sequence
  Description of Artificial Sequence: Synthetic peptide
  XENP019155 vhCDR2
EIRLYSNNYATHYAEPVKG

SEQ ID NO: 15462 - protein, 11 aa, Artificial Sequence
  Description of Artificial Sequence: Synthetic peptide
  XENP019155 vhCDR3
YYGNYGGYFDV

SEQ ID NO: 15463 - protein, 11 aa, Artificial Sequence
  Description of Artificial Sequence: Synthetic peptide
  XENP019155 vlCDR1
RASQSVGNDVA

SEQ ID NO: 15464 - protein, 7 aa, Artificial Sequence
  Description of Artificial Sequence: Synthetic peptide
  XENP019155 vlCDR2
YASHRYT

SEQ ID NO: 15465 - protein, 9 aa, Artificial Sequence
  Description of Artificial Sequence: Synthetic peptide
  XENP019155 vlCDR3
QQDYSSPRT

SEQ ID NO: 15466 - protein, 249 aa, Artificial Sequence
  Description of Artificial Sequence: Synthetic polypeptide
  XENP019156 1G6_H1.90_L1.67_scFv(GKPGS)4
EVQLVESGGGLVKPGGSLRLSCAASGFTFSNYWMNWVRQAPGKGLEWVGEIRLYSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASWRYTGVPDRFTGSGYGTEFTLTISSLQSEDFAVYFCQQDYSSPRTFGGGTKVEIK

SEQ ID NO: 15467 - protein, 122 aa, Artificial Sequence; identical to SEQ ID NO: 11837
  Description of Artificial Sequence: Synthetic polypeptide
  VH of XENP019156

SEQ ID NO: 15468 - protein, 107 aa, Artificial Sequence; identical to SEQ ID NO: 13773
  Description of Artificial Sequence: Synthetic polypeptide
  VL of XENP019156

SEQ ID NO: 15469 - protein, 5 aa, Artificial Sequence
  Description of Artificial Sequence: Synthetic peptide
  XENP019156 vhCDR1
NYWMN

SEQ ID NO: 15470 - protein, 19 aa, Artificial Sequence
  Description of Artificial Sequence: Synthetic peptide
  XENP019156 vhCDR2
EIRLYSNNYATHYAEPVKG

SEQ ID NO: 15471 - protein, 11 aa, Artificial Sequence
  Description of Artificial Sequence: Synthetic peptide
  XENP019156 vhCDR3
YYGNYGGYFDV

SEQ ID NO: 15472 - protein, 11 aa, Artificial Sequence
  Description of Artificial Sequence: Synthetic peptide
  XENP019156 vlCDR1
RASQSVSNDVA

SEQ ID NO: 15473 - protein, 7 aa, Artificial Sequence
  Description of Artificial Sequence: Synthetic peptide
  XENP019156 vlCDR2
YASWRYT

SEQ ID NO: 15474 - protein, 9 aa, Artificial Sequence
  Description of Artificial Sequence: Synthetic peptide
  XENP019156 vlCDR3
QQDYSSPRT

SEQ ID NO: 15475 - protein, 249 aa, Artificial Sequence
  Description of Artificial Sequence: Synthetic polypeptide
  XENP019157 1G6_H1.90_L1.94_scFv(GKPGS)4
EVQLVESGGGLVKPGGSLRLSCAASGFTFSNYWMNWVRQAPGKGLEWVGEIRLYSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTSVPDRFTGSGYGTEFTLTISSLQSEDFAVYFCQQDYSSPRTFGGGTKVEIK

SEQ ID NO: 15476 - protein, 122 aa, Artificial Sequence; identical to SEQ ID NO: 11837
  Description of Artificial Sequence: Synthetic polypeptide
  VH of XENP019157

SEQ ID NO: 15477 - protein, 107 aa, Artificial Sequence; identical to SEQ ID NO: 14016
  Description of Artificial Sequence: Synthetic polypeptide
  VL of XENP019157

SEQ ID NO: 15478 - protein, 5 aa, Artificial Sequence
  Description of Artificial Sequence: Synthetic peptide
  XENP019157 vhCDR1
NYWMN

SEQ ID NO: 15479 - protein, 19 aa, Artificial Sequence
  Description of Artificial Sequence: Synthetic peptide
  XENP019157 vhCDR2
EIRLYSNNYATHYAEPVKG

SEQ ID NO: 15480 - protein, 11 aa, Artificial Sequence
  Description of Artificial Sequence: Synthetic peptide
  XENP019157 vhCDR3
YYGNYGGYFDV

SEQ ID NO: 15481 - protein, 11 aa, Artificial Sequence
  Description of Artificial Sequence: Synthetic peptide
  XENP019157 vlCDR1
RASQSVSNDVA

SEQ ID NO: 15482 - protein, 7 aa, Artificial Sequence
  Description of Artificial Sequence: Synthetic peptide
  XENP019157 vlCDR2
YASHRYT

SEQ ID NO: 15483 - protein, 9 aa, Artificial Sequence
  Description of Artificial Sequence: Synthetic peptide
  XENP019157 vlCDR3
QQDYSSPRT

SEQ ID NO: 15484 - protein, 249 aa, Artificial Sequence
  Description of Artificial Sequence: Synthetic polypeptide
  XENP019158 1G6_H1.90_L1.116_scFv(GKPGS)4
EVQLVESGGGLVKPGGSLRLSCAASGFTFSNYWMNWVRQAPGKGLEWVGEIRLYSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDFSSPRTFGGGTKVEIK

SEQ ID NO: 15485 - protein, 122 aa, Artificial Sequence; identical to SEQ ID NO: 11837
  Description of Artificial Sequence: Synthetic polypeptide
  VH of XENP019158

SEQ ID NO: 15486 - protein, 107 aa, Artificial Sequence; identical to SEQ ID NO: 14214
  Description of Artificial Sequence: Synthetic polypeptide
  VL of XENP019158

SEQ ID NO: 15487 - protein, 5 aa, Artificial Sequence
  Description of Artificial Sequence: Synthetic peptide
  XENP019158 vhCDR1
NYWMN

SEQ ID NO: 15488 - protein, 19 aa, Artificial Sequence
  Description of Artificial Sequence: Synthetic peptide
  XENP019158 vhCDR2
EIRLYSNNYATHYAEPVKG

SEQ ID NO: 15489 - protein, 11 aa, Artificial Sequence
  Description of Artificial Sequence: Synthetic peptide
  XENP019158 vhCDR3
YYGNYGGYFDV

SEQ ID NO: 15490 - protein, 11 aa, Artificial Sequence
  Description of Artificial Sequence: Synthetic peptide
  XENP019158 vlCDR1
RASQSVSNDVA

SEQ ID NO: 15491 - protein, 7 aa, Artificial Sequence
  Description of Artificial Sequence: Synthetic peptide
  XENP019158 vlCDR2
YASHRYT

SEQ ID NO: 15492 - protein, 9 aa, Artificial Sequence
  Description of Artificial Sequence: Synthetic peptide
  XENP019158 vlCDR3
QQDFSSPRT

SEQ ID NO: 15493 - protein, 249 aa, Artificial Sequence; identical to SEQ ID NO: 15448
  Description of Artificial Sequence: Synthetic polypeptide
  XENP019159 1G6_H1.155_L1.119_scFv(GKPGS)4

SEQ ID NO: 15494 - protein, 122 aa, Artificial Sequence; identical to SEQ ID NO: 11837
  Description of Artificial Sequence: Synthetic polypeptide
  VH of XENP019159

SEQ ID NO: 15495 - protein, 107 aa, Artificial Sequence; identical to SEQ ID NO: 14241
  Description of Artificial Sequence: Synthetic polypeptide
  VL of XENP019159

SEQ ID NO: 15496 - protein, 5 aa, Artificial Sequence
  Description of Artificial Sequence: Synthetic peptide
  XENP019159 vhCDR1
NYWMN

SEQ ID NO: 15497 - protein, 19 aa, Artificial Sequence
  Description of Artificial Sequence: Synthetic peptide
  XENP019159 vhCDR2
EIRLYSNNYATHYAEPVKG

SEQ ID NO: 15498 - protein, 11 aa, Artificial Sequence
  Description of Artificial Sequence: Synthetic peptide
  XENP019159 vhCDR3
YYGNYGGYFDV

SEQ ID NO: 15499 - protein, 11 aa, Artificial Sequence
  Description of Artificial Sequence: Synthetic peptide
  XENP019159 vlCDR1
RASQSVSNDVA

SEQ ID NO: 15500 - protein, 7 aa, Artificial Sequence
  Description of Artificial Sequence: Synthetic peptide
  XENP019159 vlCDR2
YASHRYT

SEQ ID NO: 15501 - protein, 9 aa, Artificial Sequence
  Description of Artificial Sequence: Synthetic peptide
  XENP019159 vlCDR3
QQDWSSPRT

SEQ ID NO: 15502 - protein, 249 aa, Artificial Sequence
  Description of Artificial Sequence: Synthetic polypeptide
  XENP019182 1G6_H1_L1.190_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVGNDVAWYQQKPGQSPRLLINYASHRYTGVPDRFTGSGYGTEFTLTISSLQSEDFAVYFCQQDFSSPRTFGGGTKVEIK

SEQ ID NO: 15503 - protein, 122 aa, Artificial Sequence; identical to SEQ ID NO: 10922
  Description of Artificial Sequence: Synthetic polypeptide
  VH of XENP019182

SEQ ID NO: 15504 - protein, 107 aa, Artificial Sequence
  Description of Artificial Sequence: Synthetic polypeptide
  VL of XENP019182
SIVMTQSPATLSVSPGERATLSCRASQSVGNDVAWYQQKPGQSPRLLINYASHRYTGVPDRFTGSGYGTEFTLTISSLQSEDFAVYFCQQDFSSPRTFGGGTKVEIK

SEQ ID NO: 15505 - protein, 5 aa, Artificial Sequence
  Description of Artificial Sequence: Synthetic peptide
  XENP019182 vhCDR1
NYWMN

SEQ ID NO: 15506 - protein, 19 aa, Artificial Sequence
  Description of Artificial Sequence: Synthetic peptide
  XENP019182 vhCDR2
EIRLKSNNYATHYAEPVKG

SEQ ID NO: 15507 - protein, 11 aa, Artificial Sequence
  Description of Artificial Sequence: Synthetic peptide
  XENP019182 vhCDR3
YYGNYGGYFDV

SEQ ID NO: 15508 - protein, 11 aa, Artificial Sequence
  Description of Artificial Sequence: Synthetic peptide
  XENP019182 vlCDR1
RASQSVGNDVA

SEQ ID NO: 15509 - protein, 7 aa, Artificial Sequence
  Description of Artificial Sequence: Synthetic peptide
  XENP019182 vlCDR2
YASHRYT

SEQ ID NO: 15510 - protein, 9 aa, Artificial Sequence
  Description of Artificial Sequence: Synthetic peptide
  XENP019182 vlCDR3
QQDFSSPRT

SEQ ID NO: 15511 - protein, 249 aa, Artificial Sequence
  Description of Artificial Sequence: Synthetic polypeptide
  XENP019183 1G6_H1_L1.191_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVGNDVAWYQQKPGQSPRLLINYASHRYTGVPDRFTGSGYGTEFTLTISSLQSEDFAVYFCQQDWSSPRTFGGGTKVEIK

SEQ ID NO: 15512 - protein, 122 aa, Artificial Sequence; identical to SEQ ID NO: 10922
  Description of Artificial Sequence: Synthetic polypeptide
  VH of XENP019183

SEQ ID NO: 15513 - protein, 107 aa, Artificial Sequence
  Description of Artificial Sequence: Synthetic polypeptide
  VL of XENP019183
SIVMTQSPATLSVSPGERATLSCRASQSVGNDVAWYQQKPGQSPRLLINYASHRYTGVPDRFTGSGYGTEFTLTISSLQSEDFAVYFCQQDWSSPRTFGGGTKVEIK

SEQ ID NO: 15514 - protein, 5 aa, Artificial Sequence
  Description of Artificial Sequence: Synthetic peptide
  XENP019183 vhCDR1
NYWMN

SEQ ID NO: 15515 - protein, 19 aa, Artificial Sequence
  Description of Artificial Sequence: Synthetic peptide
  XENP019183 vhCDR2
EIRLKSNNYATHYAEPVKG

SEQ ID NO: 15516 - protein, 11 aa, Artificial Sequence
  Description of Artificial Sequence: Synthetic peptide
  XENP019183 vhCDR3
YYGNYGGYFDV

SEQ ID NO: 15517 - protein, 11 aa, Artificial Sequence
  Description of Artificial Sequence: Synthetic peptide
  XENP019183 vlCDR1
RASQSVGNDVA

SEQ ID NO: 15518 - protein, 7 aa, Artificial Sequence
  Description of Artificial Sequence: Synthetic peptide
  XENP019183 vlCDR2
YASHRYT

SEQ ID NO: 15519 - protein, 9 aa, Artificial Sequence
  Description of Artificial Sequence: Synthetic peptide
  XENP019183 vlCDR3
QQDWSSPRT

SEQ ID NO: 15520 - protein, 480 aa, Artificial Sequence
  Description of Artificial Sequence: Synthetic polypeptide
  XENP019202 1G6_H1.278_L1_scFv(GKPGS)4
EVQLVESGGGLVKPGGSLRLSCVASGFTFSNYWMNWVRQAPGKGLEWVAEIRLYSNNYATHYAESVKGRFTISRDDSKSTLYLQMNNLKTEDTGVYYCTRYYGNYGGYFDVWGQGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIKEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 15521 - protein, 122 aa, Artificial Sequence
  Description of Artificial Sequence: Synthetic polypeptide
  VH of XENP019202
EVQLVESGGGLVKPGGSLRLSCVASGFTFSNYWMNWVRQAPGKGLEWVAEIRLYSNNYATHYAESVKGRFTISRDDSKSTLYLQMNNLKTEDTGVYYCTRYYGNYGGYFDVWGQGTLVTVSS

SEQ ID NO: 15522 - protein, 338 aa, Artificial Sequence
  Description of Artificial Sequence: Synthetic polypeptide
  VL of XENP019202
SIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIKEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 15523 - protein, 5 aa, Artificial Sequence
  Description of Artificial Sequence: Synthetic peptide
  XENP019202 vhCDR1
NYWMN

SEQ ID NO: 15524 - protein, 19 aa, Artificial Sequence
  Description of Artificial Sequence: Synthetic peptide
  XENP019202 vhCDR2
EIRLYSNNYATHYAESVKG

SEQ ID NO: 15525 - protein, 11 aa, Artificial Sequence
  Description of Artificial Sequence: Synthetic peptide
  XENP019202 vhCDR3
YYGNYGGYFDV

SEQ ID NO: 15526 - protein, 11 aa, Artificial Sequence
  Description of Artificial Sequence: Synthetic peptide
  XENP019202 vlCDR1
RASQSVSNDVA

SEQ ID NO: 15527 - protein, 7 aa, Artificial Sequence
  Description of Artificial Sequence: Synthetic peptide
  XENP019202 vlCDR2
YASHRYT

SEQ ID NO: 15528 - protein, 9 aa, Artificial Sequence
  Description of Artificial Sequence: Synthetic peptide
  XENP019202 vlCDR3
QQDYSSPRT

SEQ ID NO: 15529 - protein, 249 aa, Artificial Sequence
  Description of Artificial Sequence: Synthetic polypeptide
  XENP019203 1G6_H1_L1.188_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSEIVMTQSPATLSVSPGERVTLTCRASQSVGNDVAWYQQKPGQSPRLLINYASHRYTGVPDRFTGSGYGTEFTLTISSVQSEDFAVYFCQQDFSSPRTFGGGTKVEIK

SEQ ID NO: 15530 - protein, 122 aa, Artificial Sequence; identical to SEQ ID NO: 10922
  Description of Artificial Sequence: Synthetic polypeptide
  VH of XENP019203

SEQ ID NO: 15531 - protein, 107 aa, Artificial Sequence
  Description of Artificial Sequence: Synthetic polypeptide
  VL of XENP019203
EIVMTQSPATLSVSPGERVTLTCRASQSVGNDVAWYQQKPGQSPRLLINYASHRYTGVPDRFTGSGYGTEFTLTISSVQSEDFAVYFCQQDFSSPRTFGGGTKVEIK

SEQ ID NO: 15532 - protein, 5 aa, Artificial Sequence
  Description of Artificial Sequence: Synthetic peptide
  XENP019203 vhCDR1
NYWMN

SEQ ID NO: 15533 - protein, 19 aa, Artificial Sequence
  Description of Artificial Sequence: Synthetic peptide
  XENP019203 vhCDR2
EIRLKSNNYATHYAEPVKG

SEQ ID NO: 15534 - protein, 11 aa, Artificial Sequence
  Description of Artificial Sequence: Synthetic peptide
  XENP019203 vhCDR3
YYGNYGGYFDV

SEQ ID NO: 15535 - protein, 11 aa, Artificial Sequence
  Description of Artificial Sequence: Synthetic peptide
  XENP019203 vlCDR1
RASQSVGNDVA

SEQ ID NO: 15536 - protein, 7 aa, Artificial Sequence
  Description of Artificial Sequence: Synthetic peptide
  XENP019203 vlCDR2
YASHRYT

SEQ ID NO: 15537 - protein, 9 aa, Artificial Sequence
  Description of Artificial Sequence: Synthetic peptide
  XENP019203 vlCDR3
QQDFSSPRT

SEQ ID NO: 15538 - protein, 249 aa, Artificial Sequence
  Description of Artificial Sequence: Synthetic polypeptide
  XENP019204 1G6_H1_L1.189_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSEIVLTQSPATLSVSPGERVTLTCRASQSVGNDVAWYQQKPGQAPRLLINYASHRYTGVPDRFTGSGYGTEFTLTISSVQSEDFAVYYCQQDFSSPRTFGGGTKVEIK

SEQ ID NO: 15539 - protein, 122 aa, Artificial Sequence; identical to SEQ ID NO: 10922
  Description of Artificial Sequence: Synthetic polypeptide
  VH of XENP019204

SEQ ID NO: 15540 - protein, 107 aa, Artificial Sequence
  Description of Artificial Sequence: Synthetic polypeptide
  VL of XENP019204
EIVLTQSPATLSVSPGERVTLTCRASQSVGNDVAWYQQKPGQAPRLLINYASHRYTGVPDRFTGSGYGTEFTLTISSVQSEDFAVYYCQQDFSSPRTFGGGTKVEIK

SEQ ID NO: 15541 - protein, 5 aa, Artificial Sequence
  Description of Artificial Sequence: Synthetic peptide
  XENP019204 vhCDR1
NYWMN

SEQ ID NO: 15542 - protein, 19 aa, Artificial Sequence
  Description of Artificial Sequence: Synthetic peptide
  XENP019204 vhCDR2
EIRLKSNNYATHYAEPVKG

SEQ ID NO: 15543 - protein, 11 aa, Artificial Sequence
  Description of Artificial Sequence: Synthetic peptide
  XENP019204 vhCDR3
YYGNYGGYFDV

SEQ ID NO: 15544 - protein, 11 aa, Artificial Sequence
  Description of Artificial Sequence: Synthetic peptide
  XENP019204 vlCDR1
RASQSVGNDVA

SEQ ID NO: 15545 - protein, 7 aa, Artificial Sequence
  Description of Artificial Sequence: Synthetic peptide
  XENP019204 vlCDR2
YASHRYT

SEQ ID NO: 15546 - protein, 9 aa, Artificial Sequence
  Description of Artificial Sequence: Synthetic peptide
  XENP019204 vlCDR3
QQDFSSPRT

SEQ ID NO: 15547 - protein, 249 aa, Artificial Sequence
  Description of Artificial Sequence: Synthetic polypeptide
  XENP019205 1G6_H1.278_L1.188_scFv(GKPGS)4
EVQLVESGGGLVKPGGSLRLSCVASGFTFSNYWMNWVRQAPGKGLEWVAEIRLYSNNYATHYAESVKGRFTISRDDSKSTLYLQMNNLKTEDTGVYYCTRYYGNYGGYFDVWGQGTLVTVSSGKPGSGKPGSGKPGSGKPGSEIVMTQSPATLSVSPGERVTLTCRASQSVGNDVAWYQQKPGQSPRLLINYASHRYTGVPDRFTGSGYGTEFTLTISSVQSEDFAVYFCQQDFSSPRTFGGGTKVEIK

SEQ ID NO: 15548 - protein, 122 aa, Artificial Sequence; identical to SEQ ID NO: 15521
  Description of Artificial Sequence: Synthetic polypeptide
  VH of XENP019205

SEQ ID NO: 15549 - protein, 107 aa, Artificial Sequence; identical to SEQ ID NO: 15531
  Description of Artificial Sequence: Synthetic polypeptide
  VL of XENP019205

SEQ ID NO: 15550 - protein, 5 aa, Artificial Sequence
  Description of Artificial Sequence: Synthetic peptide
  XENP019205 vhCDR1
NYWMN

SEQ ID NO: 15551 - protein, 19 aa, Artificial Sequence
  Description of Artificial Sequence: Synthetic peptide
  XENP019205 vhCDR2
EIRLYSNNYATHYAESVKG

SEQ ID NO: 15552 - protein, 11 aa, Artificial Sequence
  Description of Artificial Sequence: Synthetic peptide
  XENP019205 vhCDR3
YYGNYGGYFDV

SEQ ID NO: 15553 - protein, 11 aa, Artificial Sequence
  Description of Artificial Sequence: Synthetic peptide
  XENP019205 vlCDR1
RASQSVGNDVA

SEQ ID NO: 15554 - protein, 7 aa, Artificial Sequence
  Description of Artificial Sequence: Synthetic peptide
  XENP019205 vlCDR2
YASHRYT

SEQ ID NO: 15555 - protein, 9 aa, Artificial Sequence
  Description of Artificial Sequence: Synthetic peptide
  XENP019205 vlCDR3
QQDFSSPRT

SEQ ID NO: 15556 - protein, 249 aa, Artificial Sequence
  Description of Artificial Sequence: Synthetic polypeptide
  XENP019206 1G6_H1.278_L1.189_scFv(GKPGS)4
EVQLVESGGGLVKPGGSLRLSCVASGFTFSNYWMNWVRQAPGKGLEWVAEIRLYSNNYATHYAESVKGRFTISRDDSKSTLYLQMNNLKTEDTGVYYCTRYYGNYGGYFDVWGQGTLVTVSSGKPGSGKPGSGKPGSGKPGSEIVLTQSPATLSVSPGERVTLTCRASQSVGNDVAWYQQKPGQAPRLLINYASHRYTGVPDRFTGSGYGTEFTLTISSVQSEDFAVYYCQQDFSSPRTFGGGTKVEIK

SEQ ID NO: 15557 - protein, 122 aa, Artificial Sequence; identical to SEQ ID NO: 15521
  Description of Artificial Sequence: Synthetic polypeptide
  VH of XENP019206

SEQ ID NO: 15558 - protein, 107 aa, Artificial Sequence; identical to SEQ ID NO: 15540
  Description of Artificial Sequence: Synthetic polypeptide
  VL of XENP019206

SEQ ID NO: 15559 - protein, 5 aa, Artificial Sequence
  Description of Artificial Sequence: Synthetic peptide
  XENP019206 vhCDR1
NYWMN

SEQ ID NO: 15560 - protein, 19 aa, Artificial Sequence
  Description of Artificial Sequence: Synthetic peptide
  XENP019206 vhCDR2
EIRLYSNNYATHYAESVKG

SEQ ID NO: 15561 - protein, 11 aa, Artificial Sequence
  Description of Artificial Sequence: Synthetic peptide
  XENP019206 vhCDR3
YYGNYGGYFDV

SEQ ID NO: 15562 - protein, 11 aa, Artificial Sequence
  Description of Artificial Sequence: Synthetic peptide
  XENP019206 vlCDR1
RASQSVGNDVA

SEQ ID NO: 15563 - protein, 7 aa, Artificial Sequence
  Description of Artificial Sequence: Synthetic peptide
  XENP019206 vlCDR2
YASHRYT

SEQ ID NO: 15564 - protein, 9 aa, Artificial Sequence
  Description of Artificial Sequence: Synthetic peptide
  XENP019206 vlCDR3
QQDFSSPRT

SEQ ID NO: 15565 - protein, 249 aa, Artificial Sequence
  Description of Artificial Sequence: Synthetic polypeptide
  XENP019207 1G6_L1.188_H1.278_scFv(GKPGS)4
EIVMTQSPATLSVSPGERVTLTCRASQSVGNDVAWYQQKPGQSPRLLINYASHRYTGVPDRFTGSGYGTEFTLTISSVQSEDFAVYFCQQDFSSPRTFGGGTKVEIKGKPGSGKPGSGKPGSGKPGSEVQLVESGGGLVKPGGSLRLSCVASGFTFSNYWMNWVRQAPGKGLEWVAEIRLYSNNYATHYAESVKGRFTISRDDSKSTLYLQMNNLKTEDTGVYYCTRYYGNYGGYFDVWGQGTLVTVSS

SEQ ID NO: 15566 - protein, 107 aa, Artificial Sequence; identical to SEQ ID NO: 15531
  Description of Artificial Sequence: Synthetic polypeptide
  VH of XENP019207

SEQ ID NO: 15567 - protein, 122 aa, Artificial Sequence; identical to SEQ ID NO: 15521
  Description of Artificial Sequence: Synthetic polypeptide
  VL of XENP019207

SEQ ID NO: 15568 - protein, 11 aa, Artificial Sequence
  Description of Artificial Sequence: Synthetic peptide
  XENP019207 vhCDR1
RASQSVGNDVA

SEQ ID NO: 15569 - protein, 7 aa, Artificial Sequence
  Description of Artificial Sequence: Synthetic peptide
  XENP019207 vhCDR2
YASHRYT

SEQ ID NO: 15570 - protein, 9 aa, Artificial Sequence
  Description of Artificial Sequence: Synthetic peptide
  XENP019207 vhCDR3
QQDFSSPRT

SEQ ID NO: 15571 - protein, 5 aa, Artificial Sequence
  Description of Artificial Sequence: Synthetic peptide
  XENP019207 vlCDR1
NYWMN

SEQ ID NO: 15572 - protein, 19 aa, Artificial Sequence
  Description of Artificial Sequence: Synthetic peptide
  XENP019207 vlCDR2
EIRLYSNNYATHYAESVKG

SEQ ID NO: 15573 - protein, 11 aa, Artificial Sequence
  Description of Artificial Sequence: Synthetic peptide
  XENP019207 vlCDR3
YYGNYGGYFDV

SEQ ID NO: 15574 - protein, 249 aa, Artificial Sequence
  Description of Artificial Sequence: Synthetic polypeptide
  XENP019208 1G6_L1.189_H1.278_scFv(GKPGS)4
EIVLTQSPATLSVSPGERVTLTCRASQSVGNDVAWYQQKPGQAPRLLINYASHRYTGVPDRFTGSGYGTEFTLTISSVQSEDFAVYYCQQDFSSPRTFGGGTKVEIKGKPGSGKPGSGKPGSGKPGSEVQLVESGGGLVKPGGSLRLSCVASGFTFSNYWMNWVRQAPGKGLEWVAEIRLYSNNYATHYAESVKGRFTISRDDSKSTLYLQMNNLKTEDTGVYYCTRYYGNYGGYFDVWGQGTLVTVSS

SEQ ID NO: 15575 - protein, 107 aa, Artificial Sequence; identical to SEQ ID NO: 15540
  Description of Artificial Sequence: Synthetic polypeptide
  VH of XENP019208

SEQ ID NO: 15576 - protein, 122 aa, Artificial Sequence; identical to SEQ ID NO: 15521
  Description of Artificial Sequence: Synthetic polypeptide
  VL of XENP019208

SEQ ID NO: 15577 - protein, 11 aa, Artificial Sequence
  Description of Artificial Sequence: Synthetic peptide
  XENP019208 vhCDR1
RASQSVGNDVA

SEQ ID NO: 15578 - protein, 7 aa, Artificial Sequence
  Description of Artificial Sequence: Synthetic peptide
  XENP019208 vhCDR2
YASHRYT

SEQ ID NO: 15579 - protein, 9 aa, Artificial Sequence
  Description of Artificial Sequence: Synthetic peptide
  XENP019208 vhCDR3
QQDFSSPRT

SEQ ID NO: 15580 - protein, 5 aa, Artificial Sequence
  Description of Artificial Sequence: Synthetic peptide
  XENP019208 vlCDR1
NYWMN

SEQ ID NO: 15581 - protein, 19 aa, Artificial Sequence
  Description of Artificial Sequence: Synthetic peptide
  XENP019208 vlCDR2
EIRLYSNNYATHYAESVKG

SEQ ID NO: 15582 - protein, 11 aa, Artificial Sequence
  Description of Artificial Sequence: Synthetic peptide
  XENP019208 vlCDR3
YYGNYGGYFDV

SEQ ID NO: 15583 - protein, 249 aa, Artificial Sequence
  Description of Artificial Sequence: Synthetic polypeptide
  XENP019618 1G6_H1.279_L1.189_scFv(GKPGS)4
EVQLVESGGGLVKPGGSLRLSCVASGFTFSNYWMNWVRQAPGKGLEWVAEIRLYSNNYATHYAESVKGRFTISRDDSKSTLYLQMNNLKTEDTGVYYCTRYYGNYGGYFDVWGRGTLVTVSSGKPGSGKPGSGKPGSGKPGSEIVLTQSPATLSVSPGERVTLTCRASQSVGNDVAWYQQKPGQAPRLLINYASHRYTGVPDRFTGSGYGTEFTLTISSVQSEDFAVYYCQQDFSSPRTFGGGTKVEIK

SEQ ID NO: 15584 - protein, 122 aa, Artificial Sequence; identical to SEQ ID NO: 2872
  Description of Artificial Sequence: Synthetic polypeptide
  VH of XENP019618

SEQ ID NO: 15585 - protein, 107 aa, Artificial Sequence; identical to SEQ ID NO: 15540
  Description of Artificial Sequence: Synthetic polypeptide
  VL of XENP019618

SEQ ID NO: 15586 - protein, 5 aa, Artificial Sequence
  Description of Artificial Sequence: Synthetic peptide
  XENP019618 vhCDR1
NYWMN

SEQ ID NO: 15587 - protein, 19 aa, Artificial Sequence
  Description of Artificial Sequence: Synthetic peptide
  XENP019618 vhCDR2
EIRLYSNNYATHYAESVKG

SEQ ID NO: 15588 - protein, 11 aa, Artificial Sequence
  Description of Artificial Sequence: Synthetic peptide
  XENP019618 vhCDR3
YYGNYGGYFDV

SEQ ID NO: 15589 - protein, 11 aa, Artificial Sequence
  Description of Artificial Sequence: Synthetic peptide
  XENP019618 vlCDR1
RASQSVGNDVA

SEQ ID NO: 15590 - protein, 7 aa, Artificial Sequence
  Description of Artificial Sequence: Synthetic peptide
  XENP019618 vlCDR2
YASHRYT

SEQ ID NO: 15591 - protein, 9 aa, Artificial Sequence
  Description of Artificial Sequence: Synthetic peptide
  XENP019618 vlCDR3
QQDFSSPRT

SEQ ID NO: 15592 - protein, 249 aa, Artificial Sequence
  Description of Artificial Sequence: Synthetic polypeptide
  XENP019619 1G6_H1.280_L1.189_scFv(GKPGS)4
EVQLVESGGGLVKPGGSLRLTCVASGFTFSNYWMNWVRQAPGKGLEWVAEIRLYSNNYATHYAESVKGRFTISRDDSKSTLYLQMNNLKTEDTGVYYCTRYYGNYGGYFDVWGRGTLVTVSSGKPGSGKPGSGKPGSGKPGSEIVLTQSPATLSVSPGERVTLTCRASQSVGNDVAWYQQKPGQAPRLLINYASHRYTGVPDRFTGSGYGTEFTLTISSVQSEDFAVYYCQQDFSSPRTFGGGTKVEIK

SEQ ID NO: 15593 - protein, 122 aa, Artificial Sequence
  Description of Artificial Sequence: Synthetic polypeptide
  VH of XENP019619
EVQLVESGGGLVKPGGSLRLTCVASGFTFSNYWMNWVRQAPGKGLEWVAEIRLYSNNYATHYAESVKGRFTISRDDSKSTLYLQMNNLKTEDTGVYYCTRYYGNYGGYFDVWGRGTLVTVSS

SEQ ID NO: 15594 - protein, 107 aa, Artificial Sequence; identical to SEQ ID NO: 15540
  Description of Artificial Sequence: Synthetic polypeptide
  VL of XENP019619

SEQ ID NO: 15595 - protein, 5 aa, Artificial Sequence
  Description of Artificial Sequence: Synthetic peptide
  XENP019619 vhCDR1
NYWMN

SEQ ID NO: 15596 - protein, 19 aa, Artificial Sequence
  Description of Artificial Sequence: Synthetic peptide
  XENP019619 vhCDR2
EIRLYSNNYATHYAESVKG

SEQ ID NO: 15597 - protein, 11 aa, Artificial Sequence
  Description of Artificial Sequence: Synthetic peptide
  XENP019619 vhCDR3
YYGNYGGYFDV

SEQ ID NO: 15598 - protein, 11 aa, Artificial Sequence
  Description of Artificial Sequence: Synthetic peptide
  XENP019619 vlCDR1
RASQSVGNDVA

SEQ ID NO: 15599 - protein, 7 aa, Artificial Sequence
  Description of Artificial Sequence: Synthetic peptide
  XENP019619 vlCDR2
YASHRYT

SEQ ID NO: 15600 - protein, 9 aa, Artificial Sequence
  Description of Artificial Sequence: Synthetic peptide
  XENP019619 vlCDR3
QQDFSSPRT

SEQ ID NO: 15601 - protein, 249 aa, Artificial Sequence
  Description of Artificial Sequence: Synthetic polypeptide
  XENP019620 1G6_H1.281_L1.189_scFv(GKPGS)4
EVQLVESGGGLVKPGGSLRLSCVASGFTFSNYWMNWVRQAPGKGLEWVAEIRLYSNNYATHYAESVKGRFTISRDDSKSMLYLQMNNLKTEDTGVYYCTRYYGNYGGYFDVWGRGTLVTVSSGKPGSGKPGSGKPGSGKPGSEIVLTQSPATLSVSPGERVTLTCRASQSVGNDVAWYQQKPGQAPRLLINYASHRYTGVPDRFTGSGYGTEFTLTISSVQSEDFAVYYCQQDFSSPRTFGGGTKVEIK

SEQ ID NO: 15602 - protein, 122 aa, Artificial Sequence
  Description of Artificial Sequence: Synthetic polypeptide
  VH of XENP019620
EVQLVESGGGLVKPGGSLRLSCVASGFTFSNYWMNWVRQAPGKGLEWVAEIRLYSNNYATHYAESVKGRFTISRDDSKSMLYLQMNNLKTEDTGVYYCTRYYGNYGGYFDVWGRGTLVTVSS

SEQ ID NO: 15603 - protein, 107 aa, Artificial Sequence; identical to SEQ ID NO: 15540
  Description of Artificial Sequence: Synthetic polypeptide
  VL of XENP019620

SEQ ID NO: 15604 - protein, 5 aa, Artificial Sequence
  Description of Artificial Sequence: Synthetic peptide
  XENP019620 vhCDR1
NYWMN

SEQ ID NO: 15605 - protein, 19 aa, Artificial Sequence
  Description of Artificial Sequence: Synthetic peptide
  XENP019620 vhCDR2
EIRLYSNNYATHYAESVKG

SEQ ID NO: 15606 - protein, 11 aa, Artificial Sequence
  Description of Artificial Sequence: Synthetic peptide
  XENP019620 vhCDR3
YYGNYGGYFDV

SEQ ID NO: 15607 - protein, 11 aa, Artificial Sequence
  Description of Artificial Sequence: Synthetic peptide
  XENP019620 vlCDR1
RASQSVGNDVA

SEQ ID NO: 15608 - protein, 7 aa, Artificial Sequence
  Description of Artificial Sequence: Synthetic peptide
  XENP019620 vlCDR2
YASHRYT

SEQ ID NO: 15609 - protein, 9 aa, Artificial Sequence
  Description of Artificial Sequence: Synthetic peptide
  XENP019620 vlCDR3
QQDFSSPRT

SEQ ID NO: 15610 - protein, 249 aa, Artificial Sequence
  Description of Artificial Sequence: Synthetic polypeptide
  XENP019621 1G6_H1.282_L1.189_scFv(GKPGS)4
EVQLVESGGGLVKPGGSLRLTCVASGFTFSNYWMNWVRQAPGKGLEWVAEIRLYSNNYATHYAESVKGRFTISRDDSKSMLYLQMNNLKTEDTGVYYCTRYYGNYGGYFDVWGRGTLVTVSSGKPGSGKPGSGKPGSGKPGSEIVLTQSPATLSVSPGERVTLTCRASQSVGNDVAWYQQKPGQAPRLLINYASHRYTGVPDRFTGSGYGTEFTLTISSVQSEDFAVYYCQQDFSSPRTFGGGTKVEIK

SEQ ID NO: 15611 - protein, 122 aa, Artificial Sequence
  Description of Artificial Sequence: Synthetic polypeptide
  VH of XENP019621
EVQLVESGGGLVKPGGSLRLTCVASGFTFSNYWMNWVRQAPGKGLEWVAEIRLYSNNYATHYAESVKGRFTISRDDSKSMLYLQMNNLKTEDTGVYYCTRYYGNYGGYFDVWGRGTLVTVSS

SEQ ID NO: 15612 - protein, 107 aa, Artificial Sequence; identical to SEQ ID NO: 15540
  Description of Artificial Sequence: Synthetic polypeptide
  VL of XENP019621

SEQ ID NO: 15613 - protein, 5 aa, Artificial Sequence
  Description of Artificial Sequence: Synthetic peptide
  XENP019621 vhCDR1
NYWMN

SEQ ID NO: 15614 - protein, 19 aa, Artificial Sequence
  Description of Artificial Sequence: Synthetic peptide
  XENP019621 vhCDR2
EIRLYSNNYATHYAESVKG

SEQ ID NO: 15615 - protein, 11 aa, Artificial Sequence
  Description of Artificial Sequence: Synthetic peptide
  XENP019621 vhCDR3
YYGNYGGYFDV

SEQ ID NO: 15616 - protein, 11 aa, Artificial Sequence
  Description of Artificial Sequence: Synthetic peptide
  XENP019621 vlCDR1
RASQSVGNDVA

SEQ ID NO: 15617 - protein, 7 aa, Artificial Sequence
  Description of Artificial Sequence: Synthetic peptide
  XENP019621 vlCDR2
YASHRYT

SEQ ID NO: 15618 - protein, 9 aa, Artificial Sequence
  Description of Artificial Sequence: Synthetic peptide
  XENP019621 vlCDR3
QQDFSSPRT

SEQ ID NO: 15619 - protein, 249 aa, Artificial Sequence
  Description of Artificial Sequence: Synthetic polypeptide
  XENP019622 1G6_H1.283_L1.189_scFv(GKPGS)4
EVQLVESGGGLVKPGGSLRLSCVASGFTFSNYWMNWVRQAPGKGLEWVCEIRLYSNNYATHYAESVKGRFTCSRDDSKSTLYLQMNNLKTEDTGVYYCTRYYGNYGGYFDVWGQGTLVTVSSGKPGSGKPGSGKPGSGKPGSEIVLTQSPATLSVSPGERVTLTCRASQSVGNDVAWYQQKPGQAPRLLINYASHRYTGVPDRFTGSGYGTEFTLTISSVQSEDFAVYYCQQDFSSPRTFGGGTKVEIK

SEQ ID NO: 15620 - protein, 122 aa, Artificial Sequence
  Description of Artificial Sequence: Synthetic polypeptide
  VH of XENP019622
EVQLVESGGGLVKPGGSLRLSCVASGFTFSNYWMNWVRQAPGKGLEWVCEIRLYSNNYATHYAESVKGRFTCSRDDSKSTLYLQMNNLKTEDTGVYYCTRYYGNYGGYFDVWGQGTLVTVSS

SEQ ID NO: 15621 - protein, 107 aa, Artificial Sequence; identical to SEQ ID NO: 15540
  Description of Artificial Sequence: Synthetic polypeptide
  VL of XENP019622

SEQ ID NO: 15622 - protein, 5 aa, Artificial Sequence
  Description of Artificial Sequence: Synthetic peptide
  XENP019622 vhCDR1
NYWMN

SEQ ID NO: 15623 - protein, 19 aa, Artificial Sequence
  Description of Artificial Sequence: Synthetic peptide
  XENP019622 vhCDR2
EIRLYSNNYATHYAESVKG

SEQ ID NO: 15624 - protein, 11 aa, Artificial Sequence
  Description of Artificial Sequence: Synthetic peptide
  XENP019622 vhCDR3
YYGNYGGYFDV

SEQ ID NO: 15625 - protein, 11 aa, Artificial Sequence
  Description of Artificial Sequence: Synthetic peptide
  XENP019622 vlCDR1
RASQSVGNDVA

SEQ ID NO: 15626 - protein, 7 aa, Artificial Sequence
  Description of Artificial Sequence: Synthetic peptide
  XENP019622 vlCDR2
YASHRYT

SEQ ID NO: 15627 - protein, 9 aa, Artificial Sequence
  Description of Artificial Sequence: Synthetic peptide
  XENP019622 vlCDR3
QQDFSSPRT

SEQ ID NO: 15628 - protein, 249 aa, Artificial Sequence
  Description of Artificial Sequence: Synthetic polypeptide
  XENP019623 1G6_H1.284_L1.189_scFv(GKPGS)4
EVQLVESGGGLVKPGGSLRLSCVASGFTFSNYWMNWVRQAPGKGLEWVCEIRLYSNNYATHYAESVKGRFTCSRDDSKSTLYLQMNNLKTEDTGVYYCTRYYGNYGGYFDVWGRGTLVTVSSGKPGSGKPGSGKPGSGKPGSEIVLTQSPATLSVSPGERVTLTCRASQSVGNDVAWYQQKPGQAPRLLINYASHRYTGVPDRFTGSGYGTEFTLTISSVQSEDFAVYYCQQDFSSPRTFGGGTKVEIK

SEQ ID NO: 15629 - protein, 122 aa, Artificial Sequence
  Description of Artificial Sequence: Synthetic polypeptide
  VH of XENP019623
EVQLVESGGGLVKPGGSLRLSCVASGFTFSNYWMNWVRQAPGKGLEWVCEIRLYSNNYATHYAESVKGRFTCSRDDSKSTLYLQMNNLKTEDTGVYYCTRYYGNYGGYFDVWGRGTLVTVSS

SEQ ID NO: 15630 - protein, 107 aa, Artificial Sequence; identical to SEQ ID NO: 15540
  Description of Artificial Sequence: Synthetic polypeptide
  VL of XENP019623

SEQ ID NO: 15631 - protein, 5 aa, Artificial Sequence
  Description of Artificial Sequence: Synthetic peptide
  XENP019623 vhCDR1
NYWMN

SEQ ID NO: 15632 - protein, 19 aa, Artificial Sequence
  Description of Artificial Sequence: Synthetic peptide
  XENP019623 vhCDR2
EIRLYSNNYATHYAESVKG

SEQ ID NO: 15633 - protein, 11 aa, Artificial Sequence
  Description of Artificial Sequence: Synthetic peptide
  XENP019623 vhCDR3
YYGNYGGYFDV

SEQ ID NO: 15634 - protein, 11 aa, Artificial Sequence
  Description of Artificial Sequence: Synthetic peptide
  XENP019623 vlCDR1
RASQSVGNDVA

SEQ ID NO: 15635 - protein, 7 aa, Artificial Sequence
  Description of Artificial Sequence: Synthetic peptide
  XENP019623 vlCDR2
YASHRYT

SEQ ID NO: 15636 - protein, 9 aa, Artificial Sequence
  Description of Artificial Sequence: Synthetic peptide
  XENP019623 vlCDR3
QQDFSSPRT

SEQ ID NO: 15637 - protein, 249 aa, Artificial Sequence
  Description of Artificial Sequence: Synthetic polypeptide
  XENP019624 1G6_H1.285_L1.189_scFv(GKPGS)4
EVQLVESGGGLVKPGGSLRLTCVASGFTFSNYWMNWVRQAPGKGLEWVCEIRLYSNNYATHYAESVKGRFTCSRDDSKSMLYLQMNNLKTEDTGVYYCTRYYGNYGGYFDVWGRGTLVTVSSGKPGSGKPGSGKPGSGKPGSEIVLTQSPATLSVSPGERVTLTCRASQSVGNDVAWYQQKPGQAPRLLINYASHRYTGVPDRFTGSGYGTEFTLTISSVQSEDFAVYYCQQDFSSPRTFGGGTKVEIK

SEQ ID NO: 15638 - protein, 122 aa, Artificial Sequence
  Description of Artificial Sequence: Synthetic polypeptide
  VH of XENP019624
EVQLVESGGGLVKPGGSLRLTCVASGFTFSNYWMNWVRQAPGKGLEWVCEIRLYSNNYATHYAESVKGRFTCSRDDSKSMLYLQMNNLKTEDTGVYYCTRYYGNYGGYFDVWGRGTLVTVSS

SEQ ID NO: 15639 - protein, 107 aa, Artificial Sequence; identical to SEQ ID NO: 15540
  Description of Artificial Sequence: Synthetic polypeptide
  VL of XENP019624

SEQ ID NO: 15640 - protein, 5 aa, Artificial Sequence
  Description of Artificial Sequence: Synthetic peptide
  XENP019624 vhCDR1
NYWMN

SEQ ID NO: 15641 - protein, 19 aa, Artificial Sequence
  Description of Artificial Sequence: Synthetic peptide
  XENP019624 vhCDR2
EIRLYSNNYATHYAESVKG

SEQ ID NO: 15642 - protein, 11 aa, Artificial Sequence
  Description of Artificial Sequence: Synthetic peptide
  XENP019624 vhCDR3
YYGNYGGYFDV

SEQ ID NO: 15643 - protein, 11 aa, Artificial Sequence
  Description of Artificial Sequence: Synthetic peptide
  XENP019624 vlCDR1
RASQSVGNDVA

SEQ ID NO: 15644 - protein, 7 aa, Artificial Sequence
  Description of Artificial Sequence: Synthetic peptide
  XENP019624 vlCDR2
YASHRYT

SEQ ID NO: 15645 - protein, 9 aa, Artificial Sequence
  Description of Artificial Sequence: Synthetic peptide
  XENP019624 vlCDR3
QQDFSSPRT

SEQ ID NO: 15646 - protein, 249 aa, Artificial Sequence
  Description of Artificial Sequence: Synthetic polypeptide
  XENP019625 1G6_H1.286_L1.189_scFv(GKPGS)4
EVQLVESGGGLVKPGGSLRLSCVASGFTFSNYWMNWVRQAPGKGLEWVAEIRLYSDNYATHYAESVKGRFTISRDDSKSTLYLQMNNLKTEDTGVYYCTRYYGNYGGYFDVWGQGTLVTVSSGKPGSGKPGSGKPGSGKPGSEIVLTQSPATLSVSPGERVTLTCRASQSVGNDVAWYQQKPGQAPRLLINYASHRYTGVPDRFTGSGYGTEFTLTISSVQSEDFAVYYCQQDFSSPRTFGGGTKVEIK

SEQ ID NO: 15647 - protein, 122 aa, Artificial Sequence
  Description of Artificial Sequence: Synthetic polypeptide
  VH of XENP019625
EVQLVESGGGLVKPGGSLRLSCVASGFTFSNYWMNWVRQAPGKGLEWVAEIRLYSDNYATHYAESVKGRFTISRDDSKSTLYLQMNNLKTEDTGVYYCTRYYGNYGGYFDVWGQGTLVTVSS

SEQ ID NO: 15648 - protein, 107 aa, Artificial Sequence; identical to SEQ ID NO: 15540
  Description of Artificial Sequence: Synthetic polypeptide
  VL of XENP019625

SEQ ID NO: 15649 - protein, 5 aa, Artificial Sequence
  Description of Artificial Sequence: Synthetic peptide
  XENP019625 vhCDR1
NYWMN

SEQ ID NO: 15650 - protein, 19 aa, Artificial Sequence
  Description of Artificial Sequence: Synthetic peptide
  XENP019625 vhCDR2
EIRLYSDNYATHYAESVKG

SEQ ID NO: 15651 - protein, 11 aa, Artificial Sequence
  Description of Artificial Sequence: Synthetic peptide
  XENP019625 vhCDR3
YYGNYGGYFDV

SEQ ID NO: 15652 - protein, 11 aa, Artificial Sequence
  Description of Artificial Sequence: Synthetic peptide
  XENP019625 vlCDR1
RASQSVGNDVA

SEQ ID NO: 15653 - protein, 7 aa, Artificial Sequence
  Description of Artificial Sequence: Synthetic peptide
  XENP019625 vlCDR2
YASHRYT

SEQ ID NO: 15654 - protein, 9 aa, Artificial Sequence
  Description of Artificial Sequence: Synthetic peptide
  XENP019625 vlCDR3
QQDFSSPRT

SEQ ID NO: 15655 - protein, 249 aa, Artificial Sequence
  Description of Artificial Sequence: Synthetic polypeptide
  XENP019626 1G6_H1.278_L1.192_scFv(GKPGS)4
EVQLVESGGGLVKPGGSLRLSCVASGFTFSNYWMNWVRQAPGKGLEWVAEIRLYSNNYATHYAESVKGRFTISRDDSKSTLYLQMNNLKTEDTGVYYCTRYYGNYGGYFDVWGQGTLVTVSSGKPGSGKPGSGKPGSGKPGSEIVLTQSPATLSASPGERVTLTCRASQSVGNDVAWYQQKPGQAPRLLINYASHRYTGVPDRFTGSGYGTEFTLTISSVQSEDFAVYYCQQDFSSPRTFGGGTKVEIK

SEQ ID NO: 15656 - protein, 122 aa, Artificial Sequence; identical to SEQ ID NO: 15521
  Description of Artificial Sequence: Synthetic polypeptide
  VH of XENP019626

SEQ ID NO: 15657 - protein, 107 aa, Artificial Sequence
  Description of Artificial Sequence: Synthetic polypeptide
  VL of XENP019626
EIVLTQSPATLSASPGERVTLTCRASQSVGNDVAWYQQKPGQAPRLLINYASHRYTGVPDRFTGSGYGTEFTLTISSVQSEDFAVYYCQQDFSSPRTFGGGTKVEIK

SEQ ID NO: 15658 - protein, 5 aa, Artificial Sequence
  Description of Artificial Sequence: Synthetic peptide
  XENP019626 vhCDR1
NYWMN

SEQ ID NO: 15659 - protein, 19 aa, Artificial Sequence
  Description of Artificial Sequence: Synthetic peptide
  XENP019626 vhCDR2
EIRLYSNNYATHYAESVKG

SEQ ID NO: 15660 - protein, 11 aa, Artificial Sequence
  Description of Artificial Sequence: Synthetic peptide
  XENP019626 vhCDR3
YYGNYGGYFDV

SEQ ID NO: 15661 - protein, 11 aa, Artificial Sequence
  Description of Artificial Sequence: Synthetic peptide
  XENP019626 vlCDR1
RASQSVGNDVA

SEQ ID NO: 15662 - protein, 7 aa, Artificial Sequence
  Description of Artificial Sequence: Synthetic peptide
  XENP019626 vlCDR2
YASHRYT

SEQ ID NO: 15663 - protein, 9 aa, Artificial Sequence
  Description of Artificial Sequence: Synthetic peptide
  XENP019626 vlCDR3
QQDFSSPRT

SEQ ID NO: 15664 - protein, 249 aa, Artificial Sequence
  Description of Artificial Sequence: Synthetic polypeptide
  XENP019627 1G6_H1.278_L1.193_scFv(GKPGS)4
EVQLVESGGGLVKPGGSLRLSCVASGFTFSNYWMNWVRQAPGKGLEWVAEIRLYSNNYATHYAESVKGRFTISRDDSKSTLYLQMNNLKTEDTGVYYCTRYYGNYGGYFDVWGQGTLVTVSSGKPGSGKPGSGKPGSGKPGSEIVLTQSPATLSVSPGERVTLTCRASQSVGNDVAWYQQKPGQAPRLLINYASHRYTGVPDRFTGSGYGTEFTLTISSVQSEDFGVYYCQQDFSSPRTFGGGTKVEIK

SEQ ID NO: 15665 - protein, 122 aa, Artificial Sequence; identical to SEQ ID NO: 15521
  Description of Artificial Sequence: Synthetic polypeptide
  VH of XENP019627

SEQ ID NO: 15666 - protein, 107 aa, Artificial Sequence
  Description of Artificial Sequence: Synthetic polypeptide
  VL of XENP019627
EIVLTQSPATLSVSPGERVTLTCRASQSVGNDVAWYQQKPGQAPRLLINYASHRYTGVPDRFTGSGYGTEFTLTISSVQSEDFGVYYCQQDFSSPRTFGGGTKVEIK

SEQ ID NO: 15667 - protein, 5 aa, Artificial Sequence
  Description of Artificial Sequence: Synthetic peptide
  XENP019627 vhCDR1
NYWMN

SEQ ID NO: 15668 - protein, 19 aa, Artificial Sequence
  Description of Artificial Sequence: Synthetic peptide
  XENP019627 vhCDR2
EIRLYSNNYATHYAESVKG

SEQ ID NO: 15669 - protein, 11 aa, Artificial Sequence
  Description of Artificial Sequence: Synthetic peptide
  XENP019627 vhCDR3
YYGNYGGYFDV

SEQ ID NO: 15670 - protein, 11 aa, Artificial Sequence
  Description of Artificial Sequence: Synthetic peptide
  XENP019627 vlCDR1
RASQSVGNDVA

SEQ ID NO: 15671 - protein, 7 aa, Artificial Sequence
  Description of Artificial Sequence: Synthetic peptide
  XENP019627 vlCDR2
YASHRYT

SEQ ID NO: 15672 - protein, 9 aa, Artificial Sequence
  Description of Artificial Sequence: Synthetic peptide
  XENP019627 vlCDR3
QQDFSSPRT

SEQ ID NO: 15673 - protein, 249 aa, Artificial Sequence
  Description of Artificial Sequence: Synthetic polypeptide
  XENP019628 1G6_H1.278_L1.194_scFv(GKPGS)4
EVQLVESGGGLVKPGGSLRLSCVASGFTFSNYWMNWVRQAPGKGLEWVAEIRLYSNNYATHYAESVKGRFTISRDDSKSTLYLQMNNLKTEDTGVYYCTRYYGNYGGYFDVWGQGTLVTVSSGKPGSGKPGSGKPGSGKPGSEIVLTQSPATLSASPGERVTLTCRASQSVGNDVAWYQQKPGQAPRLLINYASHRYTGVPDRFTGSGYGTEFTLTISSVQSEDFGVYYCQQDFSSPRTFGGGTKVEIK

SEQ ID NO: 15674 - protein, 122 aa, Artificial Sequence; identical to SEQ ID NO: 15521
  Description of Artificial Sequence: Synthetic polypeptide
  VH of XENP019628

SEQ ID NO: 15675 - protein, 107 aa, Artificial Sequence; identical to SEQ ID NO: 2871
  Description of Artificial Sequence: Synthetic polypeptide
  VL of XENP019628

SEQ ID NO: 15676 - protein, 5 aa, Artificial Sequence
  Description of Artificial Sequence: Synthetic peptide
  XENP019628 vhCDR1
NYWMN

SEQ ID NO: 15677 - protein, 19 aa, Artificial Sequence
  Description of Artificial Sequence: Synthetic peptide
  XENP019628 vhCDR2
EIRLYSNNYATHYAESVKG

SEQ ID NO: 15678 - protein, 11 aa, Artificial Sequence
  Description of Artificial Sequence: Synthetic peptide
  XENP019628 vhCDR3
YYGNYGGYFDV

SEQ ID NO: 15679 - protein, 11 aa, Artificial Sequence
  Description of Artificial Sequence: Synthetic peptide
  XENP019628 vlCDR1
RASQSVGNDVA

SEQ ID NO: 15680 - protein, 7 aa, Artificial Sequence
  Description of Artificial Sequence: Synthetic peptide
  XENP019628 vlCDR2
YASHRYT

SEQ ID NO: 15681 - protein, 9 aa, Artificial Sequence
  Description of Artificial Sequence: Synthetic peptide
  XENP019628 vlCDR3
QQDFSSPRT

SEQ ID NO: 15682 - protein, 249 aa, Artificial Sequence
  Description of Artificial Sequence: Synthetic polypeptide
  XENP019629 1G6_H1.278_L1.195_scFv(GKPGS)4
EVQLVESGGGLVKPGGSLRLSCVASGFTFSNYWMNWVRQAPGKGLEWVAEIRLYSNNYATHYAESVKGRFTISRDDSKSTLYLQMNNLKTEDTGVYYCTRYYGNYGGYFDVWGQGTLVTVSSGKPGSGKPGSGKPGSGKPGSEIVLTQSPATLSVSPGERVTLTCRASQSVGNDVAWYQQKPGQAPRLLCNYASHRYTGVPDRFTCSGYGTEFTLTISSVQSEDFAVYYCQQDFSSPRTFGGGTKVEIK

SEQ ID NO: 15683 - protein, 122 aa, Artificial Sequence; identical to SEQ ID NO: 15521
  Description of Artificial Sequence: Synthetic polypeptide
  VH of XENP019629

SEQ ID NO: 15684 - protein, 107 aa, Artificial Sequence
  Description of Artificial Sequence: Synthetic polypeptide
  VL of XENP019629
EIVLTQSPATLSVSPGERVTLTCRASQSVGNDVAWYQQKPGQAPRLLCNYASHRYTGVPDRFTCSGYGTEFTLTISSVQSEDFAVYYCQQDFSSPRTFGGGTKVEIK

SEQ ID NO: 15685 - protein, 5 aa, Artificial Sequence
  Description of Artificial Sequence: Synthetic peptide
  XENP019629 vhCDR1
NYWMN

SEQ ID NO: 15686 - protein, 19 aa, Artificial Sequence
  Description of Artificial Sequence: Synthetic peptide
  XENP019629 vhCDR2
EIRLYSNNYATHYAESVKG

SEQ ID NO: 15687 - protein, 11 aa, Artificial Sequence
  Description of Artificial Sequence: Synthetic peptide
  XENP019629 vhCDR3
YYGNYGGYFDV

SEQ ID NO: 15688 - protein, 11 aa, Artificial Sequence
  Description of Artificial Sequence: Synthetic peptide
  XENP019629 vlCDR1
RASQSVGNDVA

SEQ ID NO: 15689 - protein, 9 aa, Artificial Sequence
  Description of Artificial Sequence: Synthetic peptide
  XENP019629 vlCDR2
CNYASHRYT

SEQ ID NO: 15690 - protein, 9 aa, Artificial Sequence
  Description of Artificial Sequence: Synthetic peptide
  XENP019629 vlCDR3
QQDFSSPRT

SEQ ID NO: 15691 - protein, 249 aa, Artificial Sequence
  Description of Artificial Sequence: Synthetic polypeptide
  XENP019630 1G6_H1.278_L1.196_scFv(GKPGS)4
EVQLVESGGGLVKPGGSLRLSCVASGFTFSNYWMNWVRQAPGKGLEWVAEIRLYSNNYATHYAESVKGRFTISRDDSKSTLYLQMNNLKTEDTGVYYCTRYYGNYGGYFDVWGQGTLVTVSSGKPGSGKPGSGKPGSGKPGSEIVLTQSPATLSASPGERVTLTCRASQSVGNDVAWYQQKPGQAPRLLCNYASHRYTGVPDRFTCSGYGTEFTLTISSVQSEDFGVYYCQQDFSSPRTFGGGTKVEIK

SEQ ID NO: 15692 - protein, 122 aa, Artificial Sequence; identical to SEQ ID NO: 15521
  Description of Artificial Sequence: Synthetic polypeptide
  VH of XENP019630

SEQ ID NO: 15693 - protein, 107 aa, Artificial Sequence
  Description of Artificial Sequence: Synthetic polypeptide
  VL of XENP019630
EIVLTQSPATLSASPGERVTLTCRASQSVGNDVAWYQQKPGQAPRLLCNYASHRYTGVPDRFTCSGYGTEFTLTISSVQSEDFGVYYCQQDFSSPRTFGGGTKVEIK

SEQ ID NO: 15694 - protein, 5 aa, Artificial Sequence
  Description of Artificial Sequence: Synthetic peptide
  XENP019630 vhCDR1
NYWMN

SEQ ID NO: 15695 - protein, 19 aa, Artificial Sequence
  Description of Artificial Sequence: Synthetic peptide
  XENP019630 vhCDR2
EIRLYSNNYATHYAESVKG

SEQ ID NO: 15696 - protein, 11 aa, Artificial Sequence
  Description of Artificial Sequence: Synthetic peptide
  XENP019630 vhCDR3
YYGNYGGYFDV

SEQ ID NO: 15697 - protein, 11 aa, Artificial Sequence
  Description of Artificial Sequence: Synthetic peptide
  XENP019630 vlCDR1
RASQSVGNDVA

SEQ ID NO: 15698 - protein, 9 aa, Artificial Sequence
  Description of Artificial Sequence: Synthetic peptide
  XENP019630 vlCDR2
CNYASHRYT

SEQ ID NO: 15699 - protein, 9 aa, Artificial Sequence
  Description of Artificial Sequence: Synthetic peptide
  XENP019630 vlCDR3
QQDFSSPRT

SEQ ID NO: 15700 - protein, 249 aa, Artificial Sequence
  Description of Artificial Sequence: Synthetic polypeptide
  XENP019631 1G6_H1.278_L1.197_scFv(GKPGS)4
EVQLVESGGGLVKPGGSLRLSCVASGFTFSNYWMNWVRQAPGKGLEWVAEIRLYSNNYATHYAESVKGRFTISRDDSKSTLYLQMNNLKTEDTGVYYCTRYYGNYGGYFDVWGQGTLVTVSSGKPGSGKPGSGKPGSGKPGSEIVLTQSPATLSASPGERVTLTCRASQSVGNDVAWYQQKPGQAPRLLCNYASHRYTSVPDRFTCSGYGTEFTLTISSVQSEDFGVYYCQQDFSSPRTFGGGTKVEIK

SEQ ID NO: 15701 - protein, 122 aa, Artificial Sequence; identical to SEQ ID NO: 15521
  Description of Artificial Sequence: Synthetic polypeptide
  VH of XENP019631

SEQ ID NO: 15702 - protein, 107 aa, Artificial Sequence
  Description of Artificial Sequence: Synthetic polypeptide
  VL of XENP019631
EIVLTQSPATLSASPGERVTLTCRASQSVGNDVAWYQQKPGQAPRLLCNYASHRYTSVPDRFTCSGYGTEFTLTISSVQSEDFGVYYCQQDFSSPRTFGGGTKVEIK

SEQ ID NO: 15703 - protein, 5 aa, Artificial Sequence
  Description of Artificial Sequence: Synthetic peptide
  XENP019631 vhCDR1
NYWMN

SEQ ID NO: 15704 - protein, 19 aa, Artificial Sequence
  Description of Artificial Sequence: Synthetic peptide
  XENP019631 vhCDR2
EIRLYSNNYATHYAESVKG

SEQ ID NO: 15705 - protein, 11 aa, Artificial Sequence
  Description of Artificial Sequence: Synthetic peptide
  XENP019631 vhCDR3
YYGNYGGYFDV

SEQ ID NO: 15706 - protein, 11 aa, Artificial Sequence
  Description of Artificial Sequence: Synthetic peptide
  XENP019631 vlCDR1
RASQSVGNDVA

SEQ ID NO: 15707 - protein, 9 aa, Artificial Sequence
  Description of Artificial Sequence: Synthetic peptide
  XENP019631 vlCDR2
CNYASHRYT

SEQ ID NO: 15708 - protein, 9 aa, Artificial Sequence
  Description of Artificial Sequence: Synthetic peptide
  XENP019631 vlCDR3
QQDFSSPRT

SEQ ID NO: 15709 - protein, 249 aa, Artificial Sequence
  Description of Artificial Sequence: Synthetic polypeptide
  XENP019632 1G6_H1.278_L1.198_scFv(GKPGS)4
EVQLVESGGGLVKPGGSLRLSCVASGFTFSNYWMNWVRQAPGKGLEWVAEIRLYSNNYATHYAESVKGRFTISRDDSKSTLYLQMNNLKTEDTGVYYCTRYYGNYGGYFDVWGQGTLVTVSSGKPGSGKPGSGKPGSGKPGSEIVLTQSPSTLSVSPGERVTLTCRASQSVGNDVAWYQQKPGQAPRLLINYASHRYTGVPDRFTGSGYGTEFTLTISSVQSEDFAVYYCQQDFSSPRTFGGGTKVEIK

SEQ ID NO: 15710 - protein, 122 aa, Artificial Sequence; identical to SEQ ID NO: 15521
  Description of Artificial Sequence: Synthetic polypeptide
  VH of XENP019632

SEQ ID NO: 15711 - protein, 107 aa, Artificial Sequence
  Description of Artificial Sequence: Synthetic polypeptide
  VL of XENP019632
EIVLTQSPSTLSVSPGERVTLTCRASQSVGNDVAWYQQKPGQAPRLLINYASHRYTGVPDRFTGSGYGTEFTLTISSVQSEDFAVYYCQQDFSSPRTFGGGTKVEIK

SEQ ID NO: 15712 - protein, 5 aa, Artificial Sequence
  Description of Artificial Sequence: Synthetic peptide
  XENP019632 vhCDR1
NYWMN

SEQ ID NO: 15713 - protein, 19 aa, Artificial Sequence
  Description of Artificial Sequence: Synthetic peptide
  XENP019632 vhCDR2
EIRLYSNNYATHYAESVKG

SEQ ID NO: 15714 - protein, 11 aa, Artificial Sequence
  Description of Artificial Sequence: Synthetic peptide
  XENP019632 vhCDR3
YYGNYGGYFDV

SEQ ID NO: 15715 - protein, 11 aa, Artificial Sequence
  Description of Artificial Sequence: Synthetic peptide
  XENP019632 vlCDR1
RASQSVGNDVA

SEQ ID NO: 15716 - protein, 7 aa, Artificial Sequence
  Description of Artificial Sequence: Synthetic peptide
  XENP019632 vlCDR2
YASHRYT

SEQ ID NO: 15717 - protein, 9 aa, Artificial Sequence
  Description of Artificial Sequence: Synthetic peptide
  XENP019632 vlCDR3
QQDFSSPRT

SEQ ID NO: 15718 - protein, 249 aa, Artificial Sequence
  Description of Artificial Sequence: Synthetic polypeptide
  XENP019633 1G6_H1.278_L1.199_scFv(GKPGS)4
EVQLVESGGGLVKPGGSLRLSCVASGFTFSNYWMNWVRQAPGKGLEWVAEIRLYSNNYATHYAESVKGRFTISRDDSKSTLYLQMNNLKTEDTGVYYCTRYYGNYGGYFDVWGQGTLVTVSSGKPGSGKPGSGKPGSGKPGSEIVLTQSPDTLSVSPGERVTLTCRASQSVGNDVAWYQQKPGQAPRLLINYASHRYTGVPDRFTGSGYGTEFTLTISSVQSEDFAVYYCQQDFSSPRTFGGGTKVEIK

SEQ ID NO: 15719 - protein, 122 aa, Artificial Sequence; identical to SEQ ID NO: 15521
  Description of Artificial Sequence: Synthetic polypeptide
  VH of XENP019633

SEQ ID NO: 15720 - protein, 107 aa, Artificial Sequence
  Description of Artificial Sequence: Synthetic polypeptide
  VL of XENP019633
EIVLTQSPDTLSVSPGERVTLTCRASQSVGNDVAWYQQKPGQAPRLLINYASHRYTGVPDRFTGSGYGTEFTLTISSVQSEDFAVYYCQQDFSSPRTFGGGTKVEIK

SEQ ID NO: 15721 - protein, 5 aa, Artificial Sequence
  Description of Artificial Sequence: Synthetic peptide
  XENP019633 vhCDR1
NYWMN

SEQ ID NO: 15722 - protein, 19 aa, Artificial Sequence
  Description of Artificial Sequence: Synthetic peptide
  XENP019633 vhCDR2
EIRLYSNNYATHYAESVKG

SEQ ID NO: 15723 - protein, 11 aa, Artificial Sequence
  Description of Artificial Sequence: Synthetic peptide
  XENP019633 vhCDR3
YYGNYGGYFDV

SEQ ID NO: 15724 - protein, 11 aa, Artificial Sequence
  Description of Artificial Sequence: Synthetic peptide
  XENP019633 vlCDR1
RASQSVGNDVA

SEQ ID NO: 15725 - protein, 7 aa, Artificial Sequence
  Description of Artificial Sequence: Synthetic peptide
  XENP019633 vlCDR2
YASHRYT

SEQ ID NO: 15726 - protein, 9 aa, Artificial Sequence
  Description of Artificial Sequence: Synthetic peptide
  XENP019633 vlCDR3
QQDFSSPRT

SEQ ID NO: 15727 - protein, 249 aa, Artificial Sequence
  Description of Artificial Sequence: Synthetic polypeptide
  XENP019634 1G6_H1.278_L1.200_scFv(GKPGS)4
EVQLVESGGGLVKPGGSLRLSCVASGFTFSNYWMNWVRQAPGKGLEWVAEIRLYSNNYATHYAESVKGRFTISRDDSKSTLYLQMNNLKTEDTGVYYCTRYYGNYGGYFDVWGQGTLVTVSSGKPGSGKPGSGKPGSGKPGSEIVLTQSPATLAVSPGERVTLTCRASQSVGNDVAWYQQKPGQAPRLLINYASHRYTGVPDRFTGSGYGTEFTLTISSVQSEDFAVYYCQQDFSSPRTFGGGTKVEIK

SEQ ID NO: 15728 - protein, 122 aa, Artificial Sequence; identical to SEQ ID NO: 15521
  Description of Artificial Sequence: Synthetic polypeptide
  VH of XENP019634

SEQ ID NO: 15729 - protein, 107 aa, Artificial Sequence
  Description of Artificial Sequence: Synthetic polypeptide
  VL of XENP019634
EIVLTQSPATLAVSPGERVTLTCRASQSVGNDVAWYQQKPGQAPRLLINYASHRYTGVPDRFTGSGYGTEFTLTISSVQSEDFAVYYCQQDFSSPRTFGGGTKVEIK

SEQ ID NO: 15730 - protein, 5 aa, Artificial Sequence
  Description of Artificial Sequence: Synthetic peptide
  XENP019634 vhCDR1
NYWMN

SEQ ID NO: 15731 - protein, 19 aa, Artificial Sequence
  Description of Artificial Sequence: Synthetic peptide
  XENP019634 vhCDR2
EIRLYSNNYATHYAESVKG

SEQ ID NO: 15732 - protein, 11 aa, Artificial Sequence
  Description of Artificial Sequence: Synthetic peptide
  XENP019634 vhCDR3
YYGNYGGYFDV

SEQ ID NO: 15733 - protein, 11 aa, Artificial Sequence
  Description of Artificial Sequence: Synthetic peptide
  XENP019634 vlCDR1
RASQSVGNDVA

SEQ ID NO: 15734 - protein, 7 aa, Artificial Sequence
  Description of Artificial Sequence: Synthetic peptide
  XENP019634 vlCDR2
YASHRYT

SEQ ID NO: 15735 - protein, 9 aa, Artificial Sequence
  Description of Artificial Sequence: Synthetic peptide
  XENP019634 vlCDR3
QQDFSSPRT

SEQ ID NO: 15736 - protein, 249 aa, Artificial Sequence; identical to SEQ ID NO: 15655
  Description of Artificial Sequence: Synthetic polypeptide
  XENP019635 1G6_H1.278_L1.201_scFv(GKPGS)4

SEQ ID NO: 15737 - protein, 122 aa, Artificial Sequence; identical to SEQ ID NO: 15521
  Description of Artificial Sequence: Synthetic polypeptide
  VH of XENP019635

SEQ ID NO: 15738 - protein, 107 aa, Artificial Sequence; identical to SEQ ID NO: 15657
  Description of Artificial Sequence: Synthetic polypeptide
  VL of XENP019635

SEQ ID NO: 15739 - protein, 5 aa, Artificial Sequence
  Description of Artificial Sequence: Synthetic peptide
  XENP019635 vhCDR1
NYWMN

SEQ ID NO: 15740 - protein, 19 aa, Artificial Sequence
  Description of Artificial Sequence: Synthetic peptide
  XENP019635 vhCDR2
EIRLYSNNYATHYAESVKG

SEQ ID NO: 15741 - protein, 11 aa, Artificial Sequence
  Description of Artificial Sequence: Synthetic peptide
  XENP019635 vhCDR3
YYGNYGGYFDV

SEQ ID NO: 15742 - protein, 11 aa, Artificial Sequence
  Description of Artificial Sequence: Synthetic peptide
  XENP019635 vlCDR1
RASQSVGNDVA

SEQ ID NO: 15743 - protein, 7 aa, Artificial Sequence
  Description of Artificial Sequence: Synthetic peptide
  XENP019635 vlCDR2
YASHRYT

SEQ ID NO: 15744 - protein, 9 aa, Artificial Sequence
  Description of Artificial Sequence: Synthetic peptide
  XENP019635 vlCDR3
QQDFSSPRT

SEQ ID NO: 15745 - protein, 249 aa, Artificial Sequence
  Description of Artificial Sequence: Synthetic polypeptide
  XENP019636 1G6_H1.278_L1.202_scFv(GKPGS)4
EVQLVESGGGLVKPGGSLRLSCVASGFTFSNYWMNWVRQAPGKGLEWVAEIRLYSNNYATHYAESVKGRFTISRDDSKSTLYLQMNNLKTEDTGVYYCTRYYGNYGGYFDVWGQGTLVTVSSGKPGSGKPGSGKPGSGKPGSEIVLTQSPATLSVSVGERVTLTCRASQSVGNDVAWYQQKPGQAPRLLINYASHRYTGVPDRFTGSGYGTEFTLTISSVQSEDFAVYYCQQDFSSPRTFGGGTKVEIK

SEQ ID NO: 15746 - protein, 122 aa, Artificial Sequence; identical to SEQ ID NO: 15521
  Description of Artificial Sequence: Synthetic polypeptide
  VH of XENP019636

SEQ ID NO: 15747 - protein, 107 aa, Artificial Sequence
  Description of Artificial Sequence: Synthetic polypeptide
  VL of XENP019636
EIVLTQSPATLSVSVGERVTLTCRASQSVGNDVAWYQQKPGQAPRLLINYASHRYTGVPDRFTGSGYGTEFTLTISSVQSEDFAVYYCQQDFSSPRTFGGGTKVEIK

SEQ ID NO: 15748 - protein, 5 aa, Artificial Sequence
  Description of Artificial Sequence: Synthetic peptide
  XENP019636 vhCDR1
NYWMN

SEQ ID NO: 15749 - protein, 19 aa, Artificial Sequence
  Description of Artificial Sequence: Synthetic peptide
  XENP019636 vhCDR2
EIRLYSNNYATHYAESVKG

SEQ ID NO: 15750 - protein, 11 aa, Artificial Sequence
  Description of Artificial Sequence: Synthetic peptide
  XENP019636 vhCDR3
YYGNYGGYFDV

SEQ ID NO: 15751 - protein, 11 aa, Artificial Sequence
  Description of Artificial Sequence: Synthetic peptide
  XENP019636 vlCDR1
RASQSVGNDVA

SEQ ID NO: 15752 - protein, 7 aa, Artificial Sequence
  Description of Artificial Sequence: Synthetic peptide
  XENP019636 vlCDR2
YASHRYT

SEQ ID NO: 15753 - protein, 9 aa, Artificial Sequence
  Description of Artificial Sequence: Synthetic peptide
  XENP019636 vlCDR3
QQDFSSPRT

SEQ ID NO: 15754 - protein, 249 aa, Artificial Sequence
  Description of Artificial Sequence: Synthetic polypeptide
  XENP019637 1G6_H1.278_L1.203_scFv(GKPGS)4
EVQLVESGGGLVKPGGSLRLSCVASGFTFSNYWMNWVRQAPGKGLEWVAEIRLYSNNYATHYAESVKGRFTISRDDSKSTLYLQMNNLKTEDTGVYYCTRYYGNYGGYFDVWGQGTLVTVSSGKPGSGKPGSGKPGSGKPGSEIVLTQSPATLSVSLGERVTLTCRASQSVGNDVAWYQQKPGQAPRLLINYASHRYTGVPDRFTGSGYGTEFTLTISSVQSEDFAVYYCQQDFSSPRTFGGGTKVEIK

SEQ ID NO: 15755 - protein, 122 aa, Artificial Sequence; identical to SEQ ID NO: 15521
  Description of Artificial Sequence: Synthetic polypeptide
  VH of XENP019637

SEQ ID NO: 15756 - protein, 107 aa, Artificial Sequence
  Description of Artificial Sequence: Synthetic polypeptide
  VL of XENP019637
EIVLTQSPATLSVSLGERVTLTCRASQSVGNDVAWYQQKPGQAPRLLINYASHRYTGVPDRFTGSGYGTEFTLTISSVQSEDFAVYYCQQDFSSPRTFGGGTKVEIK

SEQ ID NO: 15757 - protein, 5 aa, Artificial Sequence
  Description of Artificial Sequence: Synthetic peptide
  XENP019637 vhCDR1
NYWMN

SEQ ID NO: 15758 - protein, 19 aa, Artificial Sequence
  Description of Artificial Sequence: Synthetic peptide
  XENP019637 vhCDR2
EIRLYSNNYATHYAESVKG

SEQ ID NO: 15759 - protein, 11 aa, Artificial Sequence
  Description of Artificial Sequence: Synthetic peptide
  XENP019637 vhCDR3
YYGNYGGYFDV

SEQ ID NO: 15760 - protein, 11 aa, Artificial Sequence
  Description of Artificial Sequence: Synthetic peptide
  XENP019637 vlCDR1
RASQSVGNDVA

SEQ ID NO: 15761 - protein, 7 aa, Artificial Sequence
  Description of Artificial Sequence: Synthetic peptide
  XENP019637 vlCDR2
YASHRYT

SEQ ID NO: 15762 - protein, 9 aa, Artificial Sequence
  Description of Artificial Sequence: Synthetic peptide
  XENP019637 vlCDR3
QQDFSSPRT

SEQ ID NO: 15763 - protein, 249 aa, Artificial Sequence
  Description of Artificial Sequence: Synthetic polypeptide
  XENP019638 1G6_H1.278_L1.204_scFv(GKPGS)4
EVQLVESGGGLVKPGGSLRLSCVASGFTFSNYWMNWVRQAPGKGLEWVAEIRLYSNNYATHYAESVKGRFTISRDDSKSTLYLQMNNLKTEDTGVYYCTRYYGNYGGYFDVWGQGTLVTVSSGKPGSGKPGSGKPGSGKPGSEIVLTQSPATLSVSPGERVTLNCRASQSVGNDVAWYQQKPGQAPRLLINYASHRYTGVPDRFTGSGYGTEFTLTISSVQSEDFAVYYCQQDFSSPRTFGGGTKVEIK

SEQ ID NO: 15764 - protein, 122 aa, Artificial Sequence; identical to SEQ ID NO: 15521
  Description of Artificial Sequence: Synthetic polypeptide
  VH of XENP019638

SEQ ID NO: 15765 - protein, 107 aa, Artificial Sequence
  Description of Artificial Sequence: Synthetic polypeptide
  VL of XENP019638
EIVLTQSPATLSVSPGERVTLNCRASQSVGNDVAWYQQKPGQAPRLLINYASHRYTGVPDRFTGSGYGTEFTLTISSVQSEDFAVYYCQQDFSSPRTFGGGTKVEIK

SEQ ID NO: 15766 - protein, 5 aa, Artificial Sequence
  Description of Artificial Sequence: Synthetic peptide
  XENP019638 vhCDR1
NYWMN

SEQ ID NO: 15767 - protein, 19 aa, Artificial Sequence
  Description of Artificial Sequence: Synthetic peptide
  XENP019638 vhCDR2
EIRLYSNNYATHYAESVKG

SEQ ID NO: 15768 - protein, 11 aa, Artificial Sequence
  Description of Artificial Sequence: Synthetic peptide
  XENP019638 vhCDR3
YYGNYGGYFDV

SEQ ID NO: 15769 - protein, 11 aa, Artificial Sequence
  Description of Artificial Sequence: Synthetic peptide
  XENP019638 vlCDR1
RASQSVGNDVA

SEQ ID NO: 15770 - protein, 7 aa, Artificial Sequence
  Description of Artificial Sequence: Synthetic peptide
  XENP019638 vlCDR2
YASHRYT

SEQ ID NO: 15771 - protein, 9 aa, Artificial Sequence
  Description of Artificial Sequence: Synthetic peptide
  XENP019638 vlCDR3
QQDFSSPRT

SEQ ID NO: 15772 - protein, 249 aa, Artificial Sequence
  Description of Artificial Sequence: Synthetic polypeptide
  XENP019639 1G6_H1.278_L1.205_scFv(GKPGS)4
EVQLVESGGGLVKPGGSLRLSCVASGFTFSNYWMNWVRQAPGKGLEWVAEIRLYSNNYATHYAESVKGRFTISRDDSKSTLYLQMNNLKTEDTGVYYCTRYYGNYGGYFDVWGQGTLVTVSSGKPGSGKPGSGKPGSGKPGSEIVLTQSPATLSVSPGERVTLTCRASQSVGNDVAWYQQKPGKAPRLLINYASHRYTGVPDRFTGSGYGTEFTLTISSVQSEDFAVYYCQQDFSSPRTFGGGTKVEIK

SEQ ID NO: 15773 - protein, 122 aa, Artificial Sequence; identical to SEQ ID NO: 15521
  Description of Artificial Sequence: Synthetic polypeptide
  VH of XENP019639

SEQ ID NO: 15774 - protein, 107 aa, Artificial Sequence
  Description of Artificial Sequence: Synthetic polypeptide
  VL of XENP019639
EIVLTQSPATLSVSPGERVTLTCRASQSVGNDVAWYQQKPGKAPRLLINYASHRYTGVPDRFTGSGYGTEFTLTISSVQSEDFAVYYCQQDFSSPRTFGGGTKVEIK

SEQ ID NO: 15775 - protein, 5 aa, Artificial Sequence
  Description of Artificial Sequence: Synthetic peptide
  XENP019639 vhCDR1
NYWMN

SEQ ID NO: 15776 - protein, 19 aa, Artificial Sequence
  Description of Artificial Sequence: Synthetic peptide
  XENP019639 vhCDR2
EIRLYSNNYATHYAESVKG

SEQ ID NO: 15777 - protein, 11 aa, Artificial Sequence
  Description of Artificial Sequence: Synthetic peptide
  XENP019639 vhCDR3
YYGNYGGYFDV

SEQ ID NO: 15778 - protein, 11 aa, Artificial Sequence
  Description of Artificial Sequence: Synthetic peptide
  XENP019639 vlCDR1
RASQSVGNDVA

SEQ ID NO: 15779 - protein, 7 aa, Artificial Sequence
  Description of Artificial Sequence: Synthetic peptide
  XENP019639 vlCDR2
YASHRYT

SEQ ID NO: 15780 - protein, 9 aa, Artificial Sequence
  Description of Artificial Sequence: Synthetic peptide
  XENP019639 vlCDR3
QQDFSSPRT

SEQ ID NO: 15781 - protein, 249 aa, Artificial Sequence
  Description of Artificial Sequence: Synthetic polypeptide
  XENP019640 1G6_H1.278_L1.206_scFv(GKPGS)4
EVQLVESGGGLVKPGGSLRLSCVASGFTFSNYWMNWVRQAPGKGLEWVAEIRLYSNNYATHYAESVKGRFTISRDDSKSTLYLQMNNLKTEDTGVYYCTRYYGNYGGYFDVWGQGTLVTVSSGKPGSGKPGSGKPGSGKPGSEIVLTQSPATLSVSPGERVTLTCRASQSVGNDVAWYQQKPGQAPRLLINYASHRYTGVPDRFTGSGYGTEFTLTISSVQPEDFAVYYCQQDFSSPRTFGGGTKVEIK

SEQ ID NO: 15782 - protein, 122 aa, Artificial Sequence; identical to SEQ ID NO: 15521
  Description of Artificial Sequence: Synthetic polypeptide
  VH of XENP019640

SEQ ID NO: 15783 - protein, 107 aa, Artificial Sequence
  Description of Artificial Sequence: Synthetic polypeptide
  VL of XENP019640
EIVLTQSPATLSVSPGERVTLTCRASQSVGNDVAWYQQKPGQAPRLLINYASHRYTGVPDRFTGSGYGTEFTLTISSVQPEDFAVYYCQQDFSSPRTFGGGTKVEIK

SEQ ID NO: 15784 - protein, 5 aa, Artificial Sequence
  Description of Artificial Sequence: Synthetic peptide
  XENP019640 vhCDR1
NYWMN

SEQ ID NO: 15785 - protein, 19 aa, Artificial Sequence
  Description of Artificial Sequence: Synthetic peptide
  XENP019640 vhCDR2
EIRLYSNNYATHYAESVKG

SEQ ID NO: 15786 - protein, 11 aa, Artificial Sequence
  Description of Artificial Sequence: Synthetic peptide
  XENP019640 vhCDR3
YYGNYGGYFDV

SEQ ID NO: 15787 - protein, 11 aa, Artificial Sequence
  Description of Artificial Sequence: Synthetic peptide
  XENP019640 vlCDR1
RASQSVGNDVA

SEQ ID NO: 15788 - protein, 7 aa, Artificial Sequence
  Description of Artificial Sequence: Synthetic peptide
  XENP019640 vlCDR2
YASHRYT

SEQ ID NO: 15789 - protein, 9 aa, Artificial Sequence
  Description of Artificial Sequence: Synthetic peptide
  XENP019640 vlCDR3
QQDFSSPRT

SEQ ID NO: 15790 - protein, 249 aa, Artificial Sequence
  Description of Artificial Sequence: Synthetic polypeptide
  XENP019641 1G6_H1.278_L1.207_scFv(GKPGS)4
EVQLVESGGGLVKPGGSLRLSCVASGFTFSNYWMNWVRQAPGKGLEWVAEIRLYSNNYATHYAESVKGRFTISRDDSKSTLYLQMNNLKTEDTGVYYCTRYYGNYGGYFDVWGQGTLVTVSSGKPGSGKPGSGKPGSGKPGSEIVLTQSPATLSVSPGERVTLTCRASQSVGNDVAWYQQKPGQAPRLLINYASHRYTGVPDRFTGSGYGTEFTLTISSVQSEDVAVYYCQQDFSSPRTFGGGTKVEIK

SEQ ID NO: 15791 - protein, 122 aa, Artificial Sequence; identical to SEQ ID NO: 15521
  Description of Artificial Sequence: Synthetic polypeptide
  VH of XENP019641

SEQ ID NO: 15792 - protein, 107 aa, Artificial Sequence
  Description of Artificial Sequence: Synthetic polypeptide
  VL of XENP019641
EIVLTQSPATLSVSPGERVTLTCRASQSVGNDVAWYQQKPGQAPRLLINYASHRYTGVPDRFTGSGYGTEFTLTISSVQSEDVAVYYCQQDFSSPRTFGGGTKVEIK

SEQ ID NO: 15793 - protein, 5 aa, Artificial Sequence
  Description of Artificial Sequence: Synthetic peptide
  XENP019641 vhCDR1
NYWMN

SEQ ID NO: 15794 - protein, 19 aa, Artificial Sequence
  Description of Artificial Sequence: Synthetic peptide
  XENP019641 vhCDR2
EIRLYSNNYATHYAESVKG

SEQ ID NO: 15795 - protein, 11 aa, Artificial Sequence
  Description of Artificial Sequence: Synthetic peptide
  XENP019641 vhCDR3
YYGNYGGYFDV

SEQ ID NO: 15796 - protein, 11 aa, Artificial Sequence
  Description of Artificial Sequence: Synthetic peptide
  XENP019641 vlCDR1
RASQSVGNDVA

SEQ ID NO: 15797 - protein, 7 aa, Artificial Sequence
  Description of Artificial Sequence: Synthetic peptide
  XENP019641 vlCDR2
YASHRYT

SEQ ID NO: 15798 - protein, 9 aa, Artificial Sequence
  Description of Artificial Sequence: Synthetic peptide
  XENP019641 vlCDR3
QQDFSSPRT

SEQ ID NO: 15799 - protein, 249 aa, Artificial Sequence
  Description of Artificial Sequence: Synthetic polypeptide
  XENP019642 1G6_H1.278_L1.208_scFv(GKPGS)4
EVQLVESGGGLVKPGGSLRLSCVASGFTFSNYWMNWVRQAPGKGLEWVAEIRLYSNNYATHYAESVKGRFTISRDDSKSTLYLQMNNLKTEDTGVYYCTRYYGNYGGYFDVWGQGTLVTVSSGKPGSGKPGSGKPGSGKPGSEIVLTQSPATLSVSPGERVTLTCRASQSVGNDVAWYQQKPGQAPRLLINYASHRYTGVPDRFTGSGYGTEFTLTISSVQSEDFATYYCQQDFSSPRTFGGGTKVEIK

SEQ ID NO: 15800 - protein, 122 aa, Artificial Sequence; identical to SEQ ID NO: 15521
  Description of Artificial Sequence: Synthetic polypeptide
  VH of XENP019642

SEQ ID NO: 15801 - protein, 107 aa, Artificial Sequence
  Description of Artificial Sequence: Synthetic polypeptide
  VL of XENP019642
EIVLTQSPATLSVSPGERVTLTCRASQSVGNDVAWYQQKPGQAPRLLINYASHRYTGVPDRFTGSGYGTEFTLTISSVQSEDFATYYCQQDFSSPRTFGGGTKVEIK

SEQ ID NO: 15802 - protein, 5 aa, Artificial Sequence
  Description of Artificial Sequence: Synthetic peptide
  XENP019642 vhCDR1
NYWMN

SEQ ID NO: 15803 - protein, 19 aa, Artificial Sequence
  Description of Artificial Sequence: Synthetic peptide
  XENP019642 vhCDR2
EIRLYSNNYATHYAESVKG

SEQ ID NO: 15804 - protein, 11 aa, Artificial Sequence
  Description of Artificial Sequence: Synthetic peptide
  XENP019642 vhCDR3
YYGNYGGYFDV

SEQ ID NO: 15805 - protein, 11 aa, Artificial Sequence
  Description of Artificial Sequence: Synthetic peptide
  XENP019642 vlCDR1
RASQSVGNDVA

SEQ ID NO: 15806 - protein, 7 aa, Artificial Sequence
  Description of Artificial Sequence: Synthetic peptide
  XENP019642 vlCDR2
YASHRYT

SEQ ID NO: 15807 - protein, 9 aa, Artificial Sequence
  Description of Artificial Sequence: Synthetic peptide
  XENP019642 vlCDR3
QQDFSSPRT

SEQ ID NO: 15808 - protein, 249 aa, Artificial Sequence
  Description of Artificial Sequence: Synthetic polypeptide
  XENP019643 1G6_L1.189_H1.279_scFv(GKPGS)4
EIVLTQSPATLSVSPGERVTLTCRASQSVGNDVAWYQQKPGQAPRLLINYASHRYTGVPDRFTGSGYGTEFTLTISSVQSEDFAVYYCQQDFSSPRTFGGGTKVEIKGKPGSGKPGSGKPGSGKPGSEVQLVESGGGLVKPGGSLRLSCVASGFTFSNYWMNWVRQAPGKGLEWVAEIRLYSNNYATHYAESVKGRFTISRDDSKSTLYLQMNNLKTEDTGVYYCTRYYGNYGGYFDVWGRGTLVTVSS

SEQ ID NO: 15809 - protein, 107 aa, Artificial Sequence; identical to SEQ ID NO: 15540
  Description of Artificial Sequence: Synthetic polypeptide
  VH of XENP019643

SEQ ID NO: 15810 - protein, 122 aa, Artificial Sequence; identical to SEQ ID NO: 2872
  Description of Artificial Sequence: Synthetic polypeptide
  VL of XENP019643

SEQ ID NO: 15811 - protein, 11 aa, Artificial Sequence
  Description of Artificial Sequence: Synthetic peptide
  XENP019643 vhCDR1
RASQSVGNDVA

SEQ ID NO: 15812 - protein, 7 aa, Artificial Sequence
  Description of Artificial Sequence: Synthetic peptide
  XENP019643 vhCDR2
YASHRYT

SEQ ID NO: 15813 - protein, 9 aa, Artificial Sequence
  Description of Artificial Sequence: Synthetic peptide
  XENP019643 vhCDR3
QQDFSSPRT

SEQ ID NO: 15814 - protein, 5 aa, Artificial Sequence
  Description of Artificial Sequence: Synthetic peptide
  XENP019643 vlCDR1
NYWMN

SEQ ID NO: 15815 - protein, 19 aa, Artificial Sequence
  Description of Artificial Sequence: Synthetic peptide
  XENP019643 vlCDR2
EIRLYSNNYATHYAESVKG

SEQ ID NO: 15816 - protein, 11 aa, Artificial Sequence
  Description of Artificial Sequence: Synthetic peptide
  XENP019643 vlCDR3
YYGNYGGYFDV

SEQ ID NO: 15817 - protein, 249 aa, Artificial Sequence
  Description of Artificial Sequence: Synthetic polypeptide
  XENP019644 1G6_L1.189_H1.280_scFv(GKPGS)4
EIVLTQSPATLSVSPGERVTLTCRASQSVGNDVAWYQQKPGQAPRLLINYASHRYTGVPDRFTGSGYGTEFTLTISSVQSEDFAVYYCQQDFSSPRTFGGGTKVEIKGKPGSGKPGSGKPGSGKPGSEVQLVESGGGLVKPGGSLRLTCVASGFTFSNYWMNWVRQAPGKGLEWVAEIRLYSNNYATHYAESVKGRFTISRDDSKSTLYLQMNNLKTEDTGVYYCTRYYGNYGGYFDVWGRGTLVTVSS

SEQ ID NO: 15818 - protein, 107 aa, Artificial Sequence; identical to SEQ ID NO: 15540
  Description of Artificial Sequence: Synthetic polypeptide
  VH of XENP019644

SEQ ID NO: 15819 - protein, 122 aa, Artificial Sequence; identical to SEQ ID NO: 15593
  Description of Artificial Sequence: Synthetic polypeptide
  VL of XENP019644

SEQ ID NO: 15820 - protein, 11 aa, Artificial Sequence
  Description of Artificial Sequence: Synthetic peptide
  XENP019644 vhCDR1
RASQSVGNDVA

SEQ ID NO: 15821 - protein, 7 aa, Artificial Sequence
  Description of Artificial Sequence: Synthetic peptide
  XENP019644 vhCDR2
YASHRYT

SEQ ID NO: 15822 - protein, 9 aa, Artificial Sequence
  Description of Artificial Sequence: Synthetic peptide
  XENP019644 vhCDR3
QQDFSSPRT

SEQ ID NO: 15823 - protein, 5 aa, Artificial Sequence
  Description of Artificial Sequence: Synthetic peptide
  XENP019644 vlCDR1
NYWMN

SEQ ID NO: 15824 - protein, 19 aa, Artificial Sequence
  Description of Artificial Sequence: Synthetic peptide
  XENP019644 vlCDR2
EIRLYSNNYATHYAESVKG

SEQ ID NO: 15825 - protein, 11 aa, Artificial Sequence
  Description of Artificial Sequence: Synthetic peptide
  XENP019644 vlCDR3
YYGNYGGYFDV

SEQ ID NO: 15826 - protein, 249 aa, Artificial Sequence
  Description of Artificial Sequence: Synthetic polypeptide
  XENP019645 1G6_L1.189_H1.281_scFv(GKPGS)4
EIVLTQSPATLSVSPGERVTLTCRASQSVGNDVAWYQQKPGQAPRLLINYASHRYTGVPDRFTGSGYGTEFTLTISSVQSEDFAVYYCQQDFSSPRTFGGGTKVEIKGKPGSGKPGSGKPGSGKPGSEVQLVESGGGLVKPGGSLRLSCVASGFTFSNYWMNWVRQAPGKGLEWVAEIRLYSNNYATHYAESVKGRFTISRDDSKSMLYLQMNNLKTEDTGVYYCTRYYGNYGGYFDVWGRGTLVTVSS

SEQ ID NO: 15827 - protein, 107 aa, Artificial Sequence; identical to SEQ ID NO: 15540
  Description of Artificial Sequence: Synthetic polypeptide
  VH of XENP019645

SEQ ID NO: 15828 - protein, 122 aa, Artificial Sequence; identical to SEQ ID NO: 15602
  Description of Artificial Sequence: Synthetic polypeptide
  VL of XENP019645

SEQ ID NO: 15829 - protein, 11 aa, Artificial Sequence
  Description of Artificial Sequence: Synthetic peptide
  XENP019645 vhCDR1
RASQSVGNDVA

SEQ ID NO: 15830 - protein, 7 aa, Artificial Sequence
  Description of Artificial Sequence: Synthetic peptide
  XENP019645 vhCDR2
YASHRYT

SEQ ID NO: 15831 - protein, 9 aa, Artificial Sequence
  Description of Artificial Sequence: Synthetic peptide
  XENP019645 vhCDR3
QQDFSSPRT

SEQ ID NO: 15832 - protein, 5 aa, Artificial Sequence
  Description of Artificial Sequence: Synthetic peptide
  XENP019645 vlCDR1
NYWMN

SEQ ID NO: 15833 - protein, 19 aa, Artificial Sequence
  Description of Artificial Sequence: Synthetic peptide
  XENP019645 vlCDR2
EIRLYSNNYATHYAESVKG

SEQ ID NO: 15834 - protein, 11 aa, Artificial Sequence
  Description of Artificial Sequence: Synthetic peptide
  XENP019645 vlCDR3
YYGNYGGYFDV

SEQ ID NO: 15835 - protein, 249 aa, Artificial Sequence
  Description of Artificial Sequence: Synthetic polypeptide
  XENP019646 1G6_L1.189_H1.282_scFv(GKPGS)4
EIVLTQSPATLSVSPGERVTLTCRASQSVGNDVAWYQQKPGQAPRLLINYASHRYTGVPDRFTGSGYGTEFTLTISSVQSEDFAVYYCQQDFSSPRTFGGGTKVEIKGKPGSGKPGSGKPGSGKPGSEVQLVESGGGLVKPGGSLRLTCVASGFTFSNYWMNWVRQAPGKGLEWVAEIRLYSNNYATHYAESVKGRFTISRDDSKSMLYLQMNNLKTEDTGVYYCTRYYGNYGGYFDVWGRGTLVTVSS

SEQ ID NO: 15836 - protein, 107 aa, Artificial Sequence; identical to SEQ ID NO: 15540
  Description of Artificial Sequence: Synthetic polypeptide
  VH of XENP019646

SEQ ID NO: 15837 - protein, 122 aa, Artificial Sequence; identical to SEQ ID NO: 15611
  Description of Artificial Sequence: Synthetic polypeptide
  VL of XENP019646

SEQ ID NO: 15838 - protein, 11 aa, Artificial Sequence
  Description of Artificial Sequence: Synthetic peptide
  XENP019646 vhCDR1
RASQSVGNDVA

SEQ ID NO: 15839 - protein, 7 aa, Artificial Sequence
  Description of Artificial Sequence: Synthetic peptide
  XENP019646 vhCDR2
YASHRYT

SEQ ID NO: 15840 - protein, 9 aa, Artificial Sequence
  Description of Artificial Sequence: Synthetic peptide
  XENP019646 vhCDR3
QQDFSSPRT

SEQ ID NO: 15841 - protein, 5 aa, Artificial Sequence
  Description of Artificial Sequence: Synthetic peptide
  XENP019646 vlCDR1
NYWMN

SEQ ID NO: 15842 - protein, 19 aa, Artificial Sequence
  Description of Artificial Sequence: Synthetic peptide
  XENP019646 vlCDR2
EIRLYSNNYATHYAESVKG

SEQ ID NO: 15843 - protein, 11 aa, Artificial Sequence
  Description of Artificial Sequence: Synthetic peptide
  XENP019646 vlCDR3
YYGNYGGYFDV

SEQ ID NO: 15844 - protein, 249 aa, Artificial Sequence
  Description of Artificial Sequence: Synthetic polypeptide
  XENP019647 1G6_L1.189_H1.283_scFv(GKPGS)4
EIVLTQSPATLSVSPGERVTLTCRASQSVGNDVAWYQQKPGQAPRLLINYASHRYTGVPDRFTGSGYGTEFTLTISSVQSEDFAVYYCQQDFSSPRTFGGGTKVEIKGKPGSGKPGSGKPGSGKPGSEVQLVESGGGLVKPGGSLRLSCVASGFTFSNYWMNWVRQAPGKGLEWVCEIRLYSNNYATHYAESVKGRFTCSRDDSKSTLYLQMNNLKTEDTGVYYCTRYYGNYGGYFDVWGQGTLVTVSS

SEQ ID NO: 15845 - protein, 107 aa, Artificial Sequence; identical to SEQ ID NO: 15540
  Description of Artificial Sequence: Synthetic polypeptide
  VH of XENP019647

SEQ ID NO: 15846 - protein, 122 aa, Artificial Sequence; identical to SEQ ID NO: 15620
  Description of Artificial Sequence: Synthetic polypeptide
  VL of XENP019647

SEQ ID NO: 15847 - protein, 11 aa, Artificial Sequence
  Description of Artificial Sequence: Synthetic peptide
  XENP019647 vhCDR1
RASQSVGNDVA

SEQ ID NO: 15848 - protein, 7 aa, Artificial Sequence
  Description of Artificial Sequence: Synthetic peptide
  XENP019647 vhCDR2
YASHRYT

SEQ ID NO: 15849 - protein, 9 aa, Artificial Sequence
  Description of Artificial Sequence: Synthetic peptide
  XENP019647 vhCDR3
QQDFSSPRT

SEQ ID NO: 15850 - protein, 5 aa, Artificial Sequence
  Description of Artificial Sequence: Synthetic peptide
  XENP019647 vlCDR1
NYWMN

SEQ ID NO: 15851 - protein, 19 aa, Artificial Sequence
  Description of Artificial Sequence: Synthetic peptide
  XENP019647 vlCDR2
EIRLYSNNYATHYAESVKG

SEQ ID NO: 15852 - protein, 11 aa, Artificial Sequence
  Description of Artificial Sequence: Synthetic peptide
  XENP019647 vlCDR3
YYGNYGGYFDV

SEQ ID NO: 15853 - protein, 249 aa, Artificial Sequence
  Description of Artificial Sequence: Synthetic polypeptide
  XENP019648 1G6_L1.189_H1.284_scFv(GKPGS)4
EIVLTQSPATLSVSPGERVTLTCRASQSVGNDVAWYQQKPGQAPRLLINYASHRYTGVPDRFTGSGYGTEFTLTISSVQSEDFAVYYCQQDFSSPRTFGGGTKVEIKGKPGSGKPGSGKPGSGKPGSEVQLVESGGGLVKPGGSLRLSCVASGFTFSNYWMNWVRQAPGKGLEWVCEIRLYSNNYATHYAESVKGRFTCSRDDSKSTLYLQMNNLKTEDTGVYYCTRYYGNYGGYFDVWGRGTLVTVSS

SEQ ID NO: 15854 - protein, 107 aa, Artificial Sequence; identical to SEQ ID NO: 15540
  Description of Artificial Sequence: Synthetic polypeptide
  VH of XENP019648

SEQ ID NO: 15855 - protein, 122 aa, Artificial Sequence; identical to SEQ ID NO: 15629
  Description of Artificial Sequence: Synthetic polypeptide
  VL of XENP019648

SEQ ID NO: 15856 - protein, 11 aa, Artificial Sequence
  Description of Artificial Sequence: Synthetic peptide
  XENP019648 vhCDR1
RASQSVGNDVA

SEQ ID NO: 15857 - protein, 7 aa, Artificial Sequence
  Description of Artificial Sequence: Synthetic peptide
  XENP019648 vhCDR2
YASHRYT

SEQ ID NO: 15858 - protein, 9 aa, Artificial Sequence
  Description of Artificial Sequence: Synthetic peptide
  XENP019648 vhCDR3
QQDFSSPRT

SEQ ID NO: 15859 - protein, 5 aa, Artificial Sequence
  Description of Artificial Sequence: Synthetic peptide
  XENP019648 vlCDR1
NYWMN

SEQ ID NO: 15860 - protein, 19 aa, Artificial Sequence
  Description of Artificial Sequence: Synthetic peptide
  XENP019648 vlCDR2
EIRLYSNNYATHYAESVKG

SEQ ID NO: 15861 - protein, 11 aa, Artificial Sequence
  Description of Artificial Sequence: Synthetic peptide
  XENP019648 vlCDR3
YYGNYGGYFDV

SEQ ID NO: 15862 - protein, 249 aa, Artificial Sequence
  Description of Artificial Sequence: Synthetic polypeptide
  XENP019649 1G6_L1.189_H1.285_scFv(GKPGS)4
EIVLTQSPATLSVSPGERVTLTCRASQSVGNDVAWYQQKPGQAPRLLINYASHRYTGVPDRFTGSGYGTEFTLTISSVQSEDFAVYYCQQDFSSPRTFGGGTKVEIKGKPGSGKPGSGKPGSGKPGSEVQLVESGGGLVKPGGSLRLTCVASGFTFSNYWMNWVRQAPGKGLEWVCEIRLYSNNYATHYAESVKGRFTCSRDDSKSMLYLQMNNLKTEDTGVYYCTRYYGNYGGYFDVWGRGTLVTVSS

SEQ ID NO: 15863 - protein, 107 aa, Artificial Sequence; identical to SEQ ID NO: 15540
  Description of Artificial Sequence: Synthetic polypeptide
  VH of XENP019649

SEQ ID NO: 15864 - protein, 122 aa, Artificial Sequence; identical to SEQ ID NO: 15638
  Description of Artificial Sequence: Synthetic polypeptide
  VL of XENP019649

SEQ ID NO: 15865 - protein, 11 aa, Artificial Sequence
  Description of Artificial Sequence: Synthetic peptide
  XENP019649 vhCDR1
RASQSVGNDVA

SEQ ID NO: 15866 - protein, 7 aa, Artificial Sequence
  Description of Artificial Sequence: Synthetic peptide
  XENP019649 vhCDR2
YASHRYT

SEQ ID NO: 15867 - protein, 9 aa, Artificial Sequence
  Description of Artificial Sequence: Synthetic peptide
  XENP019649 vhCDR3
QQDFSSPRT

SEQ ID NO: 15868 - protein, 5 aa, Artificial Sequence
  Description of Artificial Sequence: Synthetic peptide
  XENP019649 vlCDR1
NYWMN

SEQ ID NO: 15869 - protein, 19 aa, Artificial Sequence
  Description of Artificial Sequence: Synthetic peptide
  XENP019649 vlCDR2
EIRLYSNNYATHYAESVKG

SEQ ID NO: 15870 - protein, 11 aa, Artificial Sequence
  Description of Artificial Sequence: Synthetic peptide
  XENP019649 vlCDR3
YYGNYGGYFDV

SEQ ID NO: 15871 - protein, 249 aa, Artificial Sequence
  Description of Artificial Sequence: Synthetic polypeptide
  XENP019650 1G6_L1.192_H1.278_scFv(GKPGS)4
EIVLTQSPATLSASPGERVTLTCRASQSVGNDVAWYQQKPGQAPRLLINYASHRYTGVPDRFTGSGYGTEFTLTISSVQSEDFAVYYCQQDFSSPRTFGGGTKVEIKGKPGSGKPGSGKPGSGKPGSEVQLVESGGGLVKPGGSLRLSCVASGFTFSNYWMNWVRQAPGKGLEWVAEIRLYSNNYATHYAESVKGRFTISRDDSKSTLYLQMNNLKTEDTGVYYCTRYYGNYGGYFDVWGQGTLVTVSS

SEQ ID NO: 15872 - protein, 107 aa, Artificial Sequence; identical to SEQ ID NO: 15657
  Description of Artificial Sequence: Synthetic polypeptide
  VH of XENP019650

SEQ ID NO: 15873 - protein, 122 aa, Artificial Sequence; identical to SEQ ID NO: 15521
  Description of Artificial Sequence: Synthetic polypeptide
  VL of XENP019650

SEQ ID NO: 15874 - protein, 11 aa, Artificial Sequence
  Description of Artificial Sequence: Synthetic peptide
  XENP019650 vhCDR1
RASQSVGNDVA

SEQ ID NO: 15875 - protein, 7 aa, Artificial Sequence
  Description of Artificial Sequence: Synthetic peptide
  XENP019650 vhCDR2
YASHRYT

SEQ ID NO: 15876 - protein, 9 aa, Artificial Sequence
  Description of Artificial Sequence: Synthetic peptide
  XENP019650 vhCDR3
QQDFSSPRT

SEQ ID NO: 15877 - protein, 5 aa, Artificial Sequence
  Description of Artificial Sequence: Synthetic peptide
  XENP019650 vlCDR1
NYWMN

SEQ ID NO: 15878 - protein, 19 aa, Artificial Sequence
  Description of Artificial Sequence: Synthetic peptide
  XENP019650 vlCDR2
EIRLYSNNYATHYAESVKG

SEQ ID NO: 15879 - protein, 11 aa, Artificial Sequence
  Description of Artificial Sequence: Synthetic peptide
  XENP019650 vlCDR3
YYGNYGGYFDV

SEQ ID NO: 15880 - protein, 249 aa, Artificial Sequence
  Description of Artificial Sequence: Synthetic polypeptide
  XENP019651 1G6_L1.193_H1.278_scFv(GKPGS)4
EIVLTQSPATLSVSPGERVTLTCRASQSVGNDVAWYQQKPGQAPRLLINYASHRYTGVPDRFTGSGYGTEFTLTISSVQSEDFGVYYCQQDFSSPRTFGGGTKVEIKGKPGSGKPGSGKPGSGKPGSEVQLVESGGGLVKPGGSLRLSCVASGFTFSNYWMNWVRQAPGKGLEWVAEIRLYSNNYATHYAESVKGRFTISRDDSKSTLYLQMNNLKTEDTGVYYCTRYYGNYGGYFDVWGQGTLVTVSS

SEQ ID NO: 15881 - protein, 107 aa, Artificial Sequence; identical to SEQ ID NO: 15666
  Description of Artificial Sequence: Synthetic polypeptide
  VH of XENP019651

SEQ ID NO: 15882 - protein, 122 aa, Artificial Sequence; identical to SEQ ID NO: 15521
  Description of Artificial Sequence: Synthetic polypeptide
  VL of XENP019651

SEQ ID NO: 15883 - protein, 11 aa, Artificial Sequence
  Description of Artificial Sequence: Synthetic peptide
  XENP019651 vhCDR1
RASQSVGNDVA

SEQ ID NO: 15884 - protein, 7 aa, Artificial Sequence
  Description of Artificial Sequence: Synthetic peptide
  XENP019651 vhCDR2
YASHRYT

SEQ ID NO: 15885 - protein, 9 aa, Artificial Sequence
  Description of Artificial Sequence: Synthetic peptide
  XENP019651 vhCDR3
QQDFSSPRT

SEQ ID NO: 15886 - protein, 5 aa, Artificial Sequence
  Description of Artificial Sequence: Synthetic peptide
  XENP019651 vlCDR1
NYWMN

SEQ ID NO: 15887 - protein, 19 aa, Artificial Sequence
  Description of Artificial Sequence: Synthetic peptide
  XENP019651 vlCDR2
EIRLYSNNYATHYAESVKG

SEQ ID NO: 15888 - protein, 11 aa, Artificial Sequence
  Description of Artificial Sequence: Synthetic peptide
  XENP019651 vlCDR3
YYGNYGGYFDV

SEQ ID NO: 15889 - protein, 249 aa, Artificial Sequence
  Description of Artificial Sequence: Synthetic polypeptide
  XENP019652 1G6_L1.194_H1.278_scFv(GKPGS)4
EIVLTQSPATLSASPGERVTLTCRASQSVGNDVAWYQQKPGQAPRLLINYASHRYTGVPDRFTGSGYGTEFTLTISSVQSEDFGVYYCQQDFSSPRTFGGGTKVEIKGKPGSGKPGSGKPGSGKPGSEVQLVESGGGLVKPGGSLRLSCVASGFTFSNYWMNWVRQAPGKGLEWVAEIRLYSNNYATHYAESVKGRFTISRDDSKSTLYLQMNNLKTEDTGVYYCTRYYGNYGGYFDVWGQGTLVTVSS

SEQ ID NO: 15890 - protein, 107 aa, Artificial Sequence; identical to SEQ ID NO: 2871
  Description of Artificial Sequence: Synthetic polypeptide
  VH of XENP019652

SEQ ID NO: 15891 - protein, 122 aa, Artificial Sequence; identical to SEQ ID NO: 15521
  Description of Artificial Sequence: Synthetic polypeptide
  VL of XENP019652

SEQ ID NO: 15892 - protein, 11 aa, Artificial Sequence
  Description of Artificial Sequence: Synthetic peptide
  XENP019652 vhCDR1
RASQSVGNDVA

SEQ ID NO: 15893 - protein, 7 aa, Artificial Sequence
  Description of Artificial Sequence: Synthetic peptide
  XENP019652 vhCDR2
YASHRYT

SEQ ID NO: 15894 - protein, 9 aa, Artificial Sequence
  Description of Artificial Sequence: Synthetic peptide
  XENP019652 vhCDR3
QQDFSSPRT

SEQ ID NO: 15895 - protein, 5 aa, Artificial Sequence
  Description of Artificial Sequence: Synthetic peptide
  XENP019652 vlCDR1
NYWMN

SEQ ID NO: 15896 - protein, 19 aa, Artificial Sequence
  Description of Artificial Sequence: Synthetic peptide
  XENP019652 vlCDR2
EIRLYSNNYATHYAESVKG

SEQ ID NO: 15897 - protein, 11 aa, Artificial Sequence
  Description of Artificial Sequence: Synthetic peptide
  XENP019652 vlCDR3
YYGNYGGYFDV

SEQ ID NO: 15898 - protein, 249 aa, Artificial Sequence
  Description of Artificial Sequence: Synthetic polypeptide
  XENP019653 1G6_L1.195_H1.278_scFv(GKPGS)4
EIVLTQSPATLSVSPGERVTLTCRASQSVGNDVAWYQQKPGQAPRLLCNYASHRYTGVPDRFTCSGYGTEFTLTISSVQSEDFAVYYCQQDFSSPRTFGGGTKVEIKGKPGSGKPGSGKPGSGKPGSEVQLVESGGGLVKPGGSLRLSCVASGFTFSNYWMNWVRQAPGKGLEWVAEIRLYSNNYATHYAESVKGRFTISRDDSKSTLYLQMNNLKTEDTGVYYCTRYYGNYGGYFDVWGQGTLVTVSS

SEQ ID NO: 15899 - protein, 107 aa, Artificial Sequence; identical to SEQ ID NO: 15684
  Description of Artificial Sequence: Synthetic polypeptide
  VH of XENP019653

SEQ ID NO: 15900 - protein, 122 aa, Artificial Sequence; identical to SEQ ID NO: 15521
  Description of Artificial Sequence: Synthetic polypeptide
  VL of XENP019653

SEQ ID NO: 15901 - protein, 11 aa, Artificial Sequence
  Description of Artificial Sequence: Synthetic peptide
  XENP019653 vhCDR1
RASQSVGNDVA

SEQ ID NO: 15902 - protein, 9 aa, Artificial Sequence
  Description of Artificial Sequence: Synthetic peptide
  XENP019653 vhCDR2
CNYASHRYT

SEQ ID NO: 15903 - protein, 9 aa, Artificial Sequence
  Description of Artificial Sequence: Synthetic peptide
  XENP019653 vhCDR3
QQDFSSPRT

SEQ ID NO: 15904 - protein, 5 aa, Artificial Sequence
  Description of Artificial Sequence: Synthetic peptide
  XENP019653 vlCDR1
NYWMN

SEQ ID NO: 15905 - protein, 19 aa, Artificial Sequence
  Description of Artificial Sequence: Synthetic peptide
  XENP019653 vlCDR2
EIRLYSNNYATHYAESVKG

SEQ ID NO: 15906 - protein, 11 aa, Artificial Sequence
  Description of Artificial Sequence: Synthetic peptide
  XENP019653 vlCDR3
YYGNYGGYFDV

SEQ ID NO: 15907 - protein, 249 aa, Artificial Sequence
  Description of Artificial Sequence: Synthetic polypeptide
  XENP019654 1G6_L1.196_H1.278_scFv(GKPGS)4
EIVLTQSPATLSASPGERVTLTCRASQSVGNDVAWYQQKPGQAPRLLCNYASHRYTGVPDRFTCSGYGTEFTLTISSVQSEDFGVYYCQQDFSSPRTFGGGTKVEIKGKPGSGKPGSGKPGSGKPGSEVQLVESGGGLVKPGGSLRLSCVASGFTFSNYWMNWVRQAPGKGLEWVAEIRLYSNNYATHYAESVKGRFTISRDDSKSTLYLQMNNLKTEDTGVYYCTRYYGNYGGYFDVWGQGTLVTVSS

SEQ ID NO: 15908 - protein, 107 aa, Artificial Sequence; identical to SEQ ID NO: 15693
  Description of Artificial Sequence: Synthetic polypeptide
  VH of XENP019654

SEQ ID NO: 15909 - protein, 122 aa, Artificial Sequence; identical to SEQ ID NO: 15521
  Description of Artificial Sequence: Synthetic polypeptide
  VL of XENP019654

SEQ ID NO: 15910 - protein, 11 aa, Artificial Sequence
  Description of Artificial Sequence: Synthetic peptide
  XENP019654 vhCDR1
RASQSVGNDVA

SEQ ID NO: 15911 - protein, 9 aa, Artificial Sequence
  Description of Artificial Sequence: Synthetic peptide
  XENP019654 vhCDR2
CNYASHRYT

SEQ ID NO: 15912 - protein, 9 aa, Artificial Sequence
  Description of Artificial Sequence: Synthetic peptide
  XENP019654 vhCDR3
QQDFSSPRT

SEQ ID NO: 15913 - protein, 5 aa, Artificial Sequence
  Description of Artificial Sequence: Synthetic peptide
  XENP019654 vlCDR1
NYWMN

SEQ ID NO: 15914 - protein, 19 aa, Artificial Sequence
  Description of Artificial Sequence: Synthetic peptide
  XENP019654 vlCDR2
EIRLYSNNYATHYAESVKG

SEQ ID NO: 15915 - protein, 11 aa, Artificial Sequence
  Description of Artificial Sequence: Synthetic peptide
  XENP019654 vlCDR3
YYGNYGGYFDV

SEQ ID NO: 15916 - protein, 249 aa, Artificial Sequence
  Description of Artificial Sequence: Synthetic polypeptide
  XENP019655 1G6_L1.197_H1.278_scFv(GKPGS)4
EIVLTQSPATLSASPGERVTLTCRASQSVGNDVAWYQQKPGQAPRLLCNYASHRYTSVPDRFTCSGYGTEFTLTISSVQSEDFGVYYCQQDFSSPRTFGGGTKVEIKGKPGSGKPGSGKPGSGKPGSEVQLVESGGGLVKPGGSLRLSCVASGFTFSNYWMNWVRQAPGKGLEWVAEIRLYSNNYATHYAESVKGRFTISRDDSKSTLYLQMNNLKTEDTGVYYCTRYYGNYGGYFDVWGQGTLVTVSS

SEQ ID NO: 15917 - protein, 107 aa, Artificial Sequence; identical to SEQ ID NO: 15702
  Description of Artificial Sequence: Synthetic polypeptide
  VH of XENP019655

SEQ ID NO: 15918 - protein, 122 aa, Artificial Sequence; identical to SEQ ID NO: 15521
  Description of Artificial Sequence: Synthetic polypeptide
  VL of XENP019655

SEQ ID NO: 15919 - protein, 11 aa, Artificial Sequence
  Description of Artificial Sequence: Synthetic peptide
  XENP019655 vhCDR1
RASQSVGNDVA

SEQ ID NO: 15920 - protein, 9 aa, Artificial Sequence
  Description of Artificial Sequence: Synthetic peptide
  XENP019655 vhCDR2
CNYASHRYT

SEQ ID NO: 15921 - protein, 9 aa, Artificial Sequence
  Description of Artificial Sequence: Synthetic peptide
  XENP019655 vhCDR3
QQDFSSPRT

SEQ ID NO: 15922 - protein, 5 aa, Artificial Sequence
  Description of Artificial Sequence: Synthetic peptide
  XENP019655 vlCDR1
NYWMN

SEQ ID NO: 15923 - protein, 19 aa, Artificial Sequence
  Description of Artificial Sequence: Synthetic peptide
  XENP019655 vlCDR2
EIRLYSNNYATHYAESVKG

SEQ ID NO: 15924 - protein, 11 aa, Artificial Sequence
  Description of Artificial Sequence: Synthetic peptide
  XENP019655 vlCDR3
YYGNYGGYFDV

SEQ ID NO: 15925 - protein, 249 aa, Artificial Sequence
  Description of Artificial Sequence: Synthetic polypeptide
  XENP019656 1G6_H1.278_L1.189_scFv_linkerV1
EVQLVESGGGLVKPGGSLRLSCVASGFTFSNYWMNWVRQAPGKGLEWVAEIRLYSNNYATHYAESVKGRFTISRDDSKSTLYLQMNNLKTEDTGVYYCTRYYGNYGGYFDVWGQGTLVTVSSGKPGSGKPGSGKPGSGGGGSEIVLTQSPATLSVSPGERVTLTCRASQSVGNDVAWYQQKPGQAPRLLINYASHRYTGVPDRFTGSGYGTEFTLTISSVQSEDFAVYYCQQDFSSPRTFGGGTKVEIK

SEQ ID NO: 15926 - protein, 122 aa, Artificial Sequence; identical to SEQ ID NO: 15521
  Description of Artificial Sequence: Synthetic polypeptide
  VH of XENP019656

SEQ ID NO: 15927 - protein, 107 aa, Artificial Sequence; identical to SEQ ID NO: 15540
  Description of Artificial Sequence: Synthetic polypeptide
  VL of XENP019656

SEQ ID NO: 15928 - protein, 5 aa, Artificial Sequence
  Description of Artificial Sequence: Synthetic peptide
  XENP019656 vhCDR1
NYWMN

SEQ ID NO: 15929 - protein, 19 aa, Artificial Sequence
  Description of Artificial Sequence: Synthetic peptide
  XENP019656 vhCDR2
EIRLYSNNYATHYAESVKG

SEQ ID NO: 15930 - protein, 11 aa, Artificial Sequence
  Description of Artificial Sequence: Synthetic peptide
  XENP019656 vhCDR3
YYGNYGGYFDV

SEQ ID NO: 15931 - protein, 11 aa, Artificial Sequence
  Description of Artificial Sequence: Synthetic peptide
  XENP019656 vlCDR1
RASQSVGNDVA

SEQ ID NO: 15932 - protein, 7 aa, Artificial Sequence
  Description of Artificial Sequence: Synthetic peptide
  XENP019656 vlCDR2
YASHRYT

SEQ ID NO: 15933 - protein, 9 aa, Artificial Sequence
  Description of Artificial Sequence: Synthetic peptide
  XENP019656 vlCDR3
QQDFSSPRT

SEQ ID NO: 15934 - protein, 247 aa, Artificial Sequence
  Description of Artificial Sequence: Synthetic polypeptide
  XENP019657 1G6_H1.278_L1.189_scFv_linkerV2
EVQLVESGGGLVKPGGSLRLSCVASGFTFSNYWMNWVRQAPGKGLEWVAEIRLYSNNYATHYAESVKGRFTISRDDSKSTLYLQMNNLKTEDTGVYYCTRYYGNYGGYFDVWGQGTLVTVSSGKPGSGKPGSGKPGSGKPEIVLTQSPATLSVSPGERVTLTCRASQSVGNDVAWYQQKPGQAPRLLINYASHRYTGVPDRFTGSGYGTEFTLTISSVQSEDFAVYYCQQDFSSPRTFGGGTKVEIK

SEQ ID NO: 15935 - protein, 122 aa, Artificial Sequence; identical to SEQ ID NO: 15521
  Description of Artificial Sequence: Synthetic polypeptide
  VH of XENP019657

SEQ ID NO: 15936 - protein, 107 aa, Artificial Sequence; identical to SEQ ID NO: 15540
  Description of Artificial Sequence: Synthetic polypeptide
  VL of XENP019657

SEQ ID NO: 15937 - protein, 5 aa, Artificial Sequence
  Description of Artificial Sequence: Synthetic peptide
  XENP019657 vhCDR1
NYWMN

SEQ ID NO: 15938 - protein, 19 aa, Artificial Sequence
  Description of Artificial Sequence: Synthetic peptide
  XENP019657 vhCDR2
EIRLYSNNYATHYAESVKG

SEQ ID NO: 15939 - protein, 11 aa, Artificial Sequence
  Description of Artificial Sequence: Synthetic peptide
  XENP019657 vhCDR3
YYGNYGGYFDV

SEQ ID NO: 15940 - protein, 11 aa, Artificial Sequence
  Description of Artificial Sequence: Synthetic peptide
  XENP019657 vlCDR1
RASQSVGNDVA

SEQ ID NO: 15941 - protein, 7 aa, Artificial Sequence
  Description of Artificial Sequence: Synthetic peptide
  XENP019657 vlCDR2
YASHRYT

SEQ ID NO: 15942 - protein, 9 aa, Artificial Sequence
  Description of Artificial Sequence: Synthetic peptide
  XENP019657 vlCDR3
QQDFSSPRT

SEQ ID NO: 15943 - protein, 244 aa, Artificial Sequence
  Description of Artificial Sequence: Synthetic polypeptide
  XENP019658 1G6_H1.278_L1.189_scFv_linkerV3
EVQLVESGGGLVKPGGSLRLSCVASGFTFSNYWMNWVRQAPGKGLEWVAEIRLYSNNYATHYAESVKGRFTISRDDSKSTLYLQMNNLKTEDTGVYYCTRYYGNYGGYFDVWGQGTLVTVSSGKPGSGKPGSGKPGSEIVLTQSPATLSVSPGERVTLTCRASQSVGNDVAWYQQKPGQAPRLLINYASHRYTGVPDRFTGSGYGTEFTLTISSVQSEDFAVYYCQQDFSSPRTFGGGTKVEIK

SEQ ID NO: 15944 - protein, 122 aa, Artificial Sequence; identical to SEQ ID NO: 15521
  Description of Artificial Sequence: Synthetic polypeptide
  VH of XENP019658

SEQ ID NO: 15945 - protein, 107 aa, Artificial Sequence; identical to SEQ ID NO: 15540
  Description of Artificial Sequence: Synthetic polypeptide
  VL of XENP019658

SEQ ID NO: 15946 - protein, 5 aa, Artificial Sequence
  Description of Artificial Sequence: Synthetic peptide
  XENP019658 vhCDR1
NYWMN

SEQ ID NO: 15947 - protein, 19 aa, Artificial Sequence
  Description of Artificial Sequence: Synthetic peptide
  XENP019658 vhCDR2
EIRLYSNNYATHYAESVKG

SEQ ID NO: 15948 - protein, 11 aa, Artificial Sequence
  Description of Artificial Sequence: Synthetic peptide
  XENP019658 vhCDR3
YYGNYGGYFDV

SEQ ID NO: 15949 - protein, 11 aa, Artificial Sequence
  Description of Artificial Sequence: Synthetic peptide
  XENP019658 vlCDR1
RASQSVGNDVA

SEQ ID NO: 15950 - protein, 7 aa, Artificial Sequence
  Description of Artificial Sequence: Synthetic peptide
  XENP019658 vlCDR2
YASHRYT

SEQ ID NO: 15951 - protein, 9 aa, Artificial Sequence
  Description of Artificial Sequence: Synthetic peptide
  XENP019658 vlCDR3
QQDFSSPRT

SEQ ID NO: 15952 - protein, 251 aa, Artificial Sequence
  Description of Artificial Sequence: Synthetic polypeptide
  XENP019659 1G6_H1.278_L1.189_scFv_linkerV4
EVQLVESGGGLVKPGGSLRLSCVASGFTFSNYWMNWVRQAPGKGLEWVAEIRLYSNNYATHYAESVKGRFTISRDDSKSTLYLQMNNLKTEDTGVYYCTRYYGNYGGYFDVWGQGTLVTVSSGKPGSGKPGSGKPGSGKPGSGSEIVLTQSPATLSVSPGERVTLTCRASQSVGNDVAWYQQKPGQAPRLLINYASHRYTGVPDRFTGSGYGTEFTLTISSVQSEDFAVYYCQQDFSSPRTFGGGTKVEIK

SEQ ID NO: 15953 - protein, 122 aa, Artificial Sequence; identical to SEQ ID NO: 15521
  Description of Artificial Sequence: Synthetic polypeptide
  VH of XENP019659

SEQ ID NO: 15954 - protein, 107 aa, Artificial Sequence; identical to SEQ ID NO: 15540
  Description of Artificial Sequence: Synthetic polypeptide
  VL of XENP019659

SEQ ID NO: 15955 - protein, 5 aa, Artificial Sequence
  Description of Artificial Sequence: Synthetic peptide
  XENP019659 vhCDR1
NYWMN

SEQ ID NO: 15956 - protein, 19 aa, Artificial Sequence
  Description of Artificial Sequence: Synthetic peptide
  XENP019659 vhCDR2
EIRLYSNNYATHYAESVKG

SEQ ID NO: 15957 - protein, 11 aa, Artificial Sequence
  Description of Artificial Sequence: Synthetic peptide
  XENP019659 vhCDR3
YYGNYGGYFDV

SEQ ID NO: 15958 - protein, 11 aa, Artificial Sequence
  Description of Artificial Sequence: Synthetic peptide
  XENP019659 vlCDR1
RASQSVGNDVA

SEQ ID NO: 15959 - protein, 7 aa, Artificial Sequence
  Description of Artificial Sequence: Synthetic peptide
  XENP019659 vlCDR2
YASHRYT

SEQ ID NO: 15960 - protein, 9 aa, Artificial Sequence
  Description of Artificial Sequence: Synthetic peptide
  XENP019659 vlCDR3
QQDFSSPRT

SEQ ID NO: 15961 - protein, 252 aa, Artificial Sequence
  Description of Artificial Sequence: Synthetic polypeptide
  XENP019660 1G6_H1.278_L1.189_scFv_linkerV5
EVQLVESGGGLVKPGGSLRLSCVASGFTFSNYWMNWVRQAPGKGLEWVAEIRLYSNNYATHYAESVKGRFTISRDDSKSTLYLQMNNLKTEDTGVYYCTRYYGNYGGYFDVWGQGTLVTVSSGKPGSGKPGSGKPGSGKPGSGGSEIVLTQSPATLSVSPGERVTLTCRASQSVGNDVAWYQQKPGQAPRLLINYASHRYTGVPDRFTGSGYGTEFTLTISSVQSEDFAVYYCQQDFSSPRTFGGGTKVEIK

SEQ ID NO: 15962 - protein, 122 aa, Artificial Sequence; identical to SEQ ID NO: 15521
  Description of Artificial Sequence: Synthetic polypeptide
  VH of XENP019660

SEQ ID NO: 15963 - protein, 108 aa, Artificial Sequence
  Description of Artificial Sequence: Synthetic polypeptide
  VL of XENP019660
SEIVLTQSPATLSVSPGERVTLTCRASQSVGNDVAWYQQKPGQAPRLLINYASHRYTGVPDRFTGSGYGTEFTLTISSVQSEDFAVYYCQQDFSSPRTFGGGTKVEIK

SEQ ID NO: 15964 - protein, 5 aa, Artificial Sequence
  Description of Artificial Sequence: Synthetic peptide
  XENP019660 vhCDR1
NYWMN

SEQ ID NO: 15965 - protein, 19 aa, Artificial Sequence
  Description of Artificial Sequence: Synthetic peptide
  XENP019660 vhCDR2
EIRLYSNNYATHYAESVKG

SEQ ID NO: 15966 - protein, 11 aa, Artificial Sequence
  Description of Artificial Sequence: Synthetic peptide
  XENP019660 vhCDR3
YYGNYGGYFDV

SEQ ID NO: 15967 - protein, 11 aa, Artificial Sequence
  Description of Artificial Sequence: Synthetic peptide
  XENP019660 vlCDR1
RASQSVGNDVA

SEQ ID NO: 15968 - protein, 7 aa, Artificial Sequence
  Description of Artificial Sequence: Synthetic peptide
  XENP019660 vlCDR2
YASHRYT

SEQ ID NO: 15969 - protein, 9 aa, Artificial Sequence
  Description of Artificial Sequence: Synthetic peptide
  XENP019660 vlCDR3
QQDFSSPRT

SEQ ID NO: 15970 - protein, 253 aa, Artificial Sequence
  Description of Artificial Sequence: Synthetic polypeptide
  XENP019661 1G6_H1.278_L1.189_scFv_linkerV6
EVQLVESGGGLVKPGGSLRLSCVASGFTFSNYWMNWVRQAPGKGLEWVAEIRLYSNNYATHYAESVKGRFTISRDDSKSTLYLQMNNLKTEDTGVYYCTRYYGNYGGYFDVWGQGTLVTVSSGKPGSGKPGSGKPGSGKPGSGGGSEIVLTQSPATLSVSPGERVTLTCRASQSVGNDVAWYQQKPGQAPRLLINYASHRYTGVPDRFTGSGYGTEFTLTISSVQSEDFAVYYCQQDFSSPRTFGGGTKVEIK

SEQ ID NO: 15971 - protein, 122 aa, Artificial Sequence; identical to SEQ ID NO: 15521
  Description of Artificial Sequence: Synthetic polypeptide
  VH of XENP019661

SEQ ID NO: 15972 - protein, 107 aa, Artificial Sequence; identical to SEQ ID NO: 15540
  Description of Artificial Sequence: Synthetic polypeptide
  VL of XENP019661

SEQ ID NO: 15973 - protein, 5 aa, Artificial Sequence
  Description of Artificial Sequence: Synthetic peptide
  XENP019661 vhCDR1
NYWMN

SEQ ID NO: 15974 - protein, 19 aa, Artificial Sequence
  Description of Artificial Sequence: Synthetic peptide
  XENP019661 vhCDR2
EIRLYSNNYATHYAESVKG

SEQ ID NO: 15975 - protein, 11 aa, Artificial Sequence
  Description of Artificial Sequence: Synthetic peptide
  XENP019661 vhCDR3
YYGNYGGYFDV

SEQ ID NO: 15976 - protein, 11 aa, Artificial Sequence
  Description of Artificial Sequence: Synthetic peptide
  XENP019661 vlCDR1
RASQSVGNDVA

SEQ ID NO: 15977 - protein, 7 aa, Artificial Sequence
  Description of Artificial Sequence: Synthetic peptide
  XENP019661 vlCDR2
YASHRYT

SEQ ID NO: 15978 - protein, 9 aa, Artificial Sequence
  Description of Artificial Sequence: Synthetic peptide
  XENP019661 vlCDR3
QQDFSSPRT

SEQ ID NO: 15979 - protein, 254 aa, Artificial Sequence
  Description of Artificial Sequence: Synthetic polypeptide
  XENP019662 1G6_H1.278_L1.189_scFv_linkerV7
EVQLVESGGGLVKPGGSLRLSCVASGFTFSNYWMNWVRQAPGKGLEWVAEIRLYSNNYATHYAESVKGRFTISRDDSKSTLYLQMNNLKTEDTGVYYCTRYYGNYGGYFDVWGQGTLVTVSSGKPGSGKPGSGKPGSGKPGSGGGGSEIVLTQSPATLSVSPGERVTLTCRASQSVGNDVAWYQQKPGQAPRLLINYASHRYTGVPDRFTGSGYGTEFTLTISSVQSEDFAVYYCQQDFSSPRTFGGGTKVEIK

SEQ ID NO: 15980 - protein, 122 aa, Artificial Sequence; identical to SEQ ID NO: 15521
  Description of Artificial Sequence: Synthetic polypeptide
  VH of XENP019662

SEQ ID NO: 15981 - protein, 107 aa, Artificial Sequence; identical to SEQ ID NO: 15540
  Description of Artificial Sequence: Synthetic polypeptide
  VL of XENP019662

SEQ ID NO: 15982 - protein, 5 aa, Artificial Sequence
  Description of Artificial Sequence: Synthetic peptide
  XENP019662 vhCDR1
NYWMN

SEQ ID NO: 15983 - protein, 19 aa, Artificial Sequence
  Description of Artificial Sequence: Synthetic peptide
  XENP019662 vhCDR2
EIRLYSNNYATHYAESVKG

SEQ ID NO: 15984 - protein, 11 aa, Artificial Sequence
  Description of Artificial Sequence: Synthetic peptide
  XENP019662 vhCDR3
YYGNYGGYFDV

SEQ ID NO: 15985 - protein, 11 aa, Artificial Sequence
  Description of Artificial Sequence: Synthetic peptide
  XENP019662 vlCDR1
RASQSVGNDVA

SEQ ID NO: 15986 - protein, 7 aa, Artificial Sequence
  Description of Artificial Sequence: Synthetic peptide
  XENP019662 vlCDR2
YASHRYT

SEQ ID NO: 15987 - protein, 9 aa, Artificial Sequence
  Description of Artificial Sequence: Synthetic peptide
  XENP019662 vlCDR3
QQDFSSPRT

SEQ ID NO: 15988 - protein, 242 aa, Artificial Sequence
  Description of Artificial Sequence: Synthetic polypeptide
  XENP019663 1G6_H1.278_L1.189_scFv_linkerV8
EVQLVESGGGLVKPGGSLRLSCVASGFTFSNYWMNWVRQAPGKGLEWVAEIRLYSNNYATHYAESVKGRFTISRDDSKSTLYLQMNNLKTEDTGVYYCTRYYGNYGGYFDVWGQGTLVTVSSGKPGSGKPGSGKPEIVLTQSPATLSVSPGERVTLTCRASQSVGNDVAWYQQKPGQAPRLLINYASHRYTGVPDRFTGSGYGTEFTLTISSVQSEDFAVYYCQQDFSSPRTFGGGTKVEIK

SEQ ID NO: 15989 - protein, 122 aa, Artificial Sequence; identical to SEQ ID NO: 15521
  Description of Artificial Sequence: Synthetic polypeptide
  VH of XENP019663

SEQ ID NO: 15990 - protein, 107 aa, Artificial Sequence; identical to SEQ ID NO: 15540
  Description of Artificial Sequence: Synthetic polypeptide
  VL of XENP019663

SEQ ID NO: 15991 - protein, 5 aa, Artificial Sequence
  Description of Artificial Sequence: Synthetic peptide
  XENP019663 vhCDR1
NYWMN

SEQ ID NO: 15992 - protein, 19 aa, Artificial Sequence
  Description of Artificial Sequence: Synthetic peptide
  XENP019663 vhCDR2
EIRLYSNNYATHYAESVKG

SEQ ID NO: 15993 - protein, 11 aa, Artificial Sequence
  Description of Artificial Sequence: Synthetic peptide
  XENP019663 vhCDR3
YYGNYGGYFDV

SEQ ID NO: 15994 - protein, 11 aa, Artificial Sequence
  Description of Artificial Sequence: Synthetic peptide
  XENP019663 vlCDR1
RASQSVGNDVA

SEQ ID NO: 15995 - protein, 7 aa, Artificial Sequence
  Description of Artificial Sequence: Synthetic peptide
  XENP019663 vlCDR2
YASHRYT

SEQ ID NO: 15996 - protein, 9 aa, Artificial Sequence
  Description of Artificial Sequence: Synthetic peptide
  XENP019663 vlCDR3
QQDFSSPRT

SEQ ID NO: 15997 - protein, 249 aa, Artificial Sequence
  Description of Artificial Sequence: Synthetic polypeptide
  XENP019664 1G6_H1.287_L1.209_scFv(GKPGS)4
EVQLVESGGGLVKPGGSLRLSCVASGFTFSNYWMNWVRQAPGKCLEWVAEIRLYSNNYATHYAESVKGRFTISRDDSKSTLYLQMNNLKTEDTGVYYCTRYYGNYGGYFDVWGQGTLVTVSSGKPGSGKPGSGKPGSGKPGSEIVLTQSPATLSVSPGERVTLTCRASQSVGNDVAWYQQKPGQAPRLLINYASHRYTGVPDRFTGSGYGTEFTLTISSVQSEDFAVYYCQQDFSSPRTFGCGTKVEIK

SEQ ID NO: 15998 - protein, 122 aa, Artificial Sequence
  Description of Artificial Sequence: Synthetic polypeptide
  VH of XENP019664
EVQLVESGGGLVKPGGSLRLSCVASGFTFSNYWMNWVRQAPGKCLEWVAEIRLYSNNYATHYAESVKGRFTISRDDSKSTLYLQMNNLKTEDTGVYYCTRYYGNYGGYFDVWGQGTLVTVSS

SEQ ID NO: 15999 - protein, 107 aa, Artificial Sequence
  Description of Artificial Sequence: Synthetic polypeptide
  VL of XENP019664
EIVLTQSPATLSVSPGERVTLTCRASQSVGNDVAWYQQKPGQAPRLLINYASHRYTGVPDRFTGSGYGTEFTLTISSVQSEDFAVYYCQQDFSSPRTFGCGTKVEIK

SEQ ID NO: 16000 - protein, 5 aa, Artificial Sequence
  Description of Artificial Sequence: Synthetic peptide
  XENP019664 vhCDR1
NYWMN

SEQ ID NO: 16001 - protein, 19 aa, Artificial Sequence
  Description of Artificial Sequence: Synthetic peptide
  XENP019664 vhCDR2
EIRLYSNNYATHYAESVKG

SEQ ID NO: 16002 - protein, 11 aa, Artificial Sequence
  Description of Artificial Sequence: Synthetic peptide
  XENP019664 vhCDR3
YYGNYGGYFDV

SEQ ID NO: 16003 - protein, 11 aa, Artificial Sequence
  Description of Artificial Sequence: Synthetic peptide
  XENP019664 vlCDR1
RASQSVGNDVA

SEQ ID NO: 16004 - protein, 7 aa, Artificial Sequence
  Description of Artificial Sequence: Synthetic peptide
  XENP019664 vlCDR2
YASHRYT

SEQ ID NO: 16005 - protein, 9 aa, Artificial Sequence
  Description of Artificial Sequence: Synthetic peptide
  XENP019664 vlCDR3
QQDFSSPRT

SEQ ID NO: 16006 - protein, 249 aa, Artificial Sequence
  Description of Artificial Sequence: Synthetic polypeptide
  XENP019665 1G6_L1.209_H1.287_scFv(GKPGS)4
EIVLTQSPATLSVSPGERVTLTCRASQSVGNDVAWYQQKPGQAPRLLINYASHRYTGVPDRFTGSGYGTEFTLTISSVQSEDFAVYYCQQDFSSPRTFGCGTKVEIKGKPGSGKPGSGKPGSGKPGSEVQLVESGGGLVKPGGSLRLSCVASGFTFSNYWMNWVRQAPGKCLEWVAEIRLYSNNYATHYAESVKGRFTISRDDSKSTLYLQMNNLKTEDTGVYYCTRYYGNYGGYFDVWGQGTLVTVSS

SEQ ID NO: 16007 - protein, 107 aa, Artificial Sequence; identical to SEQ ID NO: 15999
  Description of Artificial Sequence: Synthetic polypeptide
  VH of XENP019665

SEQ ID NO: 16008 - protein, 122 aa, Artificial Sequence; identical to SEQ ID NO: 15998
  Description of Artificial Sequence: Synthetic polypeptide
  VL of XENP019665

SEQ ID NO: 16009 - protein, 11 aa, Artificial Sequence
  Description of Artificial Sequence: Synthetic peptide
  XENP019665 vhCDR1
RASQSVGNDVA

SEQ ID NO: 16010 - protein, 7 aa, Artificial Sequence
  Description of Artificial Sequence: Synthetic peptide
  XENP019665 vhCDR2
YASHRYT

SEQ ID NO: 16011 - protein, 9 aa, Artificial Sequence
  Description of Artificial Sequence: Synthetic peptide
  XENP019665 vhCDR3
QQDFSSPRT

SEQ ID NO: 16012 - protein, 5 aa, Artificial Sequence
  Description of Artificial Sequence: Synthetic peptide
  XENP019665 vlCDR1
NYWMN

SEQ ID NO: 16013 - protein, 19 aa, Artificial Sequence
  Description of Artificial Sequence: Synthetic peptide
  XENP019665 vlCDR2
EIRLYSNNYATHYAESVKG

SEQ ID NO: 16014 - protein, 11 aa, Artificial Sequence
  Description of Artificial Sequence: Synthetic peptide
  XENP019665 vlCDR3
YYGNYGGYFDV

SEQ ID NO: 16015 - protein, 249 aa, Artificial Sequence
  Description of Artificial Sequence: Synthetic polypeptide
  XENP019666 1G6_H1.284_L1.194_scFv(GKPGS)4
EVQLVESGGGLVKPGGSLRLSCVASGFTFSNYWMNWVRQAPGKGLEWVCEIRLYSNNYATHYAESVKGRFTCSRDDSKSTLYLQMNNLKTEDTGVYYCTRYYGNYGGYFDVWGRGTLVTVSSGKPGSGKPGSGKPGSGKPGSEIVLTQSPATLSASPGERVTLTCRASQSVGNDVAWYQQKPGQAPRLLINYASHRYTGVPDRFTGSGYGTEFTLTISSVQSEDFGVYYCQQDFSSPRTFGGGTKVEIK

SEQ ID NO: 16016 - protein, 122 aa, Artificial Sequence; identical to SEQ ID NO: 15629
  Description of Artificial Sequence: Synthetic polypeptide
  VH of XENP019666

SEQ ID NO: 16017 - protein, 107 aa, Artificial Sequence; identical to SEQ ID NO: 2871
  Description of Artificial Sequence: Synthetic polypeptide
  VL of XENP019666

SEQ ID NO: 16018 - protein, 5 aa, Artificial Sequence
  Description of Artificial Sequence: Synthetic peptide
  XENP019666 vhCDR1
NYWMN

SEQ ID NO: 16019 - protein, 19 aa, Artificial Sequence
  Description of Artificial Sequence: Synthetic peptide
  XENP019666 vhCDR2
EIRLYSNNYATHYAESVKG

SEQ ID NO: 16020 - protein, 11 aa, Artificial Sequence
  Description of Artificial Sequence: Synthetic peptide
  XENP019666 vhCDR3
YYGNYGGYFDV

SEQ ID NO: 16021 - protein, 11 aa, Artificial Sequence
  Description of Artificial Sequence: Synthetic peptide
  XENP019666 vlCDR1
RASQSVGNDVA

SEQ ID NO: 16022 - protein, 7 aa, Artificial Sequence
  Description of Artificial Sequence: Synthetic peptide
  XENP019666 vlCDR2
YASHRYT

SEQ ID NO: 16023 - protein, 9 aa, Artificial Sequence
  Description of Artificial Sequence: Synthetic peptide
  XENP019666 vlCDR3
QQDFSSPRT

SEQ ID NO: 16024 - protein, 249 aa, Artificial Sequence
  Description of Artificial Sequence: Synthetic polypeptide
  XENP019667 1G6_L1.194_H1.284_scFv(GKPGS)4
EIVLTQSPATLSASPGERVTLTCRASQSVGNDVAWYQQKPGQAPRLLINYASHRYTGVPDRFTGSGYGTEFTLTISSVQSEDFGVYYCQQDFSSPRTFGGGTKVEIKGKPGSGKPGSGKPGSGKPGSEVQLVESGGGLVKPGGSLRLSCVASGFTFSNYWMNWVRQAPGKGLEWVCEIRLYSNNYATHYAESVKGRFTCSRDDSKSTLYLQMNNLKTEDTGVYYCTRYYGNYGGYFDVWGRGTLVTVSS

SEQ ID NO: 16025 - protein, 107 aa, Artificial Sequence; identical to SEQ ID NO: 2871
  Description of Artificial Sequence: Synthetic polypeptide
  VH of XENP019667

SEQ ID NO: 16026 - protein, 122 aa, Artificial Sequence; identical to SEQ ID NO: 15629
  Description of Artificial Sequence: Synthetic polypeptide
  VL of XENP019667

SEQ ID NO: 16027 - protein, 11 aa, Artificial Sequence
  Description of Artificial Sequence: Synthetic peptide
  XENP019667 vhCDR1
RASQSVGNDVA

SEQ ID NO: 16028 - protein, 7 aa, Artificial Sequence
  Description of Artificial Sequence: Synthetic peptide
  XENP019667 vhCDR2
YASHRYT

SEQ ID NO: 16029 - protein, 9 aa, Artificial Sequence
  Description of Artificial Sequence: Synthetic peptide
  XENP019667 vhCDR3
QQDFSSPRT

SEQ ID NO: 16030 - protein, 5 aa, Artificial Sequence
  Description of Artificial Sequence: Synthetic peptide
  XENP019667 vlCDR1
NYWMN

SEQ ID NO: 16031 - protein, 19 aa, Artificial Sequence
  Description of Artificial Sequence: Synthetic peptide
  XENP019667 vlCDR2
EIRLYSNNYATHYAESVKG

SEQ ID NO: 16032 - protein, 11 aa, Artificial Sequence
  Description of Artificial Sequence: Synthetic peptide
  XENP019667 vlCDR3
YYGNYGGYFDV

SEQ ID NO: 16033 - protein, 249 aa, Artificial Sequence
  Description of Artificial Sequence: Synthetic polypeptide
  XENP019668 1G6_H1.288_L1.210_scFv(GKPGS)4
EVQLVESGGGLVKPGGSLRLSCVASGFTFSNYWMNWVRQAPGKCLEWVAEIRLYSNNYATHYAESVKGRFTISRDDSKSTLYLQMNNLKTEDTGVYYCTRYYGNYGGYFDVWGRGTLVTVSSGKPGSGKPGSGKPGSGKPGSEIVLTQSPATLSASPGERVTLTCRASQSVGNDVAWYQQKPGQAPRLLINYASHRYTGVPDRFTGSGYGTEFTLTISSVQSEDFGVYYCQQDFSSPRTFGCGTKVEIK

SEQ ID NO: 16034 - protein, 122 aa, Artificial Sequence
  Description of Artificial Sequence: Synthetic polypeptide
  VH of XENP019668
EVQLVESGGGLVKPGGSLRLSCVASGFTFSNYWMNWVRQAPGKCLEWVAEIRLYSNNYATHYAESVKGRFTISRDDSKSTLYLQMNNLKTEDTGVYYCTRYYGNYGGYFDVWGRGTLVTVSS

SEQ ID NO: 16035 - protein, 107 aa, Artificial Sequence
  Description of Artificial Sequence: Synthetic polypeptide
  VL of XENP019668
EIVLTQSPATLSASPGERVTLTCRASQSVGNDVAWYQQKPGQAPRLLINYASHRYTGVPDRFTGSGYGTEFTLTISSVQSEDFGVYYCQQDFSSPRTFGCGTKVEIK

SEQ ID NO: 16036 - protein, 5 aa, Artificial Sequence
  Description of Artificial Sequence: Synthetic peptide
  XENP019668 vhCDR1
NYWMN

SEQ ID NO: 16037 - protein, 19 aa, Artificial Sequence
  Description of Artificial Sequence: Synthetic peptide
  XENP019668 vhCDR2
EIRLYSNNYATHYAESVKG

SEQ ID NO: 16038 - protein, 11 aa, Artificial Sequence
  Description of Artificial Sequence: Synthetic peptide
  XENP019668 vhCDR3
YYGNYGGYFDV

SEQ ID NO: 16039 - protein, 11 aa, Artificial Sequence
  Description of Artificial Sequence: Synthetic peptide
  XENP019668 vlCDR1
RASQSVGNDVA

SEQ ID NO: 16040 - protein, 7 aa, Artificial Sequence
  Description of Artificial Sequence: Synthetic peptide
  XENP019668 vlCDR2
YASHRYT

SEQ ID NO: 16041 - protein, 9 aa, Artificial Sequence
  Description of Artificial Sequence: Synthetic peptide
  XENP019668 vlCDR3
QQDFSSPRT

SEQ ID NO: 16042 - protein, 249 aa, Artificial Sequence
  Description of Artificial Sequence: Synthetic polypeptide
  XENP019669 1G6_L1.210_H1.288_scFv(GKPGS)4
EIVLTQSPATLSASPGERVTLTCRASQSVGNDVAWYQQKPGQAPRLLINYASHRYTGVPDRFTGSGYGTEFTLTISSVQSEDFGVYYCQQDFSSPRTFGCGTKVEIKGKPGSGKPGSGKPGSGKPGSEVQLVESGGGLVKPGGSLRLSCVASGFTFSNYWMNWVRQAPGKCLEWVAEIRLYSNNYATHYAESVKGRFTISRDDSKSTLYLQMNNLKTEDTGVYYCTRYYGNYGGYFDVWGRGTLVTVSS

SEQ ID NO: 16043 - protein, 107 aa, Artificial Sequence; identical to SEQ ID NO: 16035
  Description of Artificial Sequence: Synthetic polypeptide
  VH of XENP019669

SEQ ID NO: 16044 - protein, 122 aa, Artificial Sequence; identical to SEQ ID NO: 16034
  Description of Artificial Sequence: Synthetic polypeptide
  VL of XENP019669

SEQ ID NO: 16045 - protein, 11 aa, Artificial Sequence
  Description of Artificial Sequence: Synthetic peptide
  XENP019669 vhCDR1
RASQSVGNDVA

SEQ ID NO: 16046 - protein, 7 aa, Artificial Sequence
  Description of Artificial Sequence: Synthetic peptide
  XENP019669 vhCDR2
YASHRYT

SEQ ID NO: 16047 - protein, 9 aa, Artificial Sequence
  Description of Artificial Sequence: Synthetic peptide
  XENP019669 vhCDR3
QQDFSSPRT

SEQ ID NO: 16048 - protein, 5 aa, Artificial Sequence
  Description of Artificial Sequence: Synthetic peptide
  XENP019669 vlCDR1
NYWMN

SEQ ID NO: 16049 - protein, 19 aa, Artificial Sequence
  Description of Artificial Sequence: Synthetic peptide
  XENP019669 vlCDR2
EIRLYSNNYATHYAESVKG

SEQ ID NO: 16050 - protein, 11 aa, Artificial Sequence
  Description of Artificial Sequence: Synthetic peptide
  XENP019669 vlCDR3
YYGNYGGYFDV

SEQ ID NO: 16051 - protein, 249 aa, Artificial Sequence
  Description of Artificial Sequence: Synthetic polypeptide
  XENP019690 1G6_H1.279_L1.194_scFv(GKPGS)4
EVQLVESGGGLVKPGGSLRLSCVASGFTFSNYWMNWVRQAPGKGLEWVAEIRLYSNNYATHYAESVKGRFTISRDDSKSTLYLQMNNLKTEDTGVYYCTRYYGNYGGYFDVWGRGTLVTVSSGKPGSGKPGSGKPGSGKPGSEIVLTQSPATLSASPGERVTLTCRASQSVGNDVAWYQQKPGQAPRLLINYASHRYTGVPDRFTGSGYGTEFTLTISSVQSEDFGVYYCQQDFSSPRTFGGGTKVEIK

SEQ ID NO: 16052 - protein, 122 aa, Artificial Sequence; identical to SEQ ID NO: 2872
  Description of Artificial Sequence: Synthetic polypeptide
  VH of XENP019690

SEQ ID NO: 16053 - protein, 107 aa, Artificial Sequence; identical to SEQ ID NO: 2871
  Description of Artificial Sequence: Synthetic polypeptide
  VL of XENP019690

SEQ ID NO: 16054 - protein, 5 aa, Artificial Sequence
  Description of Artificial Sequence: Synthetic peptide
  XENP019690 vhCDR1
NYWMN

SEQ ID NO: 16055 - protein, 19 aa, Artificial Sequence
  Description of Artificial Sequence: Synthetic peptide
  XENP019690 vhCDR2
EIRLYSNNYATHYAESVKG

SEQ ID NO: 16056 - protein, 11 aa, Artificial Sequence
  Description of Artificial Sequence: Synthetic peptide
  XENP019690 vhCDR3
YYGNYGGYFDV

SEQ ID NO: 16057 - protein, 11 aa, Artificial Sequence
  Description of Artificial Sequence: Synthetic peptide
  XENP019690 vlCDR1
RASQSVGNDVA

SEQ ID NO: 16058 - protein, 7 aa, Artificial Sequence
  Description of Artificial Sequence: Synthetic peptide
  XENP019690 vlCDR2
YASHRYT

SEQ ID NO: 16059 - protein, 9 aa, Artificial Sequence
  Description of Artificial Sequence: Synthetic peptide
  XENP019690 vlCDR3
QQDFSSPRT

SEQ ID NO: 16060 - protein, 249 aa, Artificial Sequence
  Description of Artificial Sequence: Synthetic polypeptide
  XENP019691 1G6_H1.282_L1.194_scFv(GKPGS)4
EVQLVESGGGLVKPGGSLRLTCVASGFTFSNYWMNWVRQAPGKGLEWVAEIRLYSNNYATHYAESVKGRFTISRDDSKSMLYLQMNNLKTEDTGVYYCTRYYGNYGGYFDVWGRGTLVTVSSGKPGSGKPGSGKPGSGKPGSEIVLTQSPATLSASPGERVTLTCRASQSVGNDVAWYQQKPGQAPRLLINYASHRYTGVPDRFTGSGYGTEFTLTISSVQSEDFGVYYCQQDFSSPRTFGGGTKVEIK

SEQ ID NO: 16061 - protein, 122 aa, Artificial Sequence; identical to SEQ ID NO: 15611
  Description of Artificial Sequence: Synthetic polypeptide
  VH of XENP019691

SEQ ID NO: 16062 - protein, 107 aa, Artificial Sequence; identical to SEQ ID NO: 2871
  Description of Artificial Sequence: Synthetic polypeptide
  VL of XENP019691

SEQ ID NO: 16063 - protein, 5 aa, Artificial Sequence
  Description of Artificial Sequence: Synthetic peptide
  XENP019691 vhCDR1
NYWMN

SEQ ID NO: 16064 - protein, 19 aa, Artificial Sequence
  Description of Artificial Sequence: Synthetic peptide
  XENP019691 vhCDR2
EIRLYSNNYATHYAESVKG

SEQ ID NO: 16065 - protein, 11 aa, Artificial Sequence
  Description of Artificial Sequence: Synthetic peptide
  XENP019691 vhCDR3
YYGNYGGYFDV

SEQ ID NO: 16066 - protein, 11 aa, Artificial Sequence
  Description of Artificial Sequence: Synthetic peptide
  XENP019691 vlCDR1
RASQSVGNDVA

SEQ ID NO: 16067 - protein, 7 aa, Artificial Sequence
  Description of Artificial Sequence: Synthetic peptide
  XENP019691 vlCDR2
YASHRYT

SEQ ID NO: 16068 - protein, 9 aa, Artificial Sequence
  Description of Artificial Sequence: Synthetic peptide
  XENP019691 vlCDR3
QQDFSSPRT

SEQ ID NO: 16069 - protein, 249 aa, Artificial Sequence
  Description of Artificial Sequence: Synthetic polypeptide
  XENP019692 1G6_L1.194_H1.279_scFv(GKPGS)4
EIVLTQSPATLSASPGERVTLTCRASQSVGNDVAWYQQKPGQAPRLLINYASHRYTGVPDRFTGSGYGTEFTLTISSVQSEDFGVYYCQQDFSSPRTFGGGTKVEIKGKPGSGKPGSGKPGSGKPGSEVQLVESGGGLVKPGGSLRLSCVASGFTFSNYWMNWVRQAPGKGLEWVAEIRLYSNNYATHYAESVKGRFTISRDDSKSTLYLQMNNLKTEDTGVYYCTRYYGNYGGYFDVWGRGTLVTVSS

SEQ ID NO: 16070 - protein, 107 aa, Artificial Sequence; identical to SEQ ID NO: 2871
  Description of Artificial Sequence: Synthetic polypeptide
  VH of XENP019692

SEQ ID NO: 16071 - protein, 122 aa, Artificial Sequence; identical to SEQ ID NO: 2872
  Description of Artificial Sequence: Synthetic polypeptide
  VL of XENP019692

SEQ ID NO: 16072 - protein, 11 aa, Artificial Sequence
  Description of Artificial Sequence: Synthetic peptide
  XENP019692 vhCDR1
RASQSVGNDVA

SEQ ID NO: 16073 - protein, 7 aa, Artificial Sequence
  Description of Artificial Sequence: Synthetic peptide
  XENP019692 vhCDR2
YASHRYT

SEQ ID NO: 16074 - protein, 9 aa, Artificial Sequence
  Description of Artificial Sequence: Synthetic peptide
  XENP019692 vhCDR3
QQDFSSPRT

SEQ ID NO: 16075 - protein, 5 aa, Artificial Sequence
  Description of Artificial Sequence: Synthetic peptide
  XENP019692 vlCDR1
NYWMN

SEQ ID NO: 16076 - protein, 19 aa, Artificial Sequence
  Description of Artificial Sequence: Synthetic peptide
  XENP019692 vlCDR2
EIRLYSNNYATHYAESVKG

SEQ ID NO: 16077 - protein, 11 aa, Artificial Sequence
  Description of Artificial Sequence: Synthetic peptide
  XENP019692 vlCDR3
YYGNYGGYFDV

SEQ ID NO: 16078 - protein, 249 aa, Artificial Sequence
  Description of Artificial Sequence: Synthetic polypeptide
  XENP019693 1G6_L1.194_H1.282_scFv(GKPGS)4
EIVLTQSPATLSASPGERVTLTCRASQSVGNDVAWYQQKPGQAPRLLINYASHRYTGVPDRFTGSGYGTEFTLTISSVQSEDFGVYYCQQDFSSPRTFGGGTKVEIKGKPGSGKPGSGKPGSGKPGSEVQLVESGGGLVKPGGSLRLTCVASGFTFSNYWMNWVRQAPGKGLEWVAEIRLYSNNYATHYAESVKGRFTISRDDSKSMLYLQMNNLKTEDTGVYYCTRYYGNYGGYFDVWGRGTLVTVSS

SEQ ID NO: 16079 - protein, 107 aa, Artificial Sequence; identical to SEQ ID NO: 2871
  Description of Artificial Sequence: Synthetic polypeptide
  VH of XENP019693

SEQ ID NO: 16080 - protein, 122 aa, Artificial Sequence; identical to SEQ ID NO: 15611
  Description of Artificial Sequence: Synthetic polypeptide
  VL of XENP019693

SEQ ID NO: 16081 - protein, 11 aa, Artificial Sequence
  Description of Artificial Sequence: Synthetic peptide
  XENP019693 vhCDR1
RASQSVGNDVA

SEQ ID NO: 16082 - protein, 7 aa, Artificial Sequence
  Description of Artificial Sequence: Synthetic peptide
  XENP019693 vhCDR2
YASHRYT

SEQ ID NO: 16083 - protein, 9 aa, Artificial Sequence
  Description of Artificial Sequence: Synthetic peptide
  XENP019693 vhCDR3
QQDFSSPRT

SEQ ID NO: 16084 - protein, 5 aa, Artificial Sequence
  Description of Artificial Sequence: Synthetic peptide
  XENP019693 vlCDR1
NYWMN

SEQ ID NO: 16085 - protein, 19 aa, Artificial Sequence
  Description of Artificial Sequence: Synthetic peptide
  XENP019693 vlCDR2
EIRLYSNNYATHYAESVKG

SEQ ID NO: 16086 - protein, 11 aa, Artificial Sequence
  Description of Artificial Sequence: Synthetic peptide
  XENP019693 vlCDR3
YYGNYGGYFDV

SEQ ID NO: 16087 - protein, 247 aa, Artificial Sequence
  Description of Artificial Sequence: Synthetic polypeptide
  XENP020162 2E9_H1L1_scFv(GKPGS)4
QVQLVQSGAEVKKPGASVKVSCKASGYAFTNYWLGWVRQAPGQGLEWMGNFYPGSSNTYYNEKFQGRVTMTADKSISTAYMELSRLRSDDTAVYFCARHYGTNYRYFDVWGAGTLVTVSSGKPGSGKPGSGKPGSGKPGSDIVLTQSPGTLSLSPGERATLSCRASQSVSNDVAWYQQKPGQSPRLLIYYASNRYTGVPDRFTGSGYGTDFTLTISRLEPEDFAVYFCQQDYSSPYTFGGGTKVEIK

SEQ ID NO: 16088 - protein, 120 aa, Artificial Sequence; identical to SEQ ID NO: 3091
  Description of Artificial Sequence: Synthetic polypeptide
  VH of XENP020162

SEQ ID NO: 16089 - protein, 107 aa, Artificial Sequence; identical to SEQ ID NO: 3092
  Description of Artificial Sequence: Synthetic polypeptide
  VL of XENP020162

SEQ ID NO: 16090 - protein, 5 aa, Artificial Sequence
  Description of Artificial Sequence: Synthetic peptide
  XENP020162 vhCDR1
NYWLG

SEQ ID NO: 16091 - protein, 17 aa, Artificial Sequence
  Description of Artificial Sequence: Synthetic peptide
  XENP020162 vhCDR2
NFYPGSSNTYYNEKFQG

SEQ ID NO: 16092 - protein, 11 aa, Artificial Sequence
  Description of Artificial Sequence: Synthetic peptide
  XENP020162 vhCDR3
HYGTNYRYFDV

SEQ ID NO: 16093 - protein, 11 aa, Artificial Sequence
  Description of Artificial Sequence: Synthetic peptide
  XENP020162 vlCDR1
RASQSVSNDVA

SEQ ID NO: 16094 - protein, 7 aa, Artificial Sequence
  Description of Artificial Sequence: Synthetic peptide
  XENP020162 vlCDR2
YASNRYT

SEQ ID NO: 16095 - protein, 9 aa, Artificial Sequence
  Description of Artificial Sequence: Synthetic peptide
  XENP020162 vlCDR3
QQDYSSPYT

SEQ ID NO: 16096 - protein, 247 aa, Artificial Sequence
  Description of Artificial Sequence: Synthetic polypeptide
  XENP020163 2E9_H2L1_scFv(GKPGS)4
EVQLVQSGAEVKKPGESLKISCKASGYAFTNYWLGWVRQMPGKGLEWMGNFYPGSSNTYYNPSFQGQVTISADKSISTAYLQWSSLKASDTAMYFCARHYGTNYRYFDVWGAGTLVTVSSGKPGSGKPGSGKPGSGKPGSDIVLTQSPGTLSLSPGERATLSCRASQSVSNDVAWYQQKPGQSPRLLIYYASNRYTGVPDRFTGSGYGTDFTLTISRLEPEDFAVYFCQQDYSSPYTFGGGTKVEIK

SEQ ID NO: 16097 - protein, 120 aa, Artificial Sequence
  Description of Artificial Sequence: Synthetic polypeptide
  VH of XENP020163
EVQLVQSGAEVKKPGESLKISCKASGYAFTNYWLGWVRQMPGKGLEWMGNFYPGSSNTYYNPSFQGQVTISADKSISTAYLQWSSLKASDTAMYFCARHYGTNYRYFDVWGAGTLVTVSS

SEQ ID NO: 16098 - protein, 107 aa, Artificial Sequence; identical to SEQ ID NO: 3092
  Description of Artificial Sequence: Synthetic polypeptide
  VL of XENP020163

SEQ ID NO: 16099 - protein, 5 aa, Artificial Sequence
  Description of Artificial Sequence: Synthetic peptide
  XENP020163 vhCDR1
NYWLG

SEQ ID NO: 16100 - protein, 17 aa, Artificial Sequence
  Description of Artificial Sequence: Synthetic peptide
  XENP020163 vhCDR2
NFYPGSSNTYYNPSFQG

SEQ ID NO: 16101 - protein, 11 aa, Artificial Sequence
  Description of Artificial Sequence: Synthetic peptide
  XENP020163 vhCDR3
HYGTNYRYFDV

SEQ ID NO: 16102 - protein, 11 aa, Artificial Sequence
  Description of Artificial Sequence: Synthetic peptide
  XENP020163 vlCDR1
RASQSVSNDVA

SEQ ID NO: 16103 - protein, 7 aa, Artificial Sequence
  Description of Artificial Sequence: Synthetic peptide
  XENP020163 vlCDR2
YASNRYT

SEQ ID NO: 16104 - protein, 9 aa, Artificial Sequence
  Description of Artificial Sequence: Synthetic peptide
  XENP020163 vlCDR3
QQDYSSPYT

SEQ ID NO: 16105 - protein, 242 aa, Artificial Sequence
  Description of Artificial Sequence: Synthetic polypeptide
  XENP020164 3C11(PD-1)_H1L1_scFv(GKPGS)4
QVQLVQSGAEVKKPGASVKVSCKASGYTFTSYWMHWVRQAPGQGLEWMGAIYPGNIATSYNQKFQGRVTMTADTSTSTAYMELSSLRSEDTAVYYCTTSYVMDYWGQGTLVTVSSGKPGSGKPGSGKPGSGKPGSDIVMTQSPSSLSASVGDRVTITCQASQDINSYLSWFQQKPGKSPKTLIYRANRLVDGVPSRFSGSGSGQDYTFTISSLQPEDIATYYCLQYDEFPYTFGGGTKVEIK

SEQ ID NO: 16106 - protein, 115 aa, Artificial Sequence
  Description of Artificial Sequence: Synthetic polypeptide
  VH of XENP020164
QVQLVQSGAEVKKPGASVKVSCKASGYTFTSYWMHWVRQAPGQGLEWMGAIYPGNIATSYNQKFQGRVTMTADTSTSTAYMELSSLRSEDTAVYYCTTSYVMDYWGQGTLVTVSS

SEQ ID NO: 16107 - protein, 107 aa, Artificial Sequence
  Description of Artificial Sequence: Synthetic polypeptide
  VL of XENP020164
DIVMTQSPSSLSASVGDRVTITCQASQDINSYLSWFQQKPGKSPKTLIYRANRLVDGVPSRFSGSGSGQDYTFTISSLQPEDIATYYCLQYDEFPYTFGGGTKVEIK

SEQ ID NO: 16108 - protein, 5 aa, Artificial Sequence
  Description of Artificial Sequence: Synthetic peptide
  XENP020164 vhCDR1
SYWMH

SEQ ID NO: 16109 - protein, 17 aa, Artificial Sequence
  Description of Artificial Sequence: Synthetic peptide
  XENP020164 vhCDR2
AIYPGNIATSYNQKFQG

SEQ ID NO: 16110 - protein, 6 aa, Artificial Sequence
  Description of Artificial Sequence: Synthetic peptide
  XENP020164 vhCDR3
SYVMDY

SEQ ID NO: 16111 - protein, 11 aa, Artificial Sequence
  Description of Artificial Sequence: Synthetic peptide
  XENP020164 vlCDR1
QASQDINSYLS

SEQ ID NO: 16112 - protein, 7 aa, Artificial Sequence
  Description of Artificial Sequence: Synthetic peptide
  XENP020164 vlCDR2
RANRLVD

SEQ ID NO: 16113 - protein, 9 aa, Artificial Sequence
  Description of Artificial Sequence: Synthetic peptide
  XENP020164 vlCDR3
LQYDEFPYT

SEQ ID NO: 16114 - protein, 239 aa, Artificial Sequence
  Description of Artificial Sequence: Synthetic polypeptide
  XENP020165 3G12_H1L1_scFv(GKPGS)4
QVQLVQSGAEVKKPGASVKVSCKASGYTFTSYWMHWVRQAPGQGLEWMGVIDPSDSYTSYNQKFQGRVTMTVDTSTSTAYMELSSLRSEDTAVYYCTGAYYWGQGTLVTVSSGKPGSGKPGSGKPGSGKPGSDIVLTQSPSSLSASVGDRVTITCRASQGISSNIGWLQQKPGKSFKGLIYHGTNLEDGVPSRFTGSGSGADYTLTISSLQPEDFATYYCVQYAQSPWTFGGGTKVEIK

SEQ ID NO: 16115 - protein, 112 aa, Artificial Sequence
  Description of Artificial Sequence: Synthetic polypeptide
  VH of XENP020165
QVQLVQSGAEVKKPGASVKVSCKASGYTFTSYWMHWVRQAPGQGLEWMGVIDPSDSYTSYNQKFQGRVTMTVDTSTSTAYMELSSLRSEDTAVYYCTGAYYWGQGTLVTVSS

SEQ ID NO: 16116 - protein, 107 aa, Artificial Sequence
  Description of Artificial Sequence: Synthetic polypeptide
  VL of XENP020165
DIVLTQSPSSLSASVGDRVTITCRASQGISSNIGWLQQKPGKSFKGLIYHGTNLEDGVPSRFTGSGSGADYTLTISSLQPEDFATYYCVQYAQSPWTFGGGTKVEIK

SEQ ID NO: 16117 - protein, 5 aa, Artificial Sequence
  Description of Artificial Sequence: Synthetic peptide
  XENP020165 vhCDR1
SYWMH

SEQ ID NO: 16118 - protein, 17 aa, Artificial Sequence
  Description of Artificial Sequence: Synthetic peptide
  XENP020165 vhCDR2
VIDPSDSYTSYNQKFQG

SEQ ID NO: 16119 - protein, 3 aa, Artificial Sequence
  Description of Artificial Sequence: Synthetic peptide
  XENP020165 vhCDR3
AYY

SEQ ID NO: 16120 - protein, 11 aa, Artificial Sequence
  Description of Artificial Sequence: Synthetic peptide
  XENP020165 vlCDR1
RASQGISSNIG

SEQ ID NO: 16121 - protein, 7 aa, Artificial Sequence
  Description of Artificial Sequence: Synthetic peptide
  XENP020165 vlCDR2
HGTNLED

SEQ ID NO: 16122 - protein, 9 aa, Artificial Sequence
  Description of Artificial Sequence: Synthetic peptide
  XENP020165 vlCDR3
VQYAQSPWT

SEQ ID NO: 16123 - protein, 239 aa, Artificial Sequence
  Description of Artificial Sequence: Synthetic polypeptide
  XENP020166 5C4_H1L1_scFv(GKPGS)4
QVQLVQSGAEVKKPGASVKVSCKASGYTFTDYWMHWLRQAPGQGLEWMGAIDTSDSYPTYNQKFQGRVTMTVDDSTSTAYMELSSLRSEDTAVYYCTRFDYWGQGTLVTVSSGKPGSGKPGSGKPGSGKPGSDIVMTQSPDSLAVSLGERATINCKASQSVSNDVAWYQQKPGQSPKLLIYYASNRYTGVPDRFTGSGYGTDFTLTISSLQAEDVAVYFCQQDYSSPYTFGGGTKVEIK

SEQ ID NO: 16124 - protein, 112 aa, Artificial Sequence
  Description of Artificial Sequence: Synthetic polypeptide
  VH of XENP020166
QVQLVQSGAEVKKPGASVKVSCKASGYTFTDYWMHWLRQAPGQGLEWMGAIDTSDSYPTYNQKFQGRVTMTVDDSTSTAYMELSSLRSEDTAVYYCTRFDYWGQGTLVTVSS

SEQ ID NO: 16125 - protein, 107 aa, Artificial Sequence
  Description of Artificial Sequence: Synthetic polypeptide
  VL of XENP020166
DIVMTQSPDSLAVSLGERATINCKASQSVSNDVAWYQQKPGQSPKLLIYYASNRYTGVPDRFTGSGYGTDFTLTISSLQAEDVAVYFCQQDYSSPYTFGGGTKVEIK

SEQ ID NO: 16126 - protein, 5 aa, Artificial Sequence
  Description of Artificial Sequence: Synthetic peptide
  XENP020166 vhCDR1
DYWMH

SEQ ID NO: 16127 - protein, 17 aa, Artificial Sequence
  Description of Artificial Sequence: Synthetic peptide
  XENP020166 vhCDR2
AIDTSDSYPTYNQKFQG

SEQ ID NO: 16128 - protein, 3 aa, Artificial Sequence
  Description of Artificial Sequence: Synthetic peptide
  XENP020166 vhCDR3
FDY

SEQ ID NO: 16129 - protein, 11 aa, Artificial Sequence
  Description of Artificial Sequence: Synthetic peptide
  XENP020166 vlCDR1
KASQSVSNDVA

SEQ ID NO: 16130 - protein, 7 aa, Artificial Sequence
  Description of Artificial Sequence: Synthetic peptide
  XENP020166 vlCDR2
YASNRYT

SEQ ID NO: 16131 - protein, 9 aa, Artificial Sequence
  Description of Artificial Sequence: Synthetic peptide
  XENP020166 vlCDR3
QQDYSSPYT

SEQ ID NO: 16132 - protein, 239 aa, Artificial Sequence
  Description of Artificial Sequence: Synthetic polypeptide
  XENP020167 5C4_H2L1_scFv(GKPGS)4
QVQLVQSGSELKKPGASVKVSCKASGYTFTDYWMHWLRQAPGQGLEWMGAIDTSDSYPTYNQGFTGRFVFSVDDSVSTAYLQISSLKAEDTAVYYCTRFDYWGQGTLVTVSSGKPGSGKPGSGKPGSGKPGSDIVMTQSPDSLAVSLGERATINCKASQSVSNDVAWYQQKPGQSPKLLIYYASNRYTGVPDRFTGSGYGTDFTLTISSLQAEDVAVYFCQQDYSSPYTFGGGTKVEIK

SEQ ID NO: 16133 - protein, 112 aa, Artificial Sequence
  Description of Artificial Sequence: Synthetic polypeptide
  VH of XENP020167
QVQLVQSGSELKKPGASVKVSCKASGYTFTDYWMHWLRQAPGQGLEWMGAIDTSDSYPTYNQGFTGRFVFSVDDSVSTAYLQISSLKAEDTAVYYCTRFDYWGQGTLVTVSS

SEQ ID NO: 16134 - protein, 107 aa, Artificial Sequence; identical to SEQ ID NO: 16125
  Description of Artificial Sequence: Synthetic polypeptide
  VL of XENP020167

SEQ ID NO: 16135 - protein, 5 aa, Artificial Sequence
  Description of Artificial Sequence: Synthetic peptide
  XENP020167 vhCDR1
DYWMH

SEQ ID NO: 16136 - protein, 17 aa, Artificial Sequence
  Description of Artificial Sequence: Synthetic peptide
  XENP020167 vhCDR2
AIDTSDSYPTYNQGFTG

SEQ ID NO: 16137 - protein, 3 aa, Artificial Sequence
  Description of Artificial Sequence: Synthetic peptide
  XENP020167 vhCDR3
FDY

SEQ ID NO: 16138 - protein, 11 aa, Artificial Sequence
  Description of Artificial Sequence: Synthetic peptide
  XENP020167 vlCDR1
KASQSVSNDVA

SEQ ID NO: 16139 - protein, 7 aa, Artificial Sequence
  Description of Artificial Sequence: Synthetic peptide
  XENP020167 vlCDR2
YASNRYT

SEQ ID NO: 16140 - protein, 9 aa, Artificial Sequence
  Description of Artificial Sequence: Synthetic peptide
  XENP020167 vlCDR3
QQDYSSPYT

SEQ ID NO: 16141 - protein, 443 aa, Artificial Sequence
  Description of Artificial Sequence: Synthetic polypeptide
  XENP013810 Nivolumab_H0L0_IgG1 Heavy Chain
QVQLVESGGGVVQPGRSLRLDCKASGITFSNSGMHWVRQAPGKGLEWVAVIWYDGSKRYYADSVKGRFTISRDNSKNTLFLQMNSLRAEDTAVYYCATNDDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 16142 - protein, 113 aa, Artificial Sequence [sequence omitted]

SEQ ID NO: 16143 - protein, 5 aa, Artificial Sequence
  Description of Artificial Sequence: Synthetic peptide
  XENP013810 vhCDR1
NSGMH

SEQ ID NO: 16144 - protein, 17 aa, Artificial Sequence
  Description of Artificial Sequence: Synthetic peptide
  XENP013810 vhCDR2
VIWYDGSKRYYADSVKG

SEQ ID NO: 16145 - protein, 4 aa, Artificial Sequence
  Description of Artificial Sequence: Synthetic peptide
  XENP013810 vhCDR3
NDDY

SEQ ID NO: 16146 - protein, 214 aa, Artificial Sequence
  Description of Artificial Sequence: Synthetic polypeptide
  XENP013810 Nivolumab_H0L0_IgG1 Light Chain
EIVLTQSPATLSLSPGERATLSCRASQSVSSYLAWYQQKPGQAPRLLIYDASNRATGIPARFSGSGSGTDFTLTISSLEPEDFAVYYCQQSSNWPRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16147 - protein, 107 aa, Artificial Sequence [sequence omitted]

SEQ ID NO: 16148 - protein, 11 aa, Artificial Sequence
  Description of Artificial Sequence: Synthetic peptide
  XENP013810 vlCDR1
RASQSVSSYLA

SEQ ID NO: 16149 - protein, 7 aa, Artificial Sequence
  Description of Artificial Sequence: Synthetic peptide
  XENP013810 vlCDR2
DASNRAT

SEQ ID NO: 16150 - protein, 9 aa, Artificial Sequence
  Description of Artificial Sequence: Synthetic peptide
  XENP013810 vlCDR3
QQSSNWPRT

SEQ ID NO: 16151 - protein, 443 aa, Artificial Sequence
  Description of Artificial Sequence: Synthetic polypeptide
  XENP013960 Nivolumab_H0L0_IgG1_G236R/L328R Heavy Chain
QVQLVESGGGVVQPGRSLRLDCKASGITFSNSGMHWVRQAPGKGLEWVAVIWYDGSKRYYADSVKGRFTISRDNSKNTLFLQMNSLRAEDTAVYYCATNDDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLRGPSVFLFPPKPKDTLMISRTPEVTCVVVDVSHEDPEVKFNWYVDGVEVHNAKTKPREEQYNSTYRVVSVLTVLHQDWLNGKEYKCKVSNKARPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 16152 - protein, 113 aa, Artificial Sequence [sequence omitted]

SEQ ID NO: 16153 - protein, 5 aa, Artificial Sequence
  Description of Artificial Sequence: Synthetic peptide
  XENP013960 vhCDR1
NSGMH

SEQ ID NO: 16154 - protein, 17 aa, Artificial Sequence
  Description of Artificial Sequence: Synthetic peptide
  XENP013960 vhCDR2
VIWYDGSKRYYADSVKG

SEQ ID NO: 16155 - protein, 4 aa, Artificial Sequence
  Description of Artificial Sequence: Synthetic peptide
  XENP013960 vhCDR3
NDDY

SEQ ID NO: 16156 - protein, 214 aa, Artificial Sequence; identical to SEQ ID NO: 16146
  Description of Artificial Sequence: Synthetic polypeptide
  XENP013960 Nivolumab_H0L0_IgG1_G236R/L328R Light Chain

SEQ ID NO: 16157 - protein, 107 aa, Artificial Sequence [sequence omitted]

SEQ ID NO: 16158 - protein, 11 aa, Artificial Sequence
  Description of Artificial Sequence: Synthetic peptide
  XENP013960 vlCDR1
RASQSVSSYLA

SEQ ID NO: 16159 - protein, 7 aa, Artificial Sequence
  Description of Artificial Sequence: Synthetic peptide
  XENP013960 vlCDR2
DASNRAT

SEQ ID NO: 16160 - protein, 9 aa, Artificial Sequence
  Description of Artificial Sequence: Synthetic peptide
  XENP013960 vlCDR3
QQSSNWPRT

SEQ ID NO: 16161 - protein, 442 aa, Artificial Sequence
  Description of Artificial Sequence: Synthetic polypeptide
  XENP016432 Nivolumab_H0L0_IgG1_PVA_/S267K Heavy Chain
QVQLVESGGGVVQPGRSLRLDCKASGITFSNSGMHWVRQAPGKGLEWVAVIWYDGSKRYYADSVKGRFTISRDNSKNTLFLQMNSLRAEDTAVYYCATNDDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 16162 - protein, 113 aa, Artificial Sequence [sequence omitted]

SEQ ID NO: 16163 - protein, 5 aa, Artificial Sequence
  Description of Artificial Sequence: Synthetic peptide
  XENP016432 vhCDR1
NSGMH

SEQ ID NO: 16164 - protein, 17 aa, Artificial Sequence
  Description of Artificial Sequence: Synthetic peptide
  XENP016432 vhCDR2
VIWYDGSKRYYADSVKG

SEQ ID NO: 16165 - protein, 4 aa, Artificial Sequence
  Description of Artificial Sequence: Synthetic peptide
  XENP016432 vhCDR3
NDDY

SEQ ID NO: 16166 - protein, 214 aa, Artificial Sequence; identical to SEQ ID NO: 16146
  Description of Artificial Sequence: Synthetic polypeptide
  XENP016432 Nivolumab_H0L0_IgG1_PVA_/S267K Light Chain

SEQ ID NO: 16167 - protein, 107 aa, Artificial Sequence [sequence omitted]

SEQ ID NO: 16168 - protein, 11 aa, Artificial Sequence
  Description of Artificial Sequence: Synthetic peptide
  XENP016432 vlCDR1
RASQSVSSYLA

SEQ ID NO: 16169 - protein, 7 aa, Artificial Sequence
  Description of Artificial Sequence: Synthetic peptide
  XENP016432 vlCDR2
DASNRAT

SEQ ID NO: 16170 - protein, 9 aa, Artificial Sequence
  Description of Artificial Sequence: Synthetic peptide
  XENP016432 vlCDR3
QQSSNWPRT

SEQ ID NO: 16171 - protein, 440 aa, Artificial Sequence
  Description of Artificial Sequence: Synthetic polypeptide
  XENP016602 Nivolumab_H0_IgG4_S228P Heavy Chain
QVQLVESGGGVVQPGRSLRLDCKASGITFSNSGMHWVRQAPGKGLEWVAVIWYDGSKRYYADSVKGRFTISRDNSKNTLFLQMNSLRAEDTAVYYCATNDDYWGQGTLVTVSSASTKGPSVFPLAPSSKSTSGGTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 16172 - protein, 113 aa, Artificial Sequence [sequence omitted]

SEQ ID NO: 16173 - protein, 5 aa, Artificial Sequence
  Description of Artificial Sequence: Synthetic peptide
  XENP016602 vhCDR1
NSGMH

SEQ ID NO: 16174 - protein, 17 aa, Artificial Sequence
  Description of Artificial Sequence: Synthetic peptide
  XENP016602 vhCDR2
VIWYDGSKRYYADSVKG

SEQ ID NO: 16175 - protein, 4 aa, Artificial Sequence
  Description of Artificial Sequence: Synthetic peptide
  XENP016602 vhCDR3
NDDY

SEQ ID NO: 16176 - protein, 214 aa, Artificial Sequence; identical to SEQ ID NO: 16146
  Description of Artificial Sequence: Synthetic polypeptide
  XENP016602 Nivolumab_H0_IgG4_S228P Light Chain

SEQ ID NO: 16177 - protein, 107 aa, Artificial Sequence [sequence omitted]

SEQ ID NO: 16178 - protein, 11 aa, Artificial Sequence
  Description of Artificial Sequence: Synthetic peptide
  XENP016602 vlCDR1
RASQSVSSYLA

SEQ ID NO: 16179 - protein, 7 aa, Artificial Sequence
  Description of Artificial Sequence: Synthetic peptide
  XENP016602 vlCDR2
DASNRAT

SEQ ID NO: 16180 - protein, 9 aa, Artificial Sequence
  Description of Artificial Sequence: Synthetic peptide
  XENP016602 vlCDR3
QQSSNWPRT

SEQ ID NO: 16181 - protein, 447 aa, Artificial Sequence
  Description of Artificial Sequence: Synthetic polypeptide
  XENP016603 Pembrolizumab_H0_IgG4_S228P Heavy Chain
QVQLVQSGVEVKKPGASVKVSCKASGYTFTNYYMYWVRQAPGQGLEWMGGINPSNGGTNFNEKFKNRVTLTTDSSTTTAYMELKSLQFDDTAVYYCARRDYRFDMGFDYWGQGTTVTVSSASTKGPSVFPLAPSSKSTSGGTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 16182 - protein, 120 aa, Artificial Sequence [sequence omitted]

SEQ ID NO: 16183 - protein, 5 aa, Artificial Sequence
  Description of Artificial Sequence: Synthetic peptide
  XENP016603 vhCDR1
NYYMY

SEQ ID NO: 16184 - protein, 17 aa, Artificial Sequence
  Description of Artificial Sequence: Synthetic peptide
  XENP016603 vhCDR2
GINPSNGGTNFNEKFKN

SEQ ID NO: 16185 - protein, 11 aa, Artificial Sequence
  Description of Artificial Sequence: Synthetic peptide
  XENP016603 vhCDR3
RDYRFDMGFDY

SEQ ID NO: 16186 - protein, 218 aa, Artificial Sequence
  Description of Artificial Sequence: Synthetic polypeptide
  XENP016603 Pembrolizumab_H0_IgG4_S228P Light Chain
EIVLTQSPATLSLSPGERATLSCRASKGVSTSGYSYLHWYQQKPGQAPRLLIYLASYLESGVPARFSGSGSGTDFTLTISSLEPEDFAVYYCQHSRDLPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16187 - protein, 111 aa, Artificial Sequence [sequence omitted]

SEQ ID NO: 16188 - protein, 15 aa, Artificial Sequence
  Description of Artificial Sequence: Synthetic peptide
  XENP016603 vlCDR1
RASKGVSTSGYSYLH

SEQ ID NO: 16189 - protein, 7 aa, Artificial Sequence
  Description of Artificial Sequence: Synthetic peptide
  XENP016603 vlCDR2
LASYLES

SEQ ID NO: 16190 - protein, 9 aa, Artificial Sequence
  Description of Artificial Sequence: Synthetic peptide
  XENP016603 vlCDR3
QHSRDLPLT

SEQ ID NO: 16191 - protein, 443 aa, Artificial Sequence
  Description of Artificial Sequence: Synthetic polypeptide
  XENP017903 1A2_H1L1_IgG1_PVA_/S267K Heavy Chain
QIQLVQSGAEVKKPGASVKVSCKASGYTFTDYSMHWVRQAPGQGLEWMGWINTETGEPTYADKFQGRVTMTLDTSTSTAYMELSSLRSEDTAVYFCASSPLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 16192 - protein, 114 aa, Artificial Sequence; identical to SEQ ID NO: 10895
  Description of Artificial Sequence: Synthetic polypeptide
  VH of XENP017903

SEQ ID NO: 16193 - protein, 5 aa, Artificial Sequence
  Description of Artificial Sequence: Synthetic peptide
  XENP017903 vhCDR1
DYSMH

SEQ ID NO: 16194 - protein, 17 aa, Artificial Sequence
  Description of Artificial Sequence: Synthetic peptide
  XENP017903 vhCDR2
WINTETGEPTYADKFQG

SEQ ID NO: 16195 - protein, 5 aa, Artificial Sequence
  Description of Artificial Sequence: Synthetic peptide
  XENP017903 vhCDR3
SPLDY

SEQ ID NO: 16196 - protein, 219 aa, Artificial Sequence
  Description of Artificial Sequence: Synthetic polypeptide
  XENP017903 1A2_H1L1_IgG1_PVA_/S267K Light Chain
DLLLTQSPLSLPVTPGEPASISCRSSQSIVHSNGNTYLEWFLQKPGQSPQLLIYKVFNRFSGVPDRFSGSGSGTDFTLKISRVEAEDVGVYYCFQGSHVPFTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16197 - protein, 112 aa, Artificial Sequence; identical to SEQ ID NO: 10896
  Description of Artificial Sequence: Synthetic polypeptide
  VL of XENP017903

SEQ ID NO: 16198 - protein, 16 aa, Artificial Sequence
  Description of Artificial Sequence: Synthetic peptide
  XENP017903 vlCDR1
RSSQSIVHSNGNTYLE

SEQ ID NO: 16199 - protein, 7 aa, Artificial Sequence
  Description of Artificial Sequence: Synthetic peptide
  XENP017903 vlCDR2
KVFNRFS

SEQ ID NO: 16200 - protein, 9 aa, Artificial Sequence
  Description of Artificial Sequence: Synthetic peptide
  XENP017903 vlCDR3
FQGSHVPFT

SEQ ID NO: 16201 - protein, 449 aa, Artificial Sequence
  Description of Artificial Sequence: Synthetic polypeptide
  XENP017904 1C7_H1L1_IgG1_PVA_/S267K Heavy Chain
EVQLLESGGGLVQPGGSLRLSCAASGFAFSSYDMSWVRQAPGKRLEWVSYISSGGGSTYYPDSVKGRFTISRDNSKNTLYLQMNSLRAEDTAVYYCARPLDDYYAPFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 16202 - protein, 120 aa, Artificial Sequence; identical to SEQ ID NO: 10904
  Description of Artificial Sequence: Synthetic polypeptide
  VH of XENP017904

SEQ ID NO: 16203 - protein, 5 aa, Artificial Sequence
  Description of Artificial Sequence: Synthetic peptide
  XENP017904 vhCDR1
SYDMS

SEQ ID NO: 16204 - protein, 17 aa, Artificial Sequence
  Description of Artificial Sequence: Synthetic peptide
  XENP017904 vhCDR2
YISSGGGSTYYPDSVKG

SEQ ID NO: 16205 - protein, 11 aa, Artificial Sequence
  Description of Artificial Sequence: Synthetic peptide
  XENP017904 vhCDR3
PLDDYYAPFAY

SEQ ID NO: 16206 - protein, 218 aa, Artificial Sequence
  Description of Artificial Sequence: Synthetic polypeptide
  XENP017904 1C7_H1L1_IgG1_PVA_/S267K Light Chain
DIVLTQSPSSLSASVGDRVTITCRASESVDNDGISFMNWFQQKPGKPPKLLIYAASNQGSGVPARFSGSGSGTDFTLTISSLQPEDFATYFCQQSKEVPWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16207 - protein, 111 aa, Artificial Sequence; identical to SEQ ID NO: 10905
  Description of Artificial Sequence: Synthetic polypeptide
  VL of XENP017904

SEQ ID NO: 16208 - protein, 15 aa, Artificial Sequence
  Description of Artificial Sequence: Synthetic peptide
  XENP017904 vlCDR1
RASESVDNDGISFMN

SEQ ID NO: 16209 - protein, 7 aa, Artificial Sequence
  Description of Artificial Sequence: Synthetic peptide
  XENP017904 vlCDR2
AASNQGS

SEQ ID NO: 16210 - protein, 9 aa, Artificial Sequence
  Description of Artificial Sequence: Synthetic peptide
  XENP017904 vlCDR3
QQSKEVPWT

SEQ ID NO: 16211 - protein, 443 aa, Artificial Sequence
  Description of Artificial Sequence: Synthetic polypeptide
  XENP017905 1G2_H1L1_IgG1_PVA_/S267K Heavy Chain
QVQLVQSGAEVKKPGASVKVSCKVSGFSLTDYGVNWVRQAPGQGLEWMGMIWGDGSTDYNSKFQGRVTMTKDISTSTVYMELSSLRSEDTAVYYCAREYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 16212 - protein, 114 aa, Artificial Sequence; identical to SEQ ID NO: 10913
  Description of Artificial Sequence: Synthetic polypeptide
  VH of XENP017905

SEQ ID NO: 16213 - protein, 5 aa, Artificial Sequence
  Description of Artificial Sequence: Synthetic peptide
  XENP017905 vhCDR1
DYGVN

SEQ ID NO: 16214 - protein, 16 aa, Artificial Sequence
  Description of Artificial Sequence: Synthetic peptide
  XENP017905 vhCDR2
MIWGDGSTDYNSKFQG

SEQ ID NO: 16215 - protein, 6 aa, Artificial Sequence
  Description of Artificial Sequence: Synthetic peptide
  XENP017905 vhCDR3
EYAMDY

SEQ ID NO: 16216 - protein, 219 aa, Artificial Sequence
  Description of Artificial Sequence: Synthetic polypeptide
  XENP017905 1G2_H1L1_IgG1_PVA_/S267K Light Chain
DIVMTQSPDSLAVSLGERATINCKSSQSLLNSRTRKNYLAWYQQKPGQSPKLLIFWASTRESGVPDRFTGSGSGTDFTLTISSLQAEDVAVYYCKQSYNLRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16217 - protein, 112 aa, Artificial Sequence; identical to SEQ ID NO: 10914
  Description of Artificial Sequence: Synthetic polypeptide
  VL of XENP017905

SEQ ID NO: 16218 - protein, 17 aa, Artificial Sequence
  Description of Artificial Sequence: Synthetic peptide
  XENP017905 vlCDR1
KSSQSLLNSRTRKNYLA

SEQ ID NO: 16219 - protein, 7 aa, Artificial Sequence
  Description of Artificial Sequence: Synthetic peptide
  XENP017905 vlCDR2
WASTRES

SEQ ID NO: 16220 - protein, 8 aa, Artificial Sequence
  Description of Artificial Sequence: Synthetic peptide
  XENP017905 vlCDR3
KQSYNLRT

SEQ ID NO: 16221 - protein, 451 aa, Artificial Sequence
  Description of Artificial Sequence: Synthetic polypeptide
  XENP017906 1G6_H1L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 16222 - protein, 122 aa, Artificial Sequence; identical to SEQ ID NO: 10922
  Description of Artificial Sequence: Synthetic polypeptide
  VH of XENP017906

SEQ ID NO: 16223 - protein, 5 aa, Artificial Sequence
  Description of Artificial Sequence: Synthetic peptide
  XENP017906 vhCDR1
NYWMN

SEQ ID NO: 16224 - protein, 19 aa, Artificial Sequence
  Description of Artificial Sequence: Synthetic peptide
  XENP017906 vhCDR2
EIRLKSNNYATHYAEPVKG

SEQ ID NO: 16225 - protein, 11 aa, Artificial Sequence
  Description of Artificial Sequence: Synthetic peptide
  XENP017906 vhCDR3
YYGNYGGYFDV

SEQ ID NO: 16226 - protein, 214 aa, Artificial Sequence
  Description of Artificial Sequence: Synthetic polypeptide
  XENP017906 1G6_H1L1_IgG1_PVA_/S267K Light Chain
SIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16227 - protein, 107 aa, Artificial Sequence; identical to SEQ ID NO: 10923
  Description of Artificial Sequence: Synthetic polypeptide
  VL of XENP017906

SEQ ID NO: 16228 - protein, 11 aa, Artificial Sequence
  Description of Artificial Sequence: Synthetic peptide
  XENP017906 vlCDR1
RASQSVSNDVA

SEQ ID NO: 16229 - protein, 7 aa, Artificial Sequence
  Description of Artificial Sequence: Synthetic peptide
  XENP017906 vlCDR2
YASHRYT

SEQ ID NO: 16230 - protein, 9 aa, Artificial Sequence
  Description of Artificial Sequence: Synthetic peptide
  XENP017906 vlCDR3
QQDYSSPRT

SEQ ID NO: 16231 - protein, 451 aa, Artificial Sequence; identical to SEQ ID NO: 16221
  Description of Artificial Sequence: Synthetic polypeptide
  XENP017907 1G6_H1L2_IgG1_PVA_/S267K Heavy Chain

SEQ ID NO: 16232 - protein, 122 aa, Artificial Sequence; identical to SEQ ID NO: 10922
  Description of Artificial Sequence: Synthetic polypeptide
  VH of XENP017907

SEQ ID NO: 16233 - protein, 5 aa, Artificial Sequence
  Description of Artificial Sequence: Synthetic peptide
  XENP017907 vhCDR1
NYWMN

SEQ ID NO: 16234 - protein, 19 aa, Artificial Sequence
  Description of Artificial Sequence: Synthetic peptide
  XENP017907 vhCDR2
EIRLKSNNYATHYAEPVKG

SEQ ID NO: 16235 - protein, 11 aa, Artificial Sequence
  Description of Artificial Sequence: Synthetic peptide
  XENP017907 vhCDR3
YYGNYGGYFDV

SEQ ID NO: 16236 - protein, 214 aa, Artificial Sequence
  Description of Artificial Sequence: Synthetic polypeptide
  XENP017907 1G6_H1L2_IgG1_PVA_/S267K Light Chain
SIVMTQSPSSLSASVGDRVTITCRASQSVSNDVAWYQQKPGKSPKLLINYASHRYTGVPDRFTGSGYGTDFTLTISSLQPEDFATYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16237 - protein, 107 aa, Artificial Sequence; identical to SEQ ID NO: 10932
  Description of Artificial Sequence: Synthetic polypeptide
  VL of XENP017907

SEQ ID NO: 16238 - protein, 11 aa, Artificial Sequence
  Description of Artificial Sequence: Synthetic peptide
  XENP017907 vlCDR1
RASQSVSNDVA

SEQ ID NO: 16239 - protein, 7 aa, Artificial Sequence
  Description of Artificial Sequence: Synthetic peptide
  XENP017907 vlCDR2
YASHRYT

SEQ ID NO: 16240 - protein, 9 aa, Artificial Sequence
  Description of Artificial Sequence: Synthetic peptide
  XENP017907 vlCDR3
QQDYSSPRT

SEQ ID NO: 16241 - protein, 444 aa, Artificial Sequence
  Description of Artificial Sequence: Synthetic polypeptide
  XENP017908 2A2_H1L1_IgG1_PVA_/S267K Heavy Chain
QVQLVQSGAEVKKPGASVKVSCKASGYTFTNYWMHWVRQAPGQGLEWMGYINPSTGYTEYNQKFQGRVTMTADKSTSTAYMELSSLRSEDTAVYYCATGNYFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 16242 - protein, 115 aa, Artificial Sequence; identical to SEQ ID NO: 10940
  Description of Artificial Sequence: Synthetic polypeptide
  VH of XENP017908

SEQ ID NO: 16243 - protein, 5 aa, Artificial Sequence
  Description of Artificial Sequence: Synthetic peptide
  XENP017908 vhCDR1
NYWMH

SEQ ID NO: 16244 - protein, 17 aa, Artificial Sequence
  Description of Artificial Sequence: Synthetic peptide
  XENP017908 vhCDR2
YINPSTGYTEYNQKFQG

SEQ ID NO: 16245 - protein, 6 aa, Artificial Sequence
  Description of Artificial Sequence: Synthetic peptide
  XENP017908 vhCDR3
GNYFAY

SEQ ID NO: 16246 - protein, 214 aa, Artificial Sequence
  Description of Artificial Sequence: Synthetic polypeptide
  XENP017908 2A2_H1L1_IgG1_PVA_/S267K Light Chain
DIQMTQSPSSLSASVGDRVTITCRPSESLYSYLAWYQQKPGKSPKLLVYNAKTLVEGVPSRFSGSGSGTDFTLTISSLQPEDFATYYCQHHYGTPFTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16247 - protein, 107 aa, Artificial Sequence; identical to SEQ ID NO: 10941
  Description of Artificial Sequence: Synthetic polypeptide
  VL of XENP017908

SEQ ID NO: 16248 - protein, 11 aa, Artificial Sequence
  Description of Artificial Sequence: Synthetic peptide
  XENP017908 vlCDR1
RPSESLYSYLA

SEQ ID NO: 16249 - protein, 7 aa, Artificial Sequence
  Description of Artificial Sequence: Synthetic peptide
  XENP017908 vlCDR2
NAKTLVE

SEQ ID NO: 16250 - protein, 9 aa, Artificial Sequence
  Description of Artificial Sequence: Synthetic peptide
  XENP017908 vlCDR3
QHHYGTPFT

SEQ ID NO: 16251 - protein, 449 aa, Artificial Sequence
  Description of Artificial Sequence: Synthetic polypeptide
  XENP017909 2F11_H1L1_IgG1_PVA_/S267K Heavy Chain
QVQLVQSGAEVKKPGASVKVSCKGSGYTFTDYVMHWVRQAPGQSLEWMGVISTYYGDASYNQKFQGRVTMTVDKSTSTAYMELSSLRSEDTAVYYCAREGYDGYLYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 16252 - protein, 120 aa, Artificial Sequence; identical to SEQ ID NO: 10949
  Description of Artificial Sequence: Synthetic polypeptide
  VH of XENP017909

SEQ ID NO: 16253 - protein, 5 aa, Artificial Sequence
  Description of Artificial Sequence: Synthetic peptide
  XENP017909 vhCDR1
DYVMH

SEQ ID NO: 16254 - protein, 17 aa, Artificial Sequence
  Description of Artificial Sequence: Synthetic peptide
  XENP017909 vhCDR2
VISTYYGDASYNQKFQG

SEQ ID NO: 16255 - protein, 11 aa, Artificial Sequence
  Description of Artificial Sequence: Synthetic peptide
  XENP017909 vhCDR3
EGYDGYLYFDV

SEQ ID NO: 16256 - protein, 219 aa, Artificial Sequence
  Description of Artificial Sequence: Synthetic polypeptide
  XENP017909 2F11_H1L1_IgG1_PVA_/S267K Light Chain
DVLMTQTPLSSPVTLGQPASISCRSSQSIVHSNGNTYLEWYQQRPGQSPRLLIYKVSNRFSGVPDRFSGSGSGTDFTLKISRVEAEDVGVYYCFQGSHVPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16257 - protein, 112 aa, Artificial Sequence; identical to SEQ ID NO: 10950
  Description of Artificial Sequence: Synthetic polypeptide
  VL of XENP017909

SEQ ID NO: 16258 - protein, 16 aa, Artificial Sequence
  Description of Artificial Sequence: Synthetic peptide
  XENP017909 vlCDR1
RSSQSIVHSNGNTYLE

SEQ ID NO: 16259 - protein, 7 aa, Artificial Sequence
  Description of Artificial Sequence: Synthetic peptide
  XENP017909 vlCDR2
KVSNRFS

SEQ ID NO: 16260 - protein, 9 aa, Artificial Sequence
  Description of Artificial Sequence: Synthetic peptide
  XENP017909 vlCDR3
FQGSHVPYT

SEQ ID NO: 16261 - protein, 449 aa, Artificial Sequence
  Description of Artificial Sequence: Synthetic polypeptide
  XENP017910 5H1_H1L1_IgG1_PVA_/S267K Heavy Chain
QVQLVQSGAEVKKPGASVKVSCKGSGYTFTDYVMHWVRQAPGQSLEWMGVISIHYGDGRYNQKFQGRVTMTVDKSTSTAYMELSSLRSEDTAVYYCAREVYDGYLYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 16262 - protein, 120 aa, Artificial Sequence; identical to SEQ ID NO: 10958
  Description of Artificial Sequence: Synthetic polypeptide
  VH of XENP017910

SEQ ID NO: 16263 - protein, 5 aa, Artificial Sequence
  Description of Artificial Sequence: Synthetic peptide
  XENP017910 vhCDR1
DYVMH

SEQ ID NO: 16264 - protein, 17 aa, Artificial Sequence
  Description of Artificial Sequence: Synthetic peptide
  XENP017910 vhCDR2
VISIHYGDGRYNQKFQG

SEQ ID NO: 16265 - protein, 11 aa, Artificial Sequence
  Description of Artificial Sequence: Synthetic peptide
  XENP017910 vhCDR3
EVYDGYLYFDV

SEQ ID NO: 16266 - protein, 219 aa, Artificial Sequence
  Description of Artificial Sequence: Synthetic polypeptide
  XENP017910 5H1_H1L1_IgG1_PVA_/S267K Light Chain
DVLMTQSPLSLPVTPGEPASISCRSSQSIVHSNGNTYLEWYLQKPGQSPQLLIYKVSNRFSGVPDRFGGRGSGTDFTLKISRVEAEDVGVYYCFQGSHVPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16267 - protein, 112 aa, Artificial Sequence; identical to SEQ ID NO: 10959
  Description of Artificial Sequence: Synthetic polypeptide
  VL of XENP017910

SEQ ID NO: 16268 - protein, 16 aa, Artificial Sequence
  Description of Artificial Sequence: Synthetic peptide
  XENP017910 vlCDR1
RSSQSIVHSNGNTYLE

SEQ ID NO: 16269 - protein, 7 aa, Artificial Sequence
  Description of Artificial Sequence: Synthetic peptide
  XENP017910 vlCDR2
KVSNRFS

SEQ ID NO: 16270 - protein, 9 aa, Artificial Sequence
  Description of Artificial Sequence: Synthetic peptide
  XENP017910 vlCDR3
FQGSHVPYT

SEQ ID NO: 16271 - protein, 449 aa, Artificial Sequence; identical to SEQ ID NO: 16261
  Description of Artificial Sequence: Synthetic polypeptide
  XENP017911 5H1_H1L2_IgG1_PVA_/S267K Heavy Chain

SEQ ID NO: 16272 - protein, 120 aa, Artificial Sequence; identical to SEQ ID NO: 10958
  Description of Artificial Sequence: Synthetic polypeptide
  VH of XENP017911

SEQ ID NO: 16273 - protein, 5 aa, Artificial Sequence
  Description of Artificial Sequence: Synthetic peptide
  XENP017911 vhCDR1
DYVMH

SEQ ID NO: 16274 - protein, 17 aa, Artificial Sequence
  Description of Artificial Sequence: Synthetic peptide
  XENP017911 vhCDR2
VISIHYGDGRYNQKFQG

SEQ ID NO: 16275 - protein, 11 aa, Artificial Sequence
  Description of Artificial Sequence: Synthetic peptide
  XENP017911 vhCDR3
EVYDGYLYFDV

SEQ ID NO: 16276 - protein, 219 aa, Artificial Sequence
  Description of Artificial Sequence: Synthetic polypeptide
  XENP017911 5H1_H1L2_IgG1_PVA_/S267K Light Chain
DVLMTQSPLSLPVTLGQPASISCRSSQSIVHSNGNTYLEWYQQRPGQSPRLLIYKVSNRFSGVPDRFGGRGSGTDFTLKISRVEAEDVGVYYCFQGSHVPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16277 - protein, 112 aa, Artificial Sequence; identical to SEQ ID NO: 10968
  Description of Artificial Sequence: Synthetic polypeptide
  VL of XENP017911

SEQ ID NO: 16278 - protein, 16 aa, Artificial Sequence
  Description of Artificial Sequence: Synthetic peptide
  XENP017911 vlCDR1
RSSQSIVHSNGNTYLE

SEQ ID NO: 16279 - protein, 7 aa, Artificial Sequence
  Description of Artificial Sequence: Synthetic peptide
  XENP017911 vlCDR2
KVSNRFS

SEQ ID NO: 16280 - protein, 9 aa, Artificial Sequence
  Description of Artificial Sequence: Synthetic peptide
  XENP017911 vlCDR3
FQGSHVPYT

SEQ ID NO: 16281 - protein, 449 aa, Artificial Sequence
  Description of Artificial Sequence: Synthetic polypeptide
  XENP017912 10E4_H1L1_IgG1_PVA_/S267K Heavy Chain
QVQLVQSGAEVKKPGASVKVSCKASGYSFTSYWMHWVRQAPGQGLEWMGAIYPGNSDTSYNQKFQGRVTMTADTSTSTAYMELSSLRSEDTAVYYCTRDGNYVRYYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 16282 - protein, 120 aa, Artificial Sequence; identical to SEQ ID NO: 10976
  Description of Artificial Sequence: Synthetic polypeptide
  VH of XENP017912

SEQ ID NO: 16283 - protein, 5 aa, Artificial Sequence
  Description of Artificial Sequence: Synthetic peptide
  XENP017912 vhCDR1
SYWMH

SEQ ID NO: 16284 - protein, 17 aa, Artificial Sequence
  Description of Artificial Sequence: Synthetic peptide
  XENP017912 vhCDR2
AIYPGNSDTSYNQKFQG

SEQ ID NO: 16285 - protein, 11 aa, Artificial Sequence
  Description of Artificial Sequence: Synthetic peptide
  XENP017912 vhCDR3
DGNYVRYYFDY

SEQ ID NO: 16286 - protein, 214 aa, Artificial Sequence
  Description of Artificial Sequence: Synthetic polypeptide
  XENP017912 10E4_H1L1_IgG1_PVA_/S267K Light Chain
DIQMTQSPSSLSASVGDRVTITCRASQDIGSNLNWLQQKPGKTIKRLIYATSNLDSGVPKRFSGRRSGSDYTLTISSLQPEDFATYYCLQYASSPLTFGTGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16287 - protein, 107 aa, Artificial Sequence; identical to SEQ ID NO: 10977
  Description of Artificial Sequence: Synthetic polypeptide
  VL of XENP017912

SEQ ID NO: 16288 - protein, 11 aa, Artificial Sequence
  Description of Artificial Sequence: Synthetic peptide
  XENP017912 vlCDR1
RASQDIGSNLN

SEQ ID NO: 16289 - protein, 7 aa, Artificial Sequence
  Description of Artificial Sequence: Synthetic peptide
  XENP017912 vlCDR2
ATSNLDS

SEQ ID NO: 16290 - protein, 9 aa, Artificial Sequence
  Description of Artificial Sequence: Synthetic peptide
  XENP017912 vlCDR3
LQYASSPLT

SEQ ID NO: 16291 - protein, 449 aa, Artificial Sequence
  Description of Artificial Sequence: Synthetic polypeptide
  XENP017913 4C11_H1L1_IgG1_PVA_/S267K Heavy Chain
QIQLVQSGAEVKKPGASVKVSCKASGYTFTSYWMHWVRQAPGQGLEWMGAIYPGNSDTSYNQKFQGRVTMTADTSTSTAYMELSSLRSEDTAVYYCTNLYYGSSFAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 16292 - protein, 120 aa, Artificial Sequence; identical to SEQ ID NO: 10985
  Description of Artificial Sequence: Synthetic polypeptide
  VH of XENP017913

SEQ ID NO: 16293 - protein, 5 aa, Artificial Sequence
  Description of Artificial Sequence: Synthetic peptide
  XENP017913 vhCDR1
SYWMH

SEQ ID NO: 16294 - protein, 17 aa, Artificial Sequence
  Description of Artificial Sequence: Synthetic peptide
  XENP017913 vhCDR2
AIYPGNSDTSYNQKFQG

SEQ ID NO: 16295 - protein, 11 aa, Artificial Sequence
  Description of Artificial Sequence: Synthetic peptide
  XENP017913 vhCDR3
LYYGSSFAMDY

SEQ ID NO: 16296 - protein, 214 aa, Artificial Sequence
  Description of Artificial Sequence: Synthetic polypeptide
  XENP017913 4C11_H1L1_IgG1_PVA_/S267K Light Chain
DIKMTQSPSSLSASVGDRVTITCRASQDINTYLSWFQQKPGKSPKTLIYRANRLVDGVPSRFSGSGSGQDYTLTISSLQPEDFATYYCLHYDDFPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16297 - protein, 107 aa, Artificial Sequence; identical to SEQ ID NO: 10986
  Description of Artificial Sequence: Synthetic polypeptide
  VL of XENP017913

SEQ ID NO: 16298 - protein, 11 aa, Artificial Sequence
  Description of Artificial Sequence: Synthetic peptide
  XENP017913 vlCDR1
RASQDINTYLS

SEQ ID NO: 16299 - protein, 7 aa, Artificial Sequence
  Description of Artificial Sequence: Synthetic peptide
  XENP017913 vlCDR2
RANRLVD

SEQ ID NO: 16300 - protein, 9 aa, Artificial Sequence
  Description of Artificial Sequence: Synthetic peptide
  XENP017913 vlCDR3
LHYDDFPYT

SEQ ID NO: 16301 - protein, 446 aa, Artificial Sequence
  Description of Artificial Sequence: Synthetic polypeptide
  XENP017914 6A3_H1L1_IgG1_PVA_/S267K Heavy Chain
EVQLLESGGGLVQPGGSLRLSCAASGFTFSSYGMSWVRQAPGKRLEWVSTISGGGRYTYYPDSVKGRFTISRDNSKNTLYLQMNSLRAEDTAVYYCASYYDSSFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 16302 - protein, 117 aa, Artificial Sequence; identical to SEQ ID NO: 10994
  Description of Artificial Sequence: Synthetic polypeptide
  VH of XENP017914

SEQ ID NO: 16303 - protein, 5 aa, Artificial Sequence
  Description of Artificial Sequence: Synthetic peptide
  XENP017914 vhCDR1
SYGMS

SEQ ID NO: 16304 - protein, 17 aa, Artificial Sequence
  Description of Artificial Sequence: Synthetic peptide
  XENP017914 vhCDR2
TISGGGRYTYYPDSVKG

SEQ ID NO: 16305 - protein, 8 aa, Artificial Sequence
  Description of Artificial Sequence: Synthetic peptide
  XENP017914 vhCDR3
YYDSSFDY

SEQ ID NO: 16306 - protein, 214 aa, Artificial Sequence
  Description of Artificial Sequence: Synthetic polypeptide
  XENP017914 6A3_H1L1_IgG1_PVA_/S267K Light Chain
DIVMTQSPDSLAVSLGERATINCKASQDVGTAVAWYQQKPGQSPKLLIYWASTRHTGVPDRFTGSGSGTDFTLTISSLQAEDVAVYFCQHYSIYPWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16307 - protein, 107 aa, Artificial Sequence; identical to SEQ ID NO: 10995
  Description of Artificial Sequence: Synthetic polypeptide
  VL of XENP017914

SEQ ID NO: 16308 - protein, 11 aa, Artificial Sequence
  Description of Artificial Sequence: Synthetic peptide
  XENP017914 vlCDR1
KASQDVGTAVA

SEQ ID NO: 16309 - protein, 7 aa, Artificial Sequence
  Description of Artificial Sequence: Synthetic peptide
  XENP017914 vlCDR2
WASTRHT

SEQ ID NO: 16310 - protein, 9 aa, Artificial Sequence
  Description of Artificial Sequence: Synthetic peptide
  XENP017914 vlCDR3
QHYSIYPWT

SEQ ID NO: 16311 - protein, 446 aa, Artificial Sequence; identical to SEQ ID NO: 16301
  Description of Artificial Sequence: Synthetic polypeptide
  XENP017915 6A3_H1L2_IgG1_PVA_/S267K Heavy Chain

SEQ ID NO: 16312 - protein, 117 aa, Artificial Sequence; identical to SEQ ID NO: 10994
  Description of Artificial Sequence: Synthetic polypeptide
  VH of XENP017915

SEQ ID NO: 16313 - protein, 5 aa, Artificial Sequence
  Description of Artificial Sequence: Synthetic peptide
  XENP017915 vhCDR1
SYGMS

SEQ ID NO: 16314 - protein, 17 aa, Artificial Sequence
  Description of Artificial Sequence: Synthetic peptide
  XENP017915 vhCDR2
TISGGGRYTYYPDSVKG

SEQ ID NO: 16315 - protein, 8 aa, Artificial Sequence
  Description of Artificial Sequence: Synthetic peptide
  XENP017915 vhCDR3
YYDSSFDY

SEQ ID NO: 16316 - protein, 214 aa, Artificial Sequence
  Description of Artificial Sequence: Synthetic polypeptide
  XENP017915 6A3_H1L2_IgG1_PVA_/S267K Light Chain
DIVMTQSPATLSVSPGERATLSCRASQDVGTAVAWYQQKPGQSPRLLIYWASTRHTGVPDRFTGSGSGTEFTLTISSLQSEDFAVYFCQHYSIYPWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16317 - protein, 107 aa, Artificial Sequence; identical to SEQ ID NO: 11004
  Description of Artificial Sequence: Synthetic polypeptide
  VL of XENP017915

SEQ ID NO: 16318 - protein, 11 aa, Artificial Sequence
  Description of Artificial Sequence: Synthetic peptide
  XENP017915 vlCDR1
RASQDVGTAVA

SEQ ID NO: 16319 - protein, 7 aa, Artificial Sequence
  Description of Artificial Sequence: Synthetic peptide
  XENP017915 vlCDR2
WASTRHT

SEQ ID NO: 16320 - protein, 9 aa, Artificial Sequence
  Description of Artificial Sequence: Synthetic peptide
  XENP017915 vlCDR3
QHYSIYPWT

SEQ ID NO: 16321 - protein, 446 aa, Artificial Sequence; identical to SEQ ID NO: 16301
  Description of Artificial Sequence: Synthetic polypeptide
  XENP017916 6A3_H1L3_IgG1_PVA_/S267K Heavy Chain

SEQ ID NO: 16322 - protein, 117 aa, Artificial Sequence; identical to SEQ ID NO: 10994
  Description of Artificial Sequence: Synthetic polypeptide
  VH of XENP017916

SEQ ID NO: 16323 - protein, 5 aa, Artificial Sequence
  Description of Artificial Sequence: Synthetic peptide
  XENP017916 vhCDR1
SYGMS

SEQ ID NO: 16324 - protein, 17 aa, Artificial Sequence
  Description of Artificial Sequence: Synthetic peptide
  XENP017916 vhCDR2
TISGGGRYTYYPDSVKG

SEQ ID NO: 16325 - protein, 8 aa, Artificial Sequence
  Description of Artificial Sequence: Synthetic peptide
  XENP017916 vhCDR3
YYDSSFDY

SEQ ID NO: 16326 - protein, 214 aa, Artificial Sequence
  Description of Artificial Sequence: Synthetic polypeptide
  XENP017916 6A3_H1L3_IgG1_PVA_/S267K Light Chain
DIVMTQSPSSLSASVGDRVTITCRASQDVGTAVAWYQQKPGKSPKLLIYWASTRHTGVPDRFTGSGSGTDFTLTISSLQPEDFATYFCQHYSIYPWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16327 - protein, 107 aa, Artificial Sequence; identical to SEQ ID NO: 11013
  Description of Artificial Sequence: Synthetic polypeptide
  VL of XENP017916

SEQ ID NO: 16328 - protein, 11 aa, Artificial Sequence
  Description of Artificial Sequence: Synthetic peptide
  XENP017916 vlCDR1
RASQDVGTAVA

SEQ ID NO: 16329 - protein, 7 aa, Artificial Sequence
  Description of Artificial Sequence: Synthetic peptide
  XENP017916 vlCDR2
WASTRHT

SEQ ID NO: 16330 - protein, 9 aa, Artificial Sequence
  Description of Artificial Sequence: Synthetic peptide
  XENP017916 vlCDR3
QHYSIYPWT

SEQ ID NO: 16331 - protein, 446 aa, Artificial Sequence
  Description of Artificial Sequence: Synthetic polypeptide
  XENP017917 6A3_H2L3_IgG1_PVA_/S267K Heavy Chain
EVQLLESGGGLVQPGGSLRLSCAASGFTFSSYGMSWVRQAPGKGLEWVSTISGGGRYTYYPDSVKGRFTISRDNSKNTLYLQMNSLRAEDTAVYYCASYYDSSFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 16332 - protein, 117 aa, Artificial Sequence; identical to SEQ ID NO: 11030
  Description of Artificial Sequence: Synthetic polypeptide
  VH of XENP017917

SEQ ID NO: 16333 - protein, 5 aa, Artificial Sequence
  Description of Artificial Sequence: Synthetic peptide
  XENP017917 vhCDR1
SYGMS

SEQ ID NO: 16334 - protein, 17 aa, Artificial Sequence
  Description of Artificial Sequence: Synthetic peptide
  XENP017917 vhCDR2
TISGGGRYTYYPDSVKG

SEQ ID NO: 16335 - protein, 8 aa, Artificial Sequence
  Description of Artificial Sequence: Synthetic peptide
  XENP017917 vhCDR3
YYDSSFDY

SEQ ID NO: 16336 - protein, 214 aa, Artificial Sequence; identical to SEQ ID NO: 16326
  Description of Artificial Sequence: Synthetic polypeptide
  XENP017917 6A3_H2L3_IgG1_PVA_/S267K Light Chain

SEQ ID NO: 16337 - protein, 107 aa, Artificial Sequence; identical to SEQ ID NO: 11013
  Description of Artificial Sequence: Synthetic polypeptide
  VL of XENP017917

SEQ ID NO: 16338 - protein, 11 aa, Artificial Sequence
  Description of Artificial Sequence: Synthetic peptide
  XENP017917 vlCDR1
RASQDVGTAVA

SEQ ID NO: 16339 - protein, 7 aa, Artificial Sequence
  Description of Artificial Sequence: Synthetic peptide
  XENP017917 vlCDR2
WASTRHT

SEQ ID NO: 16340 - protein, 9 aa, Artificial Sequence
  Description of Artificial Sequence: Synthetic peptide
  XENP017917 vlCDR3
QHYSIYPWT

SEQ ID NO: 16341 - protein, 446 aa, Artificial Sequence
  Description of Artificial Sequence: Synthetic polypeptide
  XENP017918 6A3_H1.1_L3_IgG1_PVA_/S267K Heavy Chain
QVQLVESGGGLVKPGGSLRLSCAASGFTFSSYGMSWVRQAPGKRLEWVSTISGGGRYTYYPDSVKGRFTISRDNAKNSLYLQMNSLRAEDTAVYYCASYYDSSFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 16342 - protein, 117 aa, Artificial Sequence; identical to SEQ ID NO: 11021
  Description of Artificial Sequence: Synthetic polypeptide
  VH of XENP017918

SEQ ID NO: 16343 - protein, 5 aa, Artificial Sequence
  Description of Artificial Sequence: Synthetic peptide
  XENP017918 vhCDR1
SYGMS

SEQ ID NO: 16344 - protein, 17 aa, Artificial Sequence
  Description of Artificial Sequence: Synthetic peptide
  XENP017918 vhCDR2
TISGGGRYTYYPDSVKG

SEQ ID NO: 16345 - protein, 8 aa, Artificial Sequence
  Description of Artificial Sequence: Synthetic peptide
  XENP017918 vhCDR3
YYDSSFDY

SEQ ID NO: 16346 - protein, 214 aa, Artificial Sequence; identical to SEQ ID NO: 16326
  Description of Artificial Sequence: Synthetic polypeptide
  XENP017918 6A3_H1.1_L3_IgG1_PVA_/S267K Light Chain

SEQ ID NO: 16347 - protein, 107 aa, Artificial Sequence; identical to SEQ ID NO: 11013
  Description of Artificial Sequence: Synthetic polypeptide
  VL of XENP017918

SEQ ID NO: 16348 - protein, 11 aa, Artificial Sequence
  Description of Artificial Sequence: Synthetic peptide
  XENP017918 vlCDR1
RASQDVGTAVA

SEQ ID NO: 16349 - protein, 7 aa, Artificial Sequence
  Description of Artificial Sequence: Synthetic peptide
  XENP017918 vlCDR2
WASTRHT

SEQ ID NO: 16350 - protein, 9 aa, Artificial Sequence
  Description of Artificial Sequence: Synthetic peptide
  XENP017918 vlCDR3
QHYSIYPWT

SEQ ID NO: 16351 - protein, 451 aa, Artificial Sequence
  Description of Artificial Sequence: Synthetic polypeptide
  XENP018089 H1M7789N_H0L0_IgG1 Heavy Chain
EVQLLESGGGLVQPGGSLRLSCSASGFTFSSYTMNWVRQAPGKGLEWVSGISDTGGNTYYTDSVKGRFTVSRDNSKNTLSLQMNSLRAEDTAVYYCAKDQGGSYPYYFHYWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 16352 - protein, 121 aa, Artificial Sequence
  Description of Artificial Sequence: Synthetic polypeptide
  VH of XENP018089
EVQLLESGGGLVQPGGSLRLSCSASGFTFSSYTMNWVRQAPGKGLEWVSGISDTGGNTYYTDSVKGRFTVSRDNSKNTLSLQMNSLRAEDTAVYYCAKDQGGSYPYYFHYWGQGSLVTVSS

SEQ ID NO: 16353 - protein, 5 aa, Artificial Sequence
  Description of Artificial Sequence: Synthetic peptide
  XENP018089 vhCDR1
SYTMN

SEQ ID NO: 16354 - protein, 17 aa, Artificial Sequence
  Description of Artificial Sequence: Synthetic peptide
  XENP018089 vhCDR2
GISDTGGNTYYTDSVKG

SEQ ID NO: 16355 - protein, 12 aa, Artificial Sequence
  Description of Artificial Sequence: Synthetic peptide
  XENP018089 vhCDR3
DQGGSYPYYFHY

SEQ ID NO: 16356 - protein, 215 aa, Artificial Sequence
  Description of Artificial Sequence: Synthetic polypeptide
  XENP018089 H1M7789N_H0L0_IgG1 Light Chain
DIQMTQSPSSLSASVGDRVTITCRASQSISSYLIWYQQKPGTAPKFLIYAASSLQSGVPSRFSGSGSGTDFTLTISSLQPEDFATYYCQQSYSTPPITFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16357 - protein, 108 aa, Artificial Sequence
  Description of Artificial Sequence: Synthetic polypeptide
  VL of XENP018089
DIQMTQSPSSLSASVGDRVTITCRASQSISSYLIWYQQKPGTAPKFLIYAASSLQSGVPSRFSGSGSGTDFTLTISSLQPEDFATYYCQQSYSTPPITFGQGTRLEIK

SEQ ID NO: 16358 - protein, 11 aa, Artificial Sequence
  Description of Artificial Sequence: Synthetic peptide
  XENP018089 vlCDR1
RASQSISSYLI

SEQ ID NO: 16359 - protein, 7 aa, Artificial Sequence
  Description of Artificial Sequence: Synthetic peptide
  XENP018089 vlCDR2
AASSLQS

SEQ ID NO: 16360 - protein, 10 aa, Artificial Sequence
  Description of Artificial Sequence: Synthetic peptide
  XENP018089 vlCDR3
QQSYSTPPIT

SEQ ID NO: 16361 - protein, 446 aa, Artificial Sequence
  Description of Artificial Sequence: Synthetic polypeptide
  XENP018090 H2aM7791N_H0L0_IgG1 Heavy Chain
QMQLQQWGAGLLKPSETLSLTCVVYGGSLNGYYWSWIRQSPGKGLEWIGEIDHSGSTNYNPSLKNRVTMSVDTSKIQFSLKLTSVTVADTAVYYCAREGLLPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 16362 - protein, 116 aa, Artificial Sequence
  Description of Artificial Sequence: Synthetic polypeptide
  VH of XENP018090
QMQLQQWGAGLLKPSETLSLTCVVYGGSLNGYYWSWIRQSPGKGLEWIGEIDHSGSTNYNPSLKNRVTMSVDTSKIQFSLKLTSVTVADTAVYYCAREGLLPFDYWGQGTLVTVSS

SEQ ID NO: 16363 - protein, 5 aa, Artificial Sequence
  Description of Artificial Sequence: Synthetic peptide
  XENP018090 vhCDR1
GYYWS

SEQ ID NO: 16364 - protein, 16 aa, Artificial Sequence
  Description of Artificial Sequence: Synthetic peptide
  XENP018090 vhCDR2
EIDHSGSTNYNPSLKN

SEQ ID NO: 16365 - protein, 8 aa, Artificial Sequence
  Description of Artificial Sequence: Synthetic peptide
  XENP018090 vhCDR3
EGLLPFDY

SEQ ID NO: 16366 - protein, 215 aa, Artificial Sequence
  Description of Artificial Sequence: Synthetic polypeptide
  XENP018090 H2aM7791N_H0L0_IgG1 Light Chain
EIVLTQSPGTLSLSPGERVTLSCRASQSVYSNYLAWYQQNPGQAPRLLIYAASNRATGIPDRFSGSGSGTDFTLTISRLEPEDFAVYYCHQYATSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16367 - protein, 108 aa, Artificial Sequence
  Description of Artificial Sequence: Synthetic polypeptide
  VL of XENP018090
EIVLTQSPGTLSLSPGERVTLSCRASQSVYSNYLAWYQQNPGQAPRLLIYAASNRATGIPDRFSGSGSGTDFTLTISRLEPEDFAVYYCHQYATSPWTFGQGTKVEIK

SEQ ID NO: 16368 - protein, 12 aa, Artificial Sequence
  Description of Artificial Sequence: Synthetic peptide
  XENP018090 vlCDR1
RASQSVYSNYLA

SEQ ID NO: 16369 - protein, 7 aa, Artificial Sequence
  Description of Artificial Sequence: Synthetic peptide
  XENP018090 vlCDR2
AASNRAT

SEQ ID NO: 16370 - protein, 9 aa, Artificial Sequence
  Description of Artificial Sequence: Synthetic peptide
  XENP018090 vlCDR3
HQYATSPWT

SEQ ID NO: 16371 - protein, 446 aa, Artificial Sequence
  Description of Artificial Sequence: Synthetic polypeptide
  XENP018091 H2aM7796N_H0L0_IgG1 Heavy Chain
QVQLVESGGGVVQPGRSLRLSCAASGFTFSSYGMHWVRQAPGKGLEWVAIIWSDGDSEYNLDSVKGRFTISRDNSKNTLYLQMNSLRVEDSAVYYCARDRDLEDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 16372 - protein, 116 aa, Artificial Sequence
  Description of Artificial Sequence: Synthetic polypeptide
  VH of XENP018091
QVQLVESGGGVVQPGRSLRLSCAASGFTFSSYGMHWVRQAPGKGLEWVAIIWSDGDSEYNLDSVKGRFTISRDNSKNTLYLQMNSLRVEDSAVYYCARDRDLEDIWGQGTMVTVSS

SEQ ID NO: 16373 - protein, 5 aa, Artificial Sequence
  Description of Artificial Sequence: Synthetic peptide
  XENP018091 vhCDR1
SYGMH

SEQ ID NO: 16374 - protein, 17 aa, Artificial Sequence
  Description of Artificial Sequence: Synthetic peptide
  XENP018091 vhCDR2
IIWSDGDSEYNLDSVKG

SEQ ID NO: 16375 - protein, 7 aa, Artificial Sequence
  Description of Artificial Sequence: Synthetic peptide
  XENP018091 vhCDR3
DRDLEDI

SEQ ID NO: 16376 - protein, 214 aa, Artificial Sequence
  Description of Artificial Sequence: Synthetic polypeptide
  XENP018091 H2aM7796N_H0L0_IgG1 Light Chain
DIQMTQSPSSLSASVGDRVTITCRASQGIRNDLGWYQQKPGKAPKRLIYAASNLQSGVPSRFSGSGSGTEFTLTISSLQPEDFATYYCLQHNSYPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16377 - protein, 107 aa, Artificial Sequence
  Description of Artificial Sequence: Synthetic polypeptide
  VL of XENP018091
DIQMTQSPSSLSASVGDRVTITCRASQGIRNDLGWYQQKPGKAPKRLIYAASNLQSGVPSRFSGSGSGTEFTLTISSLQPEDFATYYCLQHNSYPLTFGGGTKVEIK

SEQ ID NO: 16378 - protein, 11 aa, Artificial Sequence
  Description of Artificial Sequence: Synthetic peptide
  XENP018091 vlCDR1
RASQGIRNDLG

SEQ ID NO: 16379 - protein, 7 aa, Artificial Sequence
  Description of Artificial Sequence: Synthetic peptide
  XENP018091 vlCDR2
AASNLQS

SEQ ID NO: 16380 - protein, 9 aa, Artificial Sequence
  Description of Artificial Sequence: Synthetic peptide
  XENP018091 vlCDR3
LQHNSYPLT

SEQ ID NO: 16381 - protein, 451 aa, Artificial Sequence
  Description of Artificial Sequence: Synthetic polypeptide
  XENP018092 H4H9057P2_H0L0_IgG1 Heavy Chain
EVQLVESGGGLVQSGRSLRLSCAASGFTFDDYAMHWVRQPPGKGLEWVSGINWNRGRTGYADSVKGRFTISRDNAKNSLYLQMNDLRVEDTALYYCAKAEQWLDEGYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 16382 - protein, 121 aa, Artificial Sequence
  Description of Artificial Sequence: Synthetic polypeptide
  VH of XENP018092
EVQLVESGGGLVQSGRSLRLSCAASGFTFDDYAMHWVRQPPGKGLEWVSGINWNRGRTGYADSVKGRFTISRDNAKNSLYLQMNDLRVEDTALYYCAKAEQWLDEGYFDYWGQGTLVTVSS

SEQ ID NO: 16383 - protein, 5 aa, Artificial Sequence
  Description of Artificial Sequence: Synthetic peptide
  XENP018092 vhCDR1
DYAMH

SEQ ID NO: 16384 - protein, 17 aa, Artificial Sequence
  Description of Artificial Sequence: Synthetic peptide
  XENP018092 vhCDR2
GINWNRGRTGYADSVKG

SEQ ID NO: 16385 - protein, 12 aa, Artificial Sequence
  Description of Artificial Sequence: Synthetic peptide
  XENP018092 vhCDR3
AEQWLDEGYFDY

SEQ ID NO: 16386 - protein, 215 aa, Artificial Sequence
  Description of Artificial Sequence: Synthetic polypeptide
  XENP018092 H4H9057P2_H0L0_IgG1 Light Chain
DIQMTQSPSSLSASVGDRVTITCRASQSISSYLNWYQQKPGKAPKLLIYAASSLQSGVPSRFSGSGSGTDFTLTISSLQPEDFATYYCQQSYSTPPITFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16387 - protein, 108 aa, Artificial Sequence; identical to SEQ ID NO: 4405
  Description of Artificial Sequence: Synthetic polypeptide
  VL of XENP018092

SEQ ID NO: 16388 - protein, 11 aa, Artificial Sequence
  Description of Artificial Sequence: Synthetic peptide
  XENP018092 vlCDR1
RASQSISSYLN

SEQ ID NO: 16389 - protein, 7 aa, Artificial Sequence
  Description of Artificial Sequence: Synthetic peptide
  XENP018092 vlCDR2
AASSLQS

SEQ ID NO: 16390 - protein, 10 aa, Artificial Sequence
  Description of Artificial Sequence: Synthetic peptide
  XENP018092 vlCDR3
QQSYSTPPIT

SEQ ID NO: 16391 - protein, 451 aa, Artificial Sequence
  Description of Artificial Sequence: Synthetic polypeptide
  XENP018093 H4H9068P2_H0L0_IgG1 Heavy Chain
EVQLVESGGGLVQPGGSLRLSCAASGFSFSSYAMNWVRQAPGKGLEWVSTISDSGGSTYYADSVKGRFTISRDNSKNTLSLQMNSLRAEDTAVYYCAKDQGGSYPYYFHYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 16392 - protein, 121 aa, Artificial Sequence
  Description of Artificial Sequence: Synthetic polypeptide
  VH of XENP018093
EVQLVESGGGLVQPGGSLRLSCAASGFSFSSYAMNWVRQAPGKGLEWVSTISDSGGSTYYADSVKGRFTISRDNSKNTLSLQMNSLRAEDTAVYYCAKDQGGSYPYYFHYWGQGTLVTVSS

SEQ ID NO: 16393 - protein, 5 aa, Artificial Sequence
  Description of Artificial Sequence: Synthetic peptide
  XENP018093 vhCDR1
SYAMN

SEQ ID NO: 16394 - protein, 17 aa, Artificial Sequence
  Description of Artificial Sequence: Synthetic peptide
  XENP018093 vhCDR2
TISDSGGSTYYADSVKG

SEQ ID NO: 16395 - protein, 12 aa, Artificial Sequence
  Description of Artificial Sequence: Synthetic peptide
  XENP018093 vhCDR3
DQGGSYPYYFHY

SEQ ID NO: 16396 - protein, 215 aa, Artificial Sequence; identical to SEQ ID NO: 16386
  Description of Artificial Sequence: Synthetic polypeptide
  XENP018093 H4H9068P2_H0L0_IgG1 Light Chain

SEQ ID NO: 16397 - protein, 108 aa, Artificial Sequence; identical to SEQ ID NO: 4405
  Description of Artificial Sequence: Synthetic polypeptide
  VL of XENP018093

SEQ ID NO: 16398 - protein, 11 aa, Artificial Sequence
  Description of Artificial Sequence: Synthetic peptide
  XENP018093 vlCDR1
RASQSISSYLN

SEQ ID NO: 16399 - protein, 7 aa, Artificial Sequence
  Description of Artificial Sequence: Synthetic peptide
  XENP018093 vlCDR2
AASSLQS

SEQ ID NO: 16400 - protein, 10 aa, Artificial Sequence
  Description of Artificial Sequence: Synthetic peptide
  XENP018093 vlCDR3
QQSYSTPPIT

SEQ ID NO: 16401 - protein, 451 aa, Artificial Sequence
  Description of Artificial Sequence: Synthetic polypeptide
  XENP018094 1G6_H1.1_L1_IgG1_PVA_/S267K Heavy Chain
QVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 16402 - protein, 122 aa, Artificial Sequence; identical to SEQ ID NO: 11039
  Description of Artificial Sequence: Synthetic polypeptide
  VH of XENP018094

SEQ ID NO: 16403 - protein, 5 aa, Artificial Sequence
  Description of Artificial Sequence: Synthetic peptide
  XENP018094 vhCDR1
NYWMN

SEQ ID NO: 16404 - protein, 19 aa, Artificial Sequence
  Description of Artificial Sequence: Synthetic peptide
  XENP018094 vhCDR2
EIRLKSNNYATHYAEPVKG

SEQ ID NO: 16405 - protein, 11 aa, Artificial Sequence
  Description of Artificial Sequence: Synthetic peptide
  XENP018094 vhCDR3
YYGNYGGYFDV

SEQ ID NO: 16406 - protein, 214 aa, Artificial Sequence; identical to SEQ ID NO: 16226
  Description of Artificial Sequence: Synthetic polypeptide
  XENP018094 1G6_H1.1_L1_IgG1_PVA_/S267K Light Chain

SEQ ID NO: 16407 - protein, 107 aa, Artificial Sequence; identical to SEQ ID NO: 10923
  Description of Artificial Sequence: Synthetic polypeptide
  VL of XENP018094

SEQ ID NO: 16408 - protein, 11 aa, Artificial Sequence
  Description of Artificial Sequence: Synthetic peptide
  XENP018094 vlCDR1
RASQSVSNDVA

SEQ ID NO: 16409 - protein, 7 aa, Artificial Sequence
  Description of Artificial Sequence: Synthetic peptide
  XENP018094 vlCDR2
YASHRYT

SEQ ID NO: 16410 - protein, 9 aa, Artificial Sequence
  Description of Artificial Sequence: Synthetic peptide
  XENP018094 vlCDR3
QQDYSSPRT

SEQ ID NO: 16411 - protein, 451 aa, Artificial Sequence
  Description of Artificial Sequence: Synthetic polypeptide
  XENP018095 1G6_H1.2_L1_IgG1_PVA_/S267K Heavy Chain
EVKLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 16412 - protein, 122 aa, Artificial Sequence; identical to SEQ ID NO: 11048
  Description of Artificial Sequence: Synthetic polypeptide
  VH of XENP018095

SEQ ID NO: 16413 - protein, 5 aa, Artificial Sequence
  Description of Artificial Sequence: Synthetic peptide
  XENP018095 vhCDR1
NYWMN

SEQ ID NO: 16414 - protein, 19 aa, Artificial Sequence
  Description of Artificial Sequence: Synthetic peptide
  XENP018095 vhCDR2
EIRLKSNNYATHYAEPVKG

SEQ ID NO: 16415 - protein, 11 aa, Artificial Sequence
  Description of Artificial Sequence: Synthetic peptide
  XENP018095 vhCDR3
YYGNYGGYFDV

SEQ ID NO: 16416 - protein, 214 aa, Artificial Sequence; identical to SEQ ID NO: 16226
  Description of Artificial Sequence: Synthetic polypeptide
  XENP018095 1G6_H1.2_L1_IgG1_PVA_/S267K Light Chain

SEQ ID NO: 16417 - protein, 107 aa, Artificial Sequence; identical to SEQ ID NO: 10923
  Description of Artificial Sequence: Synthetic polypeptide
  VL of XENP018095

SEQ ID NO: 16418 - protein, 11 aa, Artificial Sequence
  Description of Artificial Sequence: Synthetic peptide
  XENP018095 vlCDR1
RASQSVSNDVA

SEQ ID NO: 16419 - protein, 7 aa, Artificial Sequence
  Description of Artificial Sequence: Synthetic peptide
  XENP018095 vlCDR2
YASHRYT

SEQ ID NO: 16420 - protein, 9 aa, Artificial Sequence
  Description of Artificial Sequence: Synthetic peptide
  XENP018095 vlCDR3
QQDYSSPRT

SEQ ID NO: 16421 - protein, 451 aa, Artificial Sequence
  Description of Artificial Sequence: Synthetic polypeptide
  XENP018096 1G6_H1.3_L1_IgG1_PVA_/S267K Heavy Chain
EVQLEESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 16422 - protein, 122 aa, Artificial Sequence; identical to SEQ ID NO: 11057
  Description of Artificial Sequence: Synthetic polypeptide
  VH of XENP018096

SEQ ID NO: 16423 - protein, 5 aa, Artificial Sequence
  Description of Artificial Sequence: Synthetic peptide
  XENP018096 vhCDR1
NYWMN

SEQ ID NO: 16424 - protein, 19 aa, Artificial Sequence
  Description of Artificial Sequence: Synthetic peptide
  XENP018096 vhCDR2
EIRLKSNNYATHYAEPVKG

SEQ ID NO: 16425 - protein, 11 aa, Artificial Sequence
  Description of Artificial Sequence: Synthetic peptide
  XENP018096 vhCDR3
YYGNYGGYFDV

SEQ ID NO: 16426 - protein, 214 aa, Artificial Sequence; identical to SEQ ID NO: 16226
  Description of Artificial Sequence: Synthetic polypeptide
  XENP018096 1G6_H1.3_L1_IgG1_PVA_/S267K Light Chain

SEQ ID NO: 16427 - protein, 107 aa, Artificial Sequence; identical to SEQ ID NO: 10923
  Description of Artificial Sequence: Synthetic polypeptide
  VL of XENP018096

SEQ ID NO: 16428 - protein, 11 aa, Artificial Sequence
  Description of Artificial Sequence: Synthetic peptide
  XENP018096 vlCDR1
RASQSVSNDVA

SEQ ID NO: 16429 - protein, 7 aa, Artificial Sequence
  Description of Artificial Sequence: Synthetic peptide
  XENP018096 vlCDR2
YASHRYT

SEQ ID NO: 16430 - protein, 9 aa, Artificial Sequence
  Description of Artificial Sequence: Synthetic peptide
  XENP018096 vlCDR3
QQDYSSPRT

SEQ ID NO: 16431 - protein, 451 aa, Artificial Sequence
  Description of Artificial Sequence: Synthetic polypeptide
  XENP018101 1G6_H1.4_L1_IgG1_PVA_/S267K Heavy Chain
EVQLVESGGGLVQPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 16432 - protein, 122 aa, Artificial Sequence; identical to SEQ ID NO: 11066
  Description of Artificial Sequence: Synthetic polypeptide
  VH of XENP018101

SEQ ID NO: 16433 - protein, 5 aa, Artificial Sequence
  Description of Artificial Sequence: Synthetic peptide
  XENP018101 vhCDR1
NYWMN

SEQ ID NO: 16434 - protein, 19 aa, Artificial Sequence
  Description of Artificial Sequence: Synthetic peptide
  XENP018101 vhCDR2
EIRLKSNNYATHYAEPVKG

SEQ ID NO: 16435 - protein, 11 aa, Artificial Sequence
  Description of Artificial Sequence: Synthetic peptide
  XENP018101 vhCDR3
YYGNYGGYFDV

SEQ ID NO: 16436 - protein, 214 aa, Artificial Sequence; identical to SEQ ID NO: 16226
  Description of Artificial Sequence: Synthetic polypeptide
  XENP018101 1G6_H1.4_L1_IgG1_PVA_/S267K Light Chain

SEQ ID NO: 16437 - protein, 107 aa, Artificial Sequence; identical to SEQ ID NO: 10923
  Description of Artificial Sequence: Synthetic polypeptide
  VL of XENP018101

SEQ ID NO: 16438 - protein, 11 aa, Artificial Sequence
  Description of Artificial Sequence: Synthetic peptide
  XENP018101 vlCDR1
RASQSVSNDVA

SEQ ID NO: 16439 - protein, 7 aa, Artificial Sequence
  Description of Artificial Sequence: Synthetic peptide
  XENP018101 vlCDR2
YASHRYT

SEQ ID NO: 16440 - protein, 9 aa, Artificial Sequence
  Description of Artificial Sequence: Synthetic peptide
  XENP018101 vlCDR3
QQDYSSPRT

SEQ ID NO: 16441 - protein, 451 aa, Artificial Sequence
  Description of Artificial Sequence: Synthetic polypeptide
  XENP018102 1G6_H1.5_L1_IgG1_PVA_/S267K Heavy Chain
EVQLVESGGGLVRPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 16442 - protein, 122 aa, Artificial Sequence; identical to SEQ ID NO: 11075
  Description of Artificial Sequence: Synthetic polypeptide
  VH of XENP018102

SEQ ID NO: 16443 - protein, 5 aa, Artificial Sequence
  Description of Artificial Sequence: Synthetic peptide
  XENP018102 vhCDR1
NYWMN

SEQ ID NO: 16444 - protein, 19 aa, Artificial Sequence
  Description of Artificial Sequence: Synthetic peptide
  XENP018102 vhCDR2
EIRLKSNNYATHYAEPVKG

SEQ ID NO: 16445 - protein, 11 aa, Artificial Sequence
  Description of Artificial Sequence: Synthetic peptide
  XENP018102 vhCDR3
YYGNYGGYFDV

SEQ ID NO: 16446 - protein, 214 aa, Artificial Sequence; identical to SEQ ID NO: 16226
  Description of Artificial Sequence: Synthetic polypeptide
  XENP018102 1G6_H1.5_L1_IgG1_PVA_/S267K Light Chain

SEQ ID NO: 16447 - protein, 107 aa, Artificial Sequence; identical to SEQ ID NO: 10923
  Description of Artificial Sequence: Synthetic polypeptide
  VL of XENP018102

SEQ ID NO: 16448 - protein, 11 aa, Artificial Sequence
  Description of Artificial Sequence: Synthetic peptide
  XENP018102 vlCDR1
RASQSVSNDVA

SEQ ID NO: 16449 - protein, 7 aa, Artificial Sequence
  Description of Artificial Sequence: Synthetic peptide
  XENP018102 vlCDR2
YASHRYT

SEQ ID NO: 16450 - protein, 9 aa, Artificial Sequence
  Description of Artificial Sequence: Synthetic peptide
  XENP018102 vlCDR3
QQDYSSPRT

SEQ ID NO: 16451 - protein, 451 aa, Artificial Sequence
  Description of Artificial Sequence: Synthetic polypeptide
  XENP018103 1G6_H1.6_L1_IgG1_PVA_/S267K Heavy Chain
EVQLVESGGGLVKPGGSMRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 16452 - protein, 122 aa, Artificial Sequence; identical to SEQ ID NO: 11084
  Description of Artificial Sequence: Synthetic polypeptide
  VH of XENP018103

SEQ ID NO: 16453 - protein, 5 aa, Artificial Sequence
  Description of Artificial Sequence: Synthetic peptide
  XENP018103 vhCDR1
NYWMN

SEQ ID NO: 16454 - protein, 19 aa, Artificial Sequence
  Description of Artificial Sequence: Synthetic peptide
  XENP018103 vhCDR2
EIRLKSNNYATHYAEPVKG

SEQ ID NO: 16455 - protein, 11 aa, Artificial Sequence
  Description of Artificial Sequence: Synthetic peptide
  XENP018103 vhCDR3
YYGNYGGYFDV

SEQ ID NO: 16456 - protein, 214 aa, Artificial Sequence; identical to SEQ ID NO: 16226
  Description of Artificial Sequence: Synthetic polypeptide
  XENP018103 1G6_H1.6_L1_IgG1_PVA_/S267K Light Chain

SEQ ID NO: 16457 - protein, 107 aa, Artificial Sequence; identical to SEQ ID NO: 10923
  Description of Artificial Sequence: Synthetic polypeptide
  VL of XENP018103

SEQ ID NO: 16458 - protein, 11 aa, Artificial Sequence
  Description of Artificial Sequence: Synthetic peptide
  XENP018103 vlCDR1
RASQSVSNDVA

SEQ ID NO: 16459 - protein, 7 aa, Artificial Sequence
  Description of Artificial Sequence: Synthetic peptide
  XENP018103 vlCDR2
YASHRYT

SEQ ID NO: 16460 - protein, 9 aa, Artificial Sequence
  Description of Artificial Sequence: Synthetic peptide
  XENP018103 vlCDR3
QQDYSSPRT

SEQ ID NO: 16461 - protein, 451 aa, Artificial Sequence
  Description of Artificial Sequence: Synthetic polypeptide
  XENP018104 1G6_H1.7_L1_IgG1_PVA_/S267K Heavy Chain
EVQLVESGGGLVKPGGSLKLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 16462 - protein, 122 aa, Artificial Sequence; identical to SEQ ID NO: 11093
  Description of Artificial Sequence: Synthetic polypeptide
  VH of XENP018104

SEQ ID NO: 16463 - protein, 5 aa, Artificial Sequence
  Description of Artificial Sequence: Synthetic peptide
  XENP018104 vhCDR1
NYWMN

SEQ ID NO: 16464 - protein, 19 aa, Artificial Sequence
  Description of Artificial Sequence: Synthetic peptide
  XENP018104 vhCDR2
EIRLKSNNYATHYAEPVKG

SEQ ID NO: 16465 - protein, 11 aa, Artificial Sequence
  Description of Artificial Sequence: Synthetic peptide
  XENP018104 vhCDR3
YYGNYGGYFDV

SEQ ID NO: 16466 - protein, 214 aa, Artificial Sequence; identical to SEQ ID NO: 16226
  Description of Artificial Sequence: Synthetic polypeptide
  XENP018104 1G6_H1.7_L1_IgG1_PVA_/S267K Light Chain

SEQ ID NO: 16467 - protein, 107 aa, Artificial Sequence; identical to SEQ ID NO: 10923
  Description of Artificial Sequence: Synthetic polypeptide
  VL of XENP018104

SEQ ID NO: 16468 - protein, 11 aa, Artificial Sequence
  Description of Artificial Sequence: Synthetic peptide
  XENP018104 vlCDR1
RASQSVSNDVA

SEQ ID NO: 16469 - protein, 7 aa, Artificial Sequence
  Description of Artificial Sequence: Synthetic peptide
  XENP018104 vlCDR2
YASHRYT

SEQ ID NO: 16470 - protein, 9 aa, Artificial Sequence
  Description of Artificial Sequence: Synthetic peptide
  XENP018104 vlCDR3
QQDYSSPRT

SEQ ID NO: 16471 - protein, 451 aa, Artificial Sequence
  Description of Artificial Sequence: Synthetic polypeptide
  XENP018105 1G6_H1.8_L1_IgG1_PVA_/S267K Heavy Chain
EVQLVESGGGLVKPGGSLRLSCVASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 16472 - protein, 122 aa, Artificial Sequence; identical to SEQ ID NO: 11102
  Description of Artificial Sequence: Synthetic polypeptide
  VH of XENP018105

SEQ ID NO: 16473 - protein, 5 aa, Artificial Sequence
  Description of Artificial Sequence: Synthetic peptide
  XENP018105 vhCDR1
NYWMN

SEQ ID NO: 16474 - protein, 19 aa, Artificial Sequence
  Description of Artificial Sequence: Synthetic peptide
  XENP018105 vhCDR2
EIRLKSNNYATHYAEPVKG

SEQ ID NO: 16475 - protein, 11 aa, Artificial Sequence
  Description of Artificial Sequence: Synthetic peptide
  XENP018105 vhCDR3
YYGNYGGYFDV

SEQ ID NO: 16476 - protein, 214 aa, Artificial Sequence; identical to SEQ ID NO: 16226
  Description of Artificial Sequence: Synthetic polypeptide
  XENP018105 1G6_H1.8_L1_IgG1_PVA_/S267K Light Chain

SEQ ID NO: 16477 - protein, 107 aa, Artificial Sequence; identical to SEQ ID NO: 10923
  Description of Artificial Sequence: Synthetic polypeptide
  VL of XENP018105

SEQ ID NO: 16478 - protein, 11 aa, Artificial Sequence
  Description of Artificial Sequence: Synthetic peptide
  XENP018105 vlCDR1
RASQSVSNDVA

SEQ ID NO: 16479 - protein, 7 aa, Artificial Sequence
  Description of Artificial Sequence: Synthetic peptide
  XENP018105 vlCDR2
YASHRYT

SEQ ID NO: 16480 - protein, 9 aa, Artificial Sequence
  Description of Artificial Sequence: Synthetic peptide
  XENP018105 vlCDR3
QQDYSSPRT

SEQ ID NO: 16481 - protein, 451 aa, Artificial Sequence
  Description of Artificial Sequence: Synthetic polypeptide
  XENP018106 1G6_H1.9_L1_IgG1_PVA_/S267K Heavy Chain
EVQLVESGGGLVKPGGSLRLSCAASGFTVSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 16482 - protein, 122 aa, Artificial Sequence; identical to SEQ ID NO: 11111
  Description of Artificial Sequence: Synthetic polypeptide
  VH of XENP018106

SEQ ID NO: 16483 - protein, 5 aa, Artificial Sequence
  Description of Artificial Sequence: Synthetic peptide
  XENP018106 vhCDR1
NYWMN

SEQ ID NO: 16484 - protein, 19 aa, Artificial Sequence
  Description of Artificial Sequence: Synthetic peptide
  XENP018106 vhCDR2
EIRLKSNNYATHYAEPVKG

SEQ ID NO: 16485 - protein, 11 aa, Artificial Sequence
  Description of Artificial Sequence: Synthetic peptide
  XENP018106 vhCDR3
YYGNYGGYFDV

SEQ ID NO: 16486 - protein, 214 aa, Artificial Sequence; identical to SEQ ID NO: 16226
  Description of Artificial Sequence: Synthetic polypeptide
  XENP018106 1G6_H1.9_L1_IgG1_PVA_/S267K Light Chain

SEQ ID NO: 16487 - protein, 107 aa, Artificial Sequence; identical to SEQ ID NO: 10923
  Description of Artificial Sequence: Synthetic polypeptide
  VL of XENP018106

SEQ ID NO: 16488 - protein, 11 aa, Artificial Sequence
  Description of Artificial Sequence: Synthetic peptide
  XENP018106 vlCDR1
RASQSVSNDVA

SEQ ID NO: 16489 - protein, 7 aa, Artificial Sequence
  Description of Artificial Sequence: Synthetic peptide
  XENP018106 vlCDR2
YASHRYT

SEQ ID NO: 16490 - protein, 9 aa, Artificial Sequence
  Description of Artificial Sequence: Synthetic peptide
  XENP018106 vlCDR3
QQDYSSPRT

SEQ ID NO: 16491 - protein, 451 aa, Artificial Sequence
  Description of Artificial Sequence: Synthetic polypeptide
  XENP018107 1G6_H1.10_L1_IgG1_PVA_/S267K Heavy Chain
EVQLVESGGGLVKPGGSLRLSCAASGFTFTNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 16492 - protein, 122 aa, Artificial Sequence; identical to SEQ ID NO: 11120
  Description of Artificial Sequence: Synthetic polypeptide
  VH of XENP018107

SEQ ID NO: 16493 - protein, 5 aa, Artificial Sequence
  Description of Artificial Sequence: Synthetic peptide
  XENP018107 vhCDR1
NYWMN

SEQ ID NO: 16494 - protein, 19 aa, Artificial Sequence
  Description of Artificial Sequence: Synthetic peptide
  XENP018107 vhCDR2
EIRLKSNNYATHYAEPVKG

SEQ ID NO: 16495 - protein, 11 aa, Artificial Sequence
  Description of Artificial Sequence: Synthetic peptide
  XENP018107 vhCDR3
YYGNYGGYFDV

SEQ ID NO: 16496 - protein, 214 aa, Artificial Sequence; identical to SEQ ID NO: 16226
  Description of Artificial Sequence: Synthetic polypeptide
  XENP018107 1G6_H1.10_L1_IgG1_PVA_/S267K Light Chain

SEQ ID NO: 16497 - protein, 107 aa, Artificial Sequence; identical to SEQ ID NO: 10923
  Description of Artificial Sequence: Synthetic polypeptide
  VL of XENP018107

SEQ ID NO: 16498 - protein, 11 aa, Artificial Sequence
  Description of Artificial Sequence: Synthetic peptide
  XENP018107 vlCDR1
RASQSVSNDVA

SEQ ID NO: 16499 - protein, 7 aa, Artificial Sequence
  Description of Artificial Sequence: Synthetic peptide
  XENP018107 vlCDR2
YASHRYT

SEQ ID NO: 16500 - protein, 9 aa, Artificial Sequence
  Description of Artificial Sequence: Synthetic peptide
  XENP018107 vlCDR3
QQDYSSPRT

SEQ ID NO: 16501 - protein, 451 aa, Artificial Sequence
  Description of Artificial Sequence: Synthetic polypeptide
  XENP018108 1G6_H1.11_L1_IgG1_PVA_/S267K Heavy Chain
EVQLVESGGGLVKPGGSLRLSCAASGFTFANYWMNWVRQAPGKGLEWVGEIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 16502 - protein, 122 aa, Artificial Sequence; identical to SEQ ID NO: 11129
  Description of Artificial Sequence: Synthetic polypeptide
  VH of XENP018108

SEQ ID NO: 16503 - protein, 5 aa, Artificial Sequence
  Description of Artificial Sequence: Synthetic peptide
  XENP018108 vhCDR1
NYWMN

SEQ ID NO: 16504 - protein, 19 aa, Artificial Sequence
  Description of Artificial Sequence: Synthetic peptide
  XENP018108 vhCDR2
EIRLKSNNYATHYAEPVKG

SEQ ID NO: 16505 - protein, 11 aa, Artificial Sequence
  Description of Artificial Sequence: Synthetic peptide
  XENP018108 vhCDR3
YYGNYGGYFDV

SEQ ID NO: 16506 - protein, 214 aa, Artificial Sequence; identical to SEQ ID NO: 16226
  Description of Artificial Sequence: Synthetic polypeptide
  XENP018108 1G6_H1.11_L1_IgG1_PVA_/S267K Light Chain

SEQ ID NO: 16507 - protein, 107 aa, Artificial Sequence; identical to SEQ ID NO: 10923
  Description of Artificial Sequence: Synthetic polypeptide
  VL of XENP018108

SEQ ID NO: 16508 - protein, 11 aa, Artificial Sequence
  Description of Artificial Sequence: Synthetic peptide
  XENP018108 vlCDR1
RASQSVSNDVA

SEQ ID NO: 16509 - protein, 7 aa, Artificial Sequence
  Description of Artificial Sequence: Synthetic peptide
  XENP018108 vlCDR2
YASHRYT

SEQ ID NO: 16510 - protein, 9 aa, Artificial Sequence
  Description of Artificial Sequence: Synthetic peptide
  XENP018108 vlCDR3
QQDYSSPRT

SEQ ID NO: 16511 - protein, 451 aa, Artificial Sequence
  Description of Artificial Sequence: Synthetic polypeptide
  XENP018109 1G6_H1.12_L1_IgG1_PVA_/S267K Heavy Chain
EVQLVESGGGLVKPGGSLRLSCAASGFTFQNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 16512 - protein, 122 aa, Artificial Sequence; identical to SEQ ID NO: 11138
  Description of Artificial Sequence: Synthetic polypeptide
  VH of XENP018109

SEQ ID NO: 16513 - protein, 5 aa, Artificial Sequence
  Description of Artificial Sequence: Synthetic peptide
  XENP018109 vhCDR1
NYWMN

SEQ ID NO: 16514 - protein, 19 aa, Artificial Sequence
  Description of Artificial Sequence: Synthetic peptide
  XENP018109 vhCDR2
EIRLKSNNYATHYAEPVKG

SEQ ID NO: 16515 - protein, 11 aa, Artificial Sequence
  Description of Artificial Sequence: Synthetic peptide
  XENP018109 vhCDR3
YYGNYGGYFDV

SEQ ID NO: 16516 - protein, 214 aa, Artificial Sequence; identical to SEQ ID NO: 16226
  Description of Artificial Sequence: Synthetic polypeptide
  XENP018109 1G6_H1.12_L1_IgG1_PVA_/S267K Light Chain

SEQ ID NO: 16517 - protein, 107 aa, Artificial Sequence; identical to SEQ ID NO: 10923
  Description of Artificial Sequence: Synthetic polypeptide
  VL of XENP018109

SEQ ID NO: 16518 - protein, 11 aa, Artificial Sequence
  Description of Artificial Sequence: Synthetic peptide
  XENP018109 vlCDR1
RASQSVSNDVA

SEQ ID NO: 16519 - protein, 7 aa, Artificial Sequence
  Description of Artificial Sequence: Synthetic peptide
  XENP018109 vlCDR2
YASHRYT

SEQ ID NO: 16520 - protein, 9 aa, Artificial Sequence
  Description of Artificial Sequence: Synthetic peptide
  XENP018109 vlCDR3
QQDYSSPRT

SEQ ID NO: 16521 - protein, 451 aa, Artificial Sequence
  Description of Artificial Sequence: Synthetic polypeptide
  XENP018110 1G6_H1.13_L1_IgG1_PVA_/S267K Heavy Chain
EVQLVESGGGLVKPGGSLRLSCAASGFTFGNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 16522 - protein, 122 aa, Artificial Sequence; identical to SEQ ID NO: 11147
  Description of Artificial Sequence: Synthetic polypeptide
  VH of XENP018110

SEQ ID NO: 16523 - protein, 5 aa, Artificial Sequence
  Description of Artificial Sequence: Synthetic peptide
  XENP018110 vhCDR1
NYWMN

SEQ ID NO: 16524 - protein, 19 aa, Artificial Sequence
  Description of Artificial Sequence: Synthetic peptide
  XENP018110 vhCDR2
EIRLKSNNYATHYAEPVKG

SEQ ID NO: 16525 - protein, 11 aa, Artificial Sequence
  Description of Artificial Sequence: Synthetic peptide
  XENP018110 vhCDR3
YYGNYGGYFDV

SEQ ID NO: 16526 - protein, 214 aa, Artificial Sequence; identical to SEQ ID NO: 16226
  Description of Artificial Sequence: Synthetic polypeptide
  XENP018110 1G6_H1.13_L1_IgG1_PVA_/S267K Light Chain

SEQ ID NO: 16527 - protein, 107 aa, Artificial Sequence; identical to SEQ ID NO: 10923
  Description of Artificial Sequence: Synthetic polypeptide
  VL of XENP018110

SEQ ID NO: 16528 - protein, 11 aa, Artificial Sequence
  Description of Artificial Sequence: Synthetic peptide
  XENP018110 vlCDR1
RASQSVSNDVA

SEQ ID NO: 16529 - protein, 7 aa, Artificial Sequence
  Description of Artificial Sequence: Synthetic peptide
  XENP018110 vlCDR2
YASHRYT

SEQ ID NO: 16530 - protein, 9 aa, Artificial Sequence
  Description of Artificial Sequence: Synthetic peptide
  XENP018110 vlCDR3
QQDYSSPRT

SEQ ID NO: 16531 - protein, 451 aa, Artificial Sequence
  Description of Artificial Sequence: Synthetic polypeptide
  XENP018111 1G6_H1.14_L1_IgG1_PVA_/S267K Heavy Chain
EVQLVESGGGLVKPGGSLRLSCAASGFTFVNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 16532 - protein, 122 aa, Artificial Sequence; identical to SEQ ID NO: 11156
  Description of Artificial Sequence: Synthetic polypeptide
  VH of XENP018111

SEQ ID NO: 16533 - protein, 5 aa, Artificial Sequence
  Description of Artificial Sequence: Synthetic peptide
  XENP018111 vhCDR1
NYWMN

SEQ ID NO: 16534 - protein, 19 aa, Artificial Sequence
  Description of Artificial Sequence: Synthetic peptide
  XENP018111 vhCDR2
EIRLKSNNYATHYAEPVKG

SEQ ID NO: 16535 - protein, 11 aa, Artificial Sequence
  Description of Artificial Sequence: Synthetic peptide
  XENP018111 vhCDR3
YYGNYGGYFDV

SEQ ID NO: 16536 - protein, 214 aa, Artificial Sequence; identical to SEQ ID NO: 16226
  Description of Artificial Sequence: Synthetic polypeptide
  XENP018111 1G6_H1.14_L1_IgG1_PVA_/S267K Light Chain

SEQ ID NO: 16537 - protein, 107 aa, Artificial Sequence; identical to SEQ ID NO: 10923
  Description of Artificial Sequence: Synthetic polypeptide
  VL of XENP018111

SEQ ID NO: 16538 - protein, 11 aa, Artificial Sequence
  Description of Artificial Sequence: Synthetic peptide
  XENP018111 vlCDR1
RASQSVSNDVA

SEQ ID NO: 16539 - protein, 7 aa, Artificial Sequence
  Description of Artificial Sequence: Synthetic peptide
  XENP018111 vlCDR2
YASHRYT

SEQ ID NO: 16540 - protein, 9 aa, Artificial Sequence
  Description of Artificial Sequence: Synthetic peptide
  XENP018111 vlCDR3
QQDYSSPRT

SEQ ID NO: 16541 - protein, 451 aa, Artificial Sequence
  Description of Artificial Sequence: Synthetic polypeptide
  XENP018112 1G6_H1.15_L1_IgG1_PVA_/S267K Heavy Chain
EVQLVESGGGLVKPGGSLRLSCAASGFTFHNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 16542 - protein, 122 aa, Artificial Sequence; identical to SEQ ID NO: 11165
  Description of Artificial Sequence: Synthetic polypeptide
  VH of XENP018112

SEQ ID NO: 16543 - protein, 5 aa, Artificial Sequence
  Description of Artificial Sequence: Synthetic peptide
  XENP018112 vhCDR1
NYWMN

SEQ ID NO: 16544 - protein, 19 aa, Artificial Sequence
  Description of Artificial Sequence: Synthetic peptide
  XENP018112 vhCDR2
EIRLKSNNYATHYAEPVKG

SEQ ID NO: 16545 - protein, 11 aa, Artificial Sequence
  Description of Artificial Sequence: Synthetic peptide
  XENP018112 vhCDR3
YYGNYGGYFDV

SEQ ID NO: 16546 - protein, 214 aa, Artificial Sequence; identical to SEQ ID NO: 16226
  Description of Artificial Sequence: Synthetic polypeptide
  XENP018112 1G6_H1.15_L1_IgG1_PVA_/S267K Light Chain

SEQ ID NO: 16547 - protein, 107 aa, Artificial Sequence; identical to SEQ ID NO: 10923
  Description of Artificial Sequence: Synthetic polypeptide
  VL of XENP018112

SEQ ID NO: 16548 - protein, 11 aa, Artificial Sequence
  Description of Artificial Sequence: Synthetic peptide
  XENP018112 vlCDR1
RASQSVSNDVA

SEQ ID NO: 16549 - protein, 7 aa, Artificial Sequence
  Description of Artificial Sequence: Synthetic peptide
  XENP018112 vlCDR2
YASHRYT

SEQ ID NO: 16550 - protein, 9 aa, Artificial Sequence
  Description of Artificial Sequence: Synthetic peptide
  XENP018112 vlCDR3
QQDYSSPRT

SEQ ID NO: 16551 - protein, 451 aa, Artificial Sequence
  Description of Artificial Sequence: Synthetic polypeptide
  XENP018113 1G6_H1.16_L1_IgG1_PVA_/S267K Heavy Chain
EVQLVESGGGLVKPGGSLRLSCAASGFTFDNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 16552 - protein, 122 aa, Artificial Sequence; identical to SEQ ID NO: 11174
  Description of Artificial Sequence: Synthetic polypeptide
  VH of XENP018113

SEQ ID NO: 16553 - protein, 5 aa, Artificial Sequence
  Description of Artificial Sequence: Synthetic peptide
  XENP018113 vhCDR1
NYWMN

SEQ ID NO: 16554 - protein, 19 aa, Artificial Sequence
  Description of Artificial Sequence: Synthetic peptide
  XENP018113 vhCDR2
EIRLKSNNYATHYAEPVKG

SEQ ID NO: 16555 - protein, 11 aa, Artificial Sequence
  Description of Artificial Sequence: Synthetic peptide
  XENP018113 vhCDR3
YYGNYGGYFDV

SEQ ID NO: 16556 - protein, 214 aa, Artificial Sequence; identical to SEQ ID NO: 16226
  Description of Artificial Sequence: Synthetic polypeptide
  XENP018113 1G6_H1.16_L1_IgG1_PVA_/S267K Light Chain

SEQ ID NO: 16557 - protein, 107 aa, Artificial Sequence; identical to SEQ ID NO: 10923
  Description of Artificial Sequence: Synthetic polypeptide
  VL of XENP018113

SEQ ID NO: 16558 - protein, 11 aa, Artificial Sequence
  Description of Artificial Sequence: Synthetic peptide
  XENP018113 vlCDR1
RASQSVSNDVA

SEQ ID NO: 16559 - protein, 7 aa, Artificial Sequence
  Description of Artificial Sequence: Synthetic peptide
  XENP018113 vlCDR2
YASHRYT

SEQ ID NO: 16560 - protein, 9 aa, Artificial Sequence
  Description of Artificial Sequence: Synthetic peptide
  XENP018113 vlCDR3
QQDYSSPRT

SEQ ID NO: 16561 - protein, 451 aa, Artificial Sequence
  Description of Artificial Sequence: Synthetic polypeptide
  XENP018114 1G6_H1.17_L1_IgG1_PVA_/S267K Heavy Chain
EVQLVESGGGLVKPGGSLRLSCAASGFTFKNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 16562 - protein, 122 aa, Artificial Sequence; identical to SEQ ID NO: 11183
  Description of Artificial Sequence: Synthetic polypeptide
  VH of XENP018114

SEQ ID NO: 16563 - protein, 5 aa, Artificial Sequence
  Description of Artificial Sequence: Synthetic peptide
  XENP018114 vhCDR1
NYWMN

SEQ ID NO: 16564 - protein, 19 aa, Artificial Sequence
  Description of Artificial Sequence: Synthetic peptide
  XENP018114 vhCDR2
EIRLKSNNYATHYAEPVKG

SEQ ID NO: 16565 - protein, 11 aa, Artificial Sequence
  Description of Artificial Sequence: Synthetic peptide
  XENP018114 vhCDR3
YYGNYGGYFDV

SEQ ID NO: 16566 - protein, 214 aa, Artificial Sequence; identical to SEQ ID NO: 16226
  Description of Artificial Sequence: Synthetic polypeptide
  XENP018114 1G6_H1.17_L1_IgG1_PVA_/S267K Light Chain

SEQ ID NO: 16567 - protein, 107 aa, Artificial Sequence; identical to SEQ ID NO: 10923
  Description of Artificial Sequence: Synthetic polypeptide
  VL of XENP018114

SEQ ID NO: 16568 - protein, 11 aa, Artificial Sequence
  Description of Artificial Sequence: Synthetic peptide
  XENP018114 vlCDR1
RASQSVSNDVA

SEQ ID NO: 16569 - protein, 7 aa, Artificial Sequence
  Description of Artificial Sequence: Synthetic peptide
  XENP018114 vlCDR2
YASHRYT

SEQ ID NO: 16570 - protein, 9 aa, Artificial Sequence
  Description of Artificial Sequence: Synthetic peptide
  XENP018114 vlCDR3
QQDYSSPRT

SEQ ID NO: 16571 - protein, 451 aa, Artificial Sequence
  Description of Artificial Sequence: Synthetic polypeptide
  XENP018115 1G6_H1.18_L1_IgG1_PVA_/S267K Heavy Chain
EVQLVESGGGLVKPGGSLRLSCAASGFTFYNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 16572 - protein, 122 aa, Artificial Sequence; identical to SEQ ID NO: 11192
  Description of Artificial Sequence: Synthetic polypeptide
  VH of XENP018115

SEQ ID NO: 16573 - protein, 5 aa, Artificial Sequence
  Description of Artificial Sequence: Synthetic peptide
  XENP018115 vhCDR1
NYWMN

SEQ ID NO: 16574 - protein, 19 aa, Artificial Sequence
  Description of Artificial Sequence: Synthetic peptide
  XENP018115 vhCDR2
EIRLKSNNYATHYAEPVKG

SEQ ID NO: 16575 - protein, 11 aa, Artificial Sequence
  Description of Artificial Sequence: Synthetic peptide
  XENP018115 vhCDR3
YYGNYGGYFDV

SEQ ID NO: 16576 - protein, 214 aa, Artificial Sequence; identical to SEQ ID NO: 16226
  Description of Artificial Sequence: Synthetic polypeptide
  XENP018115 1G6_H1.18_L1_IgG1_PVA_/S267K Light Chain

SEQ ID NO: 16577 - protein, 107 aa, Artificial Sequence; identical to SEQ ID NO: 10923
  Description of Artificial Sequence: Synthetic polypeptide
  VL of XENP018115

SEQ ID NO: 16578 - protein, 11 aa, Artificial Sequence
  Description of Artificial Sequence: Synthetic peptide
  XENP018115 vlCDR1
RASQSVSNDVA

SEQ ID NO: 16579 - protein, 7 aa, Artificial Sequence
  Description of Artificial Sequence: Synthetic peptide
  XENP018115 vlCDR2
YASHRYT

SEQ ID NO: 16580 - protein, 9 aa, Artificial Sequence
  Description of Artificial Sequence: Synthetic peptide
  XENP018115 vlCDR3
QQDYSSPRT

SEQ ID NO: 16581 - protein, 451 aa, Artificial Sequence
  Description of Artificial Sequence: Synthetic polypeptide
  XENP018116 1G6_H1.19_L1_IgG1_PVA_/S267K Heavy Chain
EVQLVESGGGLVKPGGSLRLSCAASGFTFSDYWMNWVRQAPGKGLEWVGEIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 16582 - protein, 122 aa, Artificial Sequence; identical to SEQ ID NO: 11201
  Description of Artificial Sequence: Synthetic polypeptide
  VH of XENP018116

SEQ ID NO: 16583 - protein, 5 aa, Artificial Sequence
  Description of Artificial Sequence: Synthetic peptide
  XENP018116 vhCDR1
DYWMN

SEQ ID NO: 16584 - protein, 19 aa, Artificial Sequence
  Description of Artificial Sequence: Synthetic peptide
  XENP018116 vhCDR2
EIRLKSNNYATHYAEPVKG

SEQ ID NO: 16585 - protein, 11 aa, Artificial Sequence
  Description of Artificial Sequence: Synthetic peptide
  XENP018116 vhCDR3
YYGNYGGYFDV

SEQ ID NO: 16586 - protein, 214 aa, Artificial Sequence; identical to SEQ ID NO: 16226
  Description of Artificial Sequence: Synthetic polypeptide
  XENP018116 1G6_H1.19_L1_IgG1_PVA_/S267K Light Chain

SEQ ID NO: 16587 - protein, 107 aa, Artificial Sequence; identical to SEQ ID NO: 10923
  Description of Artificial Sequence: Synthetic polypeptide
  VL of XENP018116

SEQ ID NO: 16588 - protein, 11 aa, Artificial Sequence
  Description of Artificial Sequence: Synthetic peptide
  XENP018116 vlCDR1
RASQSVSNDVA

SEQ ID NO: 16589 - protein, 7 aa, Artificial Sequence
  Description of Artificial Sequence: Synthetic peptide
  XENP018116 vlCDR2
YASHRYT

SEQ ID NO: 16590 - protein, 9 aa, Artificial Sequence
  Description of Artificial Sequence: Synthetic peptide
  XENP018116 vlCDR3
QQDYSSPRT

SEQ ID NO: 16591 - protein, 451 aa, Artificial Sequence
  Description of Artificial Sequence: Synthetic polypeptide
  XENP018117 1G6_H1.20_L1_IgG1_PVA_/S267K Heavy Chain
EVQLVESGGGLVKPGGSLRLSCAASGFTFSHYWMNWVRQAPGKGLEWVGEIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 16592 - protein, 122 aa, Artificial Sequence; identical to SEQ ID NO: 11210
  Description of Artificial Sequence: Synthetic polypeptide
  VH of XENP018117

SEQ ID NO: 16593 - protein, 5 aa, Artificial Sequence
  Description of Artificial Sequence: Synthetic peptide
  XENP018117 vhCDR1
HYWMN

SEQ ID NO: 16594 - protein, 19 aa, Artificial Sequence
  Description of Artificial Sequence: Synthetic peptide
  XENP018117 vhCDR2
EIRLKSNNYATHYAEPVKG

SEQ ID NO: 16595 - protein, 11 aa, Artificial Sequence
  Description of Artificial Sequence: Synthetic peptide
  XENP018117 vhCDR3
YYGNYGGYFDV

SEQ ID NO: 16596 - protein, 214 aa, Artificial Sequence; identical to SEQ ID NO: 16226
  Description of Artificial Sequence: Synthetic polypeptide
  XENP018117 1G6_H1.20_L1_IgG1_PVA_/S267K Light Chain

SEQ ID NO: 16597 - protein, 107 aa, Artificial Sequence; identical to SEQ ID NO: 10923
  Description of Artificial Sequence: Synthetic polypeptide
  VL of XENP018117

SEQ ID NO: 16598 - protein, 11 aa, Artificial Sequence
  Description of Artificial Sequence: Synthetic peptide
  XENP018117 vlCDR1
RASQSVSNDVA

SEQ ID NO: 16599 - protein, 7 aa, Artificial Sequence
  Description of Artificial Sequence: Synthetic peptide
  XENP018117 vlCDR2
YASHRYT

SEQ ID NO: 16600 - protein, 9 aa, Artificial Sequence
  Description of Artificial Sequence: Synthetic peptide
  XENP018117 vlCDR3
QQDYSSPRT

SEQ ID NO: 16601 - protein, 451 aa, Artificial Sequence
  Description of Artificial Sequence: Synthetic polypeptide
  XENP018118 1G6_H1.21_L1_IgG1_PVA_/S267K Heavy Chain
EVQLVESGGGLVKPGGSLRLSCAASGFTFSEYWMNWVRQAPGKGLEWVGEIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 16602 - protein, 122 aa, Artificial Sequence; identical to SEQ ID NO: 11219
  Description of Artificial Sequence: Synthetic polypeptide
  VH of XENP018118

SEQ ID NO: 16603 - protein, 5 aa, Artificial Sequence
  Description of Artificial Sequence: Synthetic peptide
  XENP018118 vhCDR1
EYWMN

SEQ ID NO: 16604 - protein, 19 aa, Artificial Sequence
  Description of Artificial Sequence: Synthetic peptide
  XENP018118 vhCDR2
EIRLKSNNYATHYAEPVKG

SEQ ID NO: 16605 - protein, 11 aa, Artificial Sequence
  Description of Artificial Sequence: Synthetic peptide
  XENP018118 vhCDR3
YYGNYGGYFDV

SEQ ID NO: 16606 - protein, 214 aa, Artificial Sequence; identical to SEQ ID NO: 16226
  Description of Artificial Sequence: Synthetic polypeptide
  XENP018118 1G6_H1.21_L1_IgG1_PVA_/S267K Light Chain

SEQ ID NO: 16607 - protein, 107 aa, Artificial Sequence; identical to SEQ ID NO: 10923
  Description of Artificial Sequence: Synthetic polypeptide
  VL of XENP018118

SEQ ID NO: 16608 - protein, 11 aa, Artificial Sequence
  Description of Artificial Sequence: Synthetic peptide
  XENP018118 vlCDR1
RASQSVSNDVA

SEQ ID NO: 16609 - protein, 7 aa, Artificial Sequence
  Description of Artificial Sequence: Synthetic peptide
  XENP018118 vlCDR2
YASHRYT

SEQ ID NO: 16610 - protein, 9 aa, Artificial Sequence
  Description of Artificial Sequence: Synthetic peptide
  XENP018118 vlCDR3
QQDYSSPRT

SEQ ID NO: 16611 - protein, 451 aa, Artificial Sequence
  Description of Artificial Sequence: Synthetic polypeptide
  XENP018119 1G6_H1.22_L1_IgG1_PVA_/S267K Heavy Chain
EVQLVESGGGLVKPGGSLRLSCAASGFTFSSYWMNWVRQAPGKGLEWVGEIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 16612 - protein, 122 aa, Artificial Sequence; identical to SEQ ID NO: 11228
  Description of Artificial Sequence: Synthetic polypeptide
  VH of XENP018119

SEQ ID NO: 16613 - protein, 5 aa, Artificial Sequence
  Description of Artificial Sequence: Synthetic peptide
  XENP018119 vhCDR1
SYWMN

SEQ ID NO: 16614 - protein, 19 aa, Artificial Sequence
  Description of Artificial Sequence: Synthetic peptide
  XENP018119 vhCDR2
EIRLKSNNYATHYAEPVKG

SEQ ID NO: 16615 - protein, 11 aa, Artificial Sequence
  Description of Artificial Sequence: Synthetic peptide
  XENP018119 vhCDR3
YYGNYGGYFDV

SEQ ID NO: 16616 - protein, 214 aa, Artificial Sequence; identical to SEQ ID NO: 16226
  Description of Artificial Sequence: Synthetic polypeptide
  XENP018119 1G6_H1.22_L1_IgG1_PVA_/S267K Light Chain

SEQ ID NO: 16617 - protein, 107 aa, Artificial Sequence; identical to SEQ ID NO: 10923
  Description of Artificial Sequence: Synthetic polypeptide
  VL of XENP018119

SEQ ID NO: 16618 - protein, 11 aa, Artificial Sequence
  Description of Artificial Sequence: Synthetic peptide
  XENP018119 vlCDR1
RASQSVSNDVA

SEQ ID NO: 16619 - protein, 7 aa, Artificial Sequence
  Description of Artificial Sequence: Synthetic peptide
  XENP018119 vlCDR2
YASHRYT

SEQ ID NO: 16620 - protein, 9 aa, Artificial Sequence
  Description of Artificial Sequence: Synthetic peptide
  XENP018119 vlCDR3
QQDYSSPRT

SEQ ID NO: 16621 - protein, 451 aa, Artificial Sequence
  Description of Artificial Sequence: Synthetic polypeptide
  XENP018120 1G6_H1.23_L1_IgG1_PVA_/S267K Heavy Chain
EVQLVESGGGLVKPGGSLRLSCAASGFTFSRYWMNWVRQAPGKGLEWVGEIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 16622 - protein, 122 aa, Artificial Sequence; identical to SEQ ID NO: 11237
  Description of Artificial Sequence: Synthetic polypeptide
  VH of XENP018120

SEQ ID NO: 16623 - protein, 5 aa, Artificial Sequence
  Description of Artificial Sequence: Synthetic peptide
  XENP018120 vhCDR1
RYWMN

SEQ ID NO: 16624 - protein, 19 aa, Artificial Sequence
  Description of Artificial Sequence: Synthetic peptide
  XENP018120 vhCDR2
EIRLKSNNYATHYAEPVKG

SEQ ID NO: 16625 - protein, 11 aa, Artificial Sequence
  Description of Artificial Sequence: Synthetic peptide
  XENP018120 vhCDR3
YYGNYGGYFDV

SEQ ID NO: 16626 - protein, 214 aa, Artificial Sequence; identical to SEQ ID NO: 16226
  Description of Artificial Sequence: Synthetic polypeptide
  XENP018120 1G6_H1.23_L1_IgG1_PVA_/S267K Light Chain

SEQ ID NO: 16627 - protein, 107 aa, Artificial Sequence; identical to SEQ ID NO: 10923
  Description of Artificial Sequence: Synthetic polypeptide
  VL of XENP018120

SEQ ID NO: 16628 - protein, 11 aa, Artificial Sequence
  Description of Artificial Sequence: Synthetic peptide
  XENP018120 vlCDR1
RASQSVSNDVA

SEQ ID NO: 16629 - protein, 7 aa, Artificial Sequence
  Description of Artificial Sequence: Synthetic peptide
  XENP018120 vlCDR2
YASHRYT

SEQ ID NO: 16630 - protein, 9 aa, Artificial Sequence
  Description of Artificial Sequence: Synthetic peptide
  XENP018120 vlCDR3
QQDYSSPRT

SEQ ID NO: 16631 - protein, 451 aa, Artificial Sequence
  Description of Artificial Sequence: Synthetic polypeptide
  XENP018121 1G6_H1.24_L1_IgG1_PVA_/S267K Heavy Chain
EVQLVESGGGLVKPGGSLRLSCAASGFTFSLYWMNWVRQAPGKGLEWVGEIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 16632 - protein, 122 aa, Artificial Sequence; identical to SEQ ID NO: 11246
  Description of Artificial Sequence: Synthetic polypeptide
  VH of XENP018121

SEQ ID NO: 16633 - protein, 5 aa, Artificial Sequence
  Description of Artificial Sequence: Synthetic peptide
  XENP018121 vhCDR1
LYWMN

SEQ ID NO: 16634 - protein, 19 aa, Artificial Sequence
  Description of Artificial Sequence: Synthetic peptide
  XENP018121 vhCDR2
EIRLKSNNYATHYAEPVKG

SEQ ID NO: 16635 - protein, 11 aa, Artificial Sequence
  Description of Artificial Sequence: Synthetic peptide
  XENP018121 vhCDR3
YYGNYGGYFDV

SEQ ID NO: 16636 - protein, 214 aa, Artificial Sequence; identical to SEQ ID NO: 16226
  Description of Artificial Sequence: Synthetic polypeptide
  XENP018121 1G6_H1.24_L1_IgG1_PVA_/S267K Light Chain

SEQ ID NO: 16637 - protein, 107 aa, Artificial Sequence; identical to SEQ ID NO: 10923
  Description of Artificial Sequence: Synthetic polypeptide
  VL of XENP018121

SEQ ID NO: 16638 - protein, 11 aa, Artificial Sequence
  Description of Artificial Sequence: Synthetic peptide
  XENP018121 vlCDR1
RASQSVSNDVA

SEQ ID NO: 16639 - protein, 7 aa, Artificial Sequence
  Description of Artificial Sequence: Synthetic peptide
  XENP018121 vlCDR2
YASHRYT

SEQ ID NO: 16640 - protein, 9 aa, Artificial Sequence
  Description of Artificial Sequence: Synthetic peptide
  XENP018121 vlCDR3
QQDYSSPRT

SEQ ID NO: 16641 - protein, 451 aa, Artificial Sequence
  Description of Artificial Sequence: Synthetic polypeptide
  XENP018122 1G6_H1.25_L1_IgG1_PVA_/S267K Heavy Chain
EVQLVESGGGLVKPGGSLRLSCAASGFTFSTYWMNWVRQAPGKGLEWVGEIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 16642 - protein, 122 aa, Artificial Sequence; identical to SEQ ID NO: 11255
  Description of Artificial Sequence: Synthetic polypeptide
  VH of XENP018122

SEQ ID NO: 16643 - protein, 5 aa, Artificial Sequence
  Description of Artificial Sequence: Synthetic peptide
  XENP018122 vhCDR1
TYWMN

SEQ ID NO: 16644 - protein, 19 aa, Artificial Sequence
  Description of Artificial Sequence: Synthetic peptide
  XENP018122 vhCDR2
EIRLKSNNYATHYAEPVKG

SEQ ID NO: 16645 - protein, 11 aa, Artificial Sequence
  Description of Artificial Sequence: Synthetic peptide
  XENP018122 vhCDR3
YYGNYGGYFDV

SEQ ID NO: 16646 - protein, 214 aa, Artificial Sequence; identical to SEQ ID NO: 16226
  Description of Artificial Sequence: Synthetic polypeptide
  XENP018122 1G6_H1.25_L1_IgG1_PVA_/S267K Light Chain

SEQ ID NO: 16647 - protein, 107 aa, Artificial Sequence; identical to SEQ ID NO: 10923
  Description of Artificial Sequence: Synthetic polypeptide
  VL of XENP018122

SEQ ID NO: 16648 - protein, 11 aa, Artificial Sequence
  Description of Artificial Sequence: Synthetic peptide
  XENP018122 vlCDR1
RASQSVSNDVA

SEQ ID NO: 16649 - protein, 7 aa, Artificial Sequence
  Description of Artificial Sequence: Synthetic peptide
  XENP018122 vlCDR2
YASHRYT

SEQ ID NO: 16650 - protein, 9 aa, Artificial Sequence
  Description of Artificial Sequence: Synthetic peptide
  XENP018122 vlCDR3
QQDYSSPRT

SEQ ID NO: 16651 - protein, 451 aa, Artificial Sequence
  Description of Artificial Sequence: Synthetic polypeptide
  XENP018123 1G6_H1.26_L1_IgG1_PVA_/S267K Heavy Chain
EVQLVESGGGLVKPGGSLRLSCAASGFTFSGYWMNWVRQAPGKGLEWVGEIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 16652 - protein, 122 aa, Artificial Sequence; identical to SEQ ID NO: 11264
  Description of Artificial Sequence: Synthetic polypeptide
  VH of XENP018123

SEQ ID NO: 16653 - protein, 5 aa, Artificial Sequence
  Description of Artificial Sequence: Synthetic peptide
  XENP018123 vhCDR1
GYWMN

SEQ ID NO: 16654 - protein, 19 aa, Artificial Sequence
  Description of Artificial Sequence: Synthetic peptide
  XENP018123 vhCDR2
EIRLKSNNYATHYAEPVKG

SEQ ID NO: 16655 - protein, 11 aa, Artificial Sequence
  Description of Artificial Sequence: Synthetic peptide
  XENP018123 vhCDR3
YYGNYGGYFDV

SEQ ID NO: 16656 - protein, 214 aa, Artificial Sequence; identical to SEQ ID NO: 16226
  Description of Artificial Sequence: Synthetic polypeptide
  XENP018123 1G6_H1.26_L1_IgG1_PVA_/S267K Light Chain

SEQ ID NO: 16657 - protein, 107 aa, Artificial Sequence; identical to SEQ ID NO: 10923
  Description of Artificial Sequence: Synthetic polypeptide
  VL of XENP018123

SEQ ID NO: 16658 - protein, 11 aa, Artificial Sequence
  Description of Artificial Sequence: Synthetic peptide
  XENP018123 vlCDR1
RASQSVSNDVA

SEQ ID NO: 16659 - protein, 7 aa, Artificial Sequence
  Description of Artificial Sequence: Synthetic peptide
  XENP018123 vlCDR2
YASHRYT

SEQ ID NO: 16660 - protein, 9 aa, Artificial Sequence
  Description of Artificial Sequence: Synthetic peptide
  XENP018123 vlCDR3
QQDYSSPRT

SEQ ID NO: 16661 - protein, 451 aa, Artificial Sequence
  Description of Artificial Sequence: Synthetic polypeptide
  XENP018124 1G6_H1.27_L1_IgG1_PVA_/S267K Heavy Chain
EVQLVESGGGLVKPGGSLRLSCAASGFTFSYYWMNWVRQAPGKGLEWVGEIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 16662 - protein, 122 aa, Artificial Sequence; identical to SEQ ID NO: 11273
  Description of Artificial Sequence: Synthetic polypeptide
  VH of XENP018124

SEQ ID NO: 16663 - protein, 5 aa, Artificial Sequence
  Description of Artificial Sequence: Synthetic peptide
  XENP018124 vhCDR1
YYWMN

SEQ ID NO: 16664 - protein, 19 aa, Artificial Sequence
  Description of Artificial Sequence: Synthetic peptide
  XENP018124 vhCDR2
EIRLKSNNYATHYAEPVKG

SEQ ID NO: 16665 - protein, 11 aa, Artificial Sequence
  Description of Artificial Sequence: Synthetic peptide
  XENP018124 vhCDR3
YYGNYGGYFDV

SEQ ID NO: 16666 - protein, 214 aa, Artificial Sequence; identical to SEQ ID NO: 16226
  Description of Artificial Sequence: Synthetic polypeptide
  XENP018124 1G6_H1.27_L1_IgG1_PVA_/S267K Light Chain

SEQ ID NO: 16667 - protein, 107 aa, Artificial Sequence; identical to SEQ ID NO: 10923
  Description of Artificial Sequence: Synthetic polypeptide
  VL of XENP018124

SEQ ID NO: 16668 - protein, 11 aa, Artificial Sequence
  Description of Artificial Sequence: Synthetic peptide
  XENP018124 vlCDR1
RASQSVSNDVA

SEQ ID NO: 16669 - protein, 7 aa, Artificial Sequence
  Description of Artificial Sequence: Synthetic peptide
  XENP018124 vlCDR2
YASHRYT

SEQ ID NO: 16670 - protein, 9 aa, Artificial Sequence
  Description of Artificial Sequence: Synthetic peptide
  XENP018124 vlCDR3
QQDYSSPRT

SEQ ID NO: 16671 - protein, 451 aa, Artificial Sequence
  Description of Artificial Sequence: Synthetic polypeptide
  XENP018125 1G6_H1.28_L1_IgG1_PVA_/S267K Heavy Chain
EVQLVESGGGLVKPGGSLRLSCAASGFTFSNFWMNWVRQAPGKGLEWVGEIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 16672 - protein, 122 aa, Artificial Sequence; identical to SEQ ID NO: 11282
  Description of Artificial Sequence: Synthetic polypeptide
  VH of XENP018125

SEQ ID NO: 16673 - protein, 5 aa, Artificial Sequence
  Description of Artificial Sequence: Synthetic peptide
  XENP018125 vhCDR1
NFWMN

SEQ ID NO: 16674 - protein, 19 aa, Artificial Sequence
  Description of Artificial Sequence: Synthetic peptide
  XENP018125 vhCDR2
EIRLKSNNYATHYAEPVKG

SEQ ID NO: 16675 - protein, 11 aa, Artificial Sequence
  Description of Artificial Sequence: Synthetic peptide
  XENP018125 vhCDR3
YYGNYGGYFDV

SEQ ID NO: 16676 - protein, 214 aa, Artificial Sequence; identical to SEQ ID NO: 16226
  Description of Artificial Sequence: Synthetic polypeptide
  XENP018125 1G6_H1.28_L1_IgG1_PVA_/S267K Light Chain

SEQ ID NO: 16677 - protein, 107 aa, Artificial Sequence; identical to SEQ ID NO: 10923
  Description of Artificial Sequence: Synthetic polypeptide
  VL of XENP018125

SEQ ID NO: 16678 - protein, 11 aa, Artificial Sequence
  Description of Artificial Sequence: Synthetic peptide
  XENP018125 vlCDR1
RASQSVSNDVA

SEQ ID NO: 16679 - protein, 7 aa, Artificial Sequence
  Description of Artificial Sequence: Synthetic peptide
  XENP018125 vlCDR2
YASHRYT

SEQ ID NO: 16680 - protein, 9 aa, Artificial Sequence
  Description of Artificial Sequence: Synthetic peptide
  XENP018125 vlCDR3
QQDYSSPRT

SEQ ID NO: 16681 - protein, 451 aa, Artificial Sequence
  Description of Artificial Sequence: Synthetic polypeptide
  XENP018126 1G6_H1.29_L1_IgG1_PVA_/S267K Heavy Chain
EVQLVESGGGLVKPGGSLRLSCAASGFTFSNHWMNWVRQAPGKGLEWVGEIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 16682 - protein, 122 aa, Artificial Sequence; identical to SEQ ID NO: 11291
  Description of Artificial Sequence: Synthetic polypeptide
  VH of XENP018126

SEQ ID NO: 16683 - protein, 5 aa, Artificial Sequence
  Description of Artificial Sequence: Synthetic peptide
  XENP018126 vhCDR1
NHWMN

SEQ ID NO: 16684 - protein, 19 aa, Artificial Sequence
  Description of Artificial Sequence: Synthetic peptide
  XENP018126 vhCDR2
EIRLKSNNYATHYAEPVKG

SEQ ID NO: 16685 - protein, 11 aa, Artificial Sequence
  Description of Artificial Sequence: Synthetic peptide
  XENP018126 vhCDR3
YYGNYGGYFDV

SEQ ID NO: 16686 - protein, 214 aa, Artificial Sequence; identical to SEQ ID NO: 16226
  Description of Artificial Sequence: Synthetic polypeptide
  XENP018126 1G6_H1.29_L1_IgG1_PVA_/S267K Light Chain

SEQ ID NO: 16687 - protein, 107 aa, Artificial Sequence; identical to SEQ ID NO: 10923
  Description of Artificial Sequence: Synthetic polypeptide
  VL of XENP018126

SEQ ID NO: 16688 - protein, 11 aa, Artificial Sequence
  Description of Artificial Sequence: Synthetic peptide
  XENP018126 vlCDR1
RASQSVSNDVA

SEQ ID NO: 16689 - protein, 7 aa, Artificial Sequence
  Description of Artificial Sequence: Synthetic peptide
  XENP018126 vlCDR2
YASHRYT

SEQ ID NO: 16690 - protein, 9 aa, Artificial Sequence
  Description of Artificial Sequence: Synthetic peptide
  XENP018126 vlCDR3
QQDYSSPRT

SEQ ID NO: 16691 - protein, 451 aa, Artificial Sequence
  Description of Artificial Sequence: Synthetic polypeptide
  XENP018127 1G6_H1.30_L1_IgG1_PVA_/S267K Heavy Chain
EVQLVESGGGLVKPGGSLRLSCAASGFTFSNLWMNWVRQAPGKGLEWVGEIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 16692 - protein, 122 aa, Artificial Sequence; identical to SEQ ID NO: 11300
  Description of Artificial Sequence: Synthetic polypeptide
  VH of XENP018127

SEQ ID NO: 16693 - protein, 5 aa, Artificial Sequence
  Description of Artificial Sequence: Synthetic peptide
  XENP018127 vhCDR1
NLWMN

SEQ ID NO: 16694 - protein, 19 aa, Artificial Sequence
  Description of Artificial Sequence: Synthetic peptide
  XENP018127 vhCDR2
EIRLKSNNYATHYAEPVKG

SEQ ID NO: 16695 - protein, 11 aa, Artificial Sequence
  Description of Artificial Sequence: Synthetic peptide
  XENP018127 vhCDR3
YYGNYGGYFDV

SEQ ID NO: 16696 - protein, 214 aa, Artificial Sequence; identical to SEQ ID NO: 16226
  Description of Artificial Sequence: Synthetic polypeptide
  XENP018127 1G6_H1.30_L1_IgG1_PVA_/S267K Light Chain

SEQ ID NO: 16697 - protein, 107 aa, Artificial Sequence; identical to SEQ ID NO: 10923
  Description of Artificial Sequence: Synthetic polypeptide
  VL of XENP018127

SEQ ID NO: 16698 - protein, 11 aa, Artificial Sequence
  Description of Artificial Sequence: Synthetic peptide
  XENP018127 vlCDR1
RASQSVSNDVA

SEQ ID NO: 16699 - protein, 7 aa, Artificial Sequence
  Description of Artificial Sequence: Synthetic peptide
  XENP018127 vlCDR2
YASHRYT

SEQ ID NO: 16700 - protein, 9 aa, Artificial Sequence
  Description of Artificial Sequence: Synthetic peptide
  XENP018127 vlCDR3
QQDYSSPRT

SEQ ID NO: 16701 - protein, 451 aa, Artificial Sequence
  Description of Artificial Sequence: Synthetic polypeptide
  XENP018128 1G6_H1.31_L1_IgG1_PVA_/S267K Heavy Chain
EVQLVESGGGLVKPGGSLRLSCAASGFTFSNWWMNWVRQAPGKGLEWVGEIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 16702 - protein, 122 aa, Artificial Sequence; identical to SEQ ID NO: 11309
  Description of Artificial Sequence: Synthetic polypeptide
  VH of XENP018128

SEQ ID NO: 16703 - protein, 5 aa, Artificial Sequence
  Description of Artificial Sequence: Synthetic peptide
  XENP018128 vhCDR1
NWWMN

SEQ ID NO: 16704 - protein, 19 aa, Artificial Sequence
  Description of Artificial Sequence: Synthetic peptide
  XENP018128 vhCDR2
EIRLKSNNYATHYAEPVKG

SEQ ID NO: 16705 - protein, 11 aa, Artificial Sequence
  Description of Artificial Sequence: Synthetic peptide
  XENP018128 vhCDR3
YYGNYGGYFDV

SEQ ID NO: 16706 - protein, 214 aa, Artificial Sequence; identical to SEQ ID NO: 16226
  Description of Artificial Sequence: Synthetic polypeptide
  XENP018128 1G6_H1.31_L1_IgG1_PVA_/S267K Light Chain

SEQ ID NO: 16707 - protein, 107 aa, Artificial Sequence; identical to SEQ ID NO: 10923
  Description of Artificial Sequence: Synthetic polypeptide
  VL of XENP018128

SEQ ID NO: 16708 - protein, 11 aa, Artificial Sequence
  Description of Artificial Sequence: Synthetic peptide
  XENP018128 vlCDR1
RASQSVSNDVA

SEQ ID NO: 16709 - protein, 7 aa, Artificial Sequence
  Description of Artificial Sequence: Synthetic peptide
  XENP018128 vlCDR2
YASHRYT

SEQ ID NO: 16710 - protein, 9 aa, Artificial Sequence
  Description of Artificial Sequence: Synthetic peptide
  XENP018128 vlCDR3
QQDYSSPRT

SEQ ID NO: 16711 - protein, 451 aa, Artificial Sequence
  Description of Artificial Sequence: Synthetic polypeptide
  XENP018129 1G6_H1.32_L1_IgG1_PVA_/S267K Heavy Chain
EVQLVESGGGLVKPGGSLRLSCAASGFTFSNVWMNWVRQAPGKGLEWVGEIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 16712 - protein, 122 aa, Artificial Sequence; identical to SEQ ID NO: 11318
  Description of Artificial Sequence: Synthetic polypeptide
  VH of XENP018129

SEQ ID NO: 16713 - protein, 5 aa, Artificial Sequence
  Description of Artificial Sequence: Synthetic peptide
  XENP018129 vhCDR1
NVWMN

SEQ ID NO: 16714 - protein, 19 aa, Artificial Sequence
  Description of Artificial Sequence: Synthetic peptide
  XENP018129 vhCDR2
EIRLKSNNYATHYAEPVKG

SEQ ID NO: 16715 - protein, 11 aa, Artificial Sequence
  Description of Artificial Sequence: Synthetic peptide
  XENP018129 vhCDR3
YYGNYGGYFDV

SEQ ID NO: 16716 - protein, 214 aa, Artificial Sequence; identical to SEQ ID NO: 16226
  Description of Artificial Sequence: Synthetic polypeptide
  XENP018129 1G6_H1.32_L1_IgG1_PVA_/S267K Light Chain

SEQ ID NO: 16717 - protein, 107 aa, Artificial Sequence; identical to SEQ ID NO: 10923
  Description of Artificial Sequence: Synthetic polypeptide
  VL of XENP018129

SEQ ID NO: 16718 - protein, 11 aa, Artificial Sequence
  Description of Artificial Sequence: Synthetic peptide
  XENP018129 vlCDR1
RASQSVSNDVA

SEQ ID NO: 16719 - protein, 7 aa, Artificial Sequence
  Description of Artificial Sequence: Synthetic peptide
  XENP018129 vlCDR2
YASHRYT

SEQ ID NO: 16720 - protein, 9 aa, Artificial Sequence
  Description of Artificial Sequence: Synthetic peptide
  XENP018129 vlCDR3
QQDYSSPRT

SEQ ID NO: 16721 - protein, 451 aa, Artificial Sequence
  Description of Artificial Sequence: Synthetic polypeptide
  XENP018130 1G6_H1.33_L1_IgG1_PVA_/S267K Heavy Chain
EVQLVESGGGLVKPGGSLRLSCAASGFTFSNAWMNWVRQAPGKGLEWVGEIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 16722 - protein, 122 aa, Artificial Sequence; identical to SEQ ID NO: 11327
  Description of Artificial Sequence: Synthetic polypeptide
  VH of XENP018130

SEQ ID NO: 16723 - protein, 5 aa, Artificial Sequence
  Description of Artificial Sequence: Synthetic peptide
  XENP018130 vhCDR1
NAWMN

SEQ ID NO: 16724 - protein, 19 aa, Artificial Sequence
  Description of Artificial Sequence: Synthetic peptide
  XENP018130 vhCDR2
EIRLKSNNYATHYAEPVKG

SEQ ID NO: 16725 - protein, 11 aa, Artificial Sequence
  Description of Artificial Sequence: Synthetic peptide
  XENP018130 vhCDR3
YYGNYGGYFDV

SEQ ID NO: 16726 - protein, 214 aa, Artificial Sequence; identical to SEQ ID NO: 16226
  Description of Artificial Sequence: Synthetic polypeptide
  XENP018130 1G6_H1.33_L1_IgG1_PVA_/S267K Light Chain

SEQ ID NO: 16727 - protein, 107 aa, Artificial Sequence; identical to SEQ ID NO: 10923
  Description of Artificial Sequence: Synthetic polypeptide
  VL of XENP018130

SEQ ID NO: 16728 - protein, 11 aa, Artificial Sequence
  Description of Artificial Sequence: Synthetic peptide
  XENP018130 vlCDR1
RASQSVSNDVA

SEQ ID NO: 16729 - protein, 7 aa, Artificial Sequence
  Description of Artificial Sequence: Synthetic peptide
  XENP018130 vlCDR2
YASHRYT

SEQ ID NO: 16730 - protein, 9 aa, Artificial Sequence
  Description of Artificial Sequence: Synthetic peptide
  XENP018130 vlCDR3
QQDYSSPRT

SEQ ID NO: 16731 - protein, 451 aa, Artificial Sequence
  Description of Artificial Sequence: Synthetic polypeptide
  XENP018131 1G6_H1.34_L1_IgG1_PVA_/S267K Heavy Chain
EVQLVESGGGLVKPGGSLRLSCAASGFTFSNQWMNWVRQAPGKGLEWVGEIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 16732 - protein, 122 aa, Artificial Sequence; identical to SEQ ID NO: 11336
  Description of Artificial Sequence: Synthetic polypeptide
  VH of XENP018131

SEQ ID NO: 16733 - protein, 5 aa, Artificial Sequence
  Description of Artificial Sequence: Synthetic peptide
  XENP018131 vhCDR1
NQWMN

SEQ ID NO: 16734 - protein, 19 aa, Artificial Sequence
  Description of Artificial Sequence: Synthetic peptide
  XENP018131 vhCDR2
EIRLKSNNYATHYAEPVKG

SEQ ID NO: 16735 - protein, 11 aa, Artificial Sequence
  Description of Artificial Sequence: Synthetic peptide
  XENP018131 vhCDR3
YYGNYGGYFDV

SEQ ID NO: 16736 - protein, 214 aa, Artificial Sequence; identical to SEQ ID NO: 16226
  Description of Artificial Sequence: Synthetic polypeptide
  XENP018131 1G6_H1.34_L1_IgG1_PVA_/S267K Light Chain

SEQ ID NO: 16737 - protein, 107 aa, Artificial Sequence; identical to SEQ ID NO: 10923
  Description of Artificial Sequence: Synthetic polypeptide
  VL of XENP018131

SEQ ID NO: 16738 - protein, 11 aa, Artificial Sequence
  Description of Artificial Sequence: Synthetic peptide
  XENP018131 vlCDR1
RASQSVSNDVA

SEQ ID NO: 16739 - protein, 7 aa, Artificial Sequence
  Description of Artificial Sequence: Synthetic peptide
  XENP018131 vlCDR2
YASHRYT

SEQ ID NO: 16740 - protein, 9 aa, Artificial Sequence
  Description of Artificial Sequence: Synthetic peptide
  XENP018131 vlCDR3
QQDYSSPRT

SEQ ID NO: 16741 - protein, 451 aa, Artificial Sequence
  Description of Artificial Sequence: Synthetic polypeptide
  XENP018132 1G6_H1.35_L1_IgG1_PVA_/S267K Heavy Chain
EVQLVESGGGLVKPGGSLRLSCAASGFTFSNDWMNWVRQAPGKGLEWVGEIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 16742 - protein, 122 aa, Artificial Sequence; identical to SEQ ID NO: 11345
  Description of Artificial Sequence: Synthetic polypeptide
  VH of XENP018132

SEQ ID NO: 16743 - protein, 5 aa, Artificial Sequence
  Description of Artificial Sequence: Synthetic peptide
  XENP018132 vhCDR1
NDWMN

SEQ ID NO: 16744 - protein, 19 aa, Artificial Sequence
  Description of Artificial Sequence: Synthetic peptide
  XENP018132 vhCDR2
EIRLKSNNYATHYAEPVKG

SEQ ID NO: 16745 - protein, 11 aa, Artificial Sequence
  Description of Artificial Sequence: Synthetic peptide
  XENP018132 vhCDR3
YYGNYGGYFDV

SEQ ID NO: 16746 - protein, 214 aa, Artificial Sequence; identical to SEQ ID NO: 16226
  Description of Artificial Sequence: Synthetic polypeptide
  XENP018132 1G6_H1.35_L1_IgG1_PVA_/S267K Light Chain

SEQ ID NO: 16747 - protein, 107 aa, Artificial Sequence; identical to SEQ ID NO: 10923
  Description of Artificial Sequence: Synthetic polypeptide
  VL of XENP018132

SEQ ID NO: 16748 - protein, 11 aa, Artificial Sequence
  Description of Artificial Sequence: Synthetic peptide
  XENP018132 vlCDR1
RASQSVSNDVA

SEQ ID NO: 16749 - protein, 7 aa, Artificial Sequence
  Description of Artificial Sequence: Synthetic peptide
  XENP018132 vlCDR2
YASHRYT

SEQ ID NO: 16750 - protein, 9 aa, Artificial Sequence
  Description of Artificial Sequence: Synthetic peptide
  XENP018132 vlCDR3
QQDYSSPRT

SEQ ID NO: 16751 - protein, 451 aa, Artificial Sequence
  Description of Artificial Sequence: Synthetic polypeptide
  XENP018133 1G6_H1.36_L1_IgG1_PVA_/S267K Heavy Chain
EVQLVESGGGLVKPGGSLRLSCAASGFTFSNKWMNWVRQAPGKGLEWVGEIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 16752 - protein, 122 aa, Artificial Sequence; identical to SEQ ID NO: 11354
  Description of Artificial Sequence: Synthetic polypeptide
  VH of XENP018133

SEQ ID NO: 16753 - protein, 5 aa, Artificial Sequence
  Description of Artificial Sequence: Synthetic peptide
  XENP018133 vhCDR1
NKWMN

SEQ ID NO: 16754 - protein, 19 aa, Artificial Sequence
  Description of Artificial Sequence: Synthetic peptide
  XENP018133 vhCDR2
EIRLKSNNYATHYAEPVKG

SEQ ID NO: 16755 - protein, 11 aa, Artificial Sequence
  Description of Artificial Sequence: Synthetic peptide
  XENP018133 vhCDR3
YYGNYGGYFDV

SEQ ID NO: 16756 - protein, 214 aa, Artificial Sequence; identical to SEQ ID NO: 16226
  Description of Artificial Sequence: Synthetic polypeptide
  XENP018133 1G6_H1.36_L1_IgG1_PVA_/S267K Light Chain

SEQ ID NO: 16757 - protein, 107 aa, Artificial Sequence; identical to SEQ ID NO: 10923
  Description of Artificial Sequence: Synthetic polypeptide
  VL of XENP018133

SEQ ID NO: 16758 - protein, 11 aa, Artificial Sequence
  Description of Artificial Sequence: Synthetic peptide
  XENP018133 vlCDR1
RASQSVSNDVA

SEQ ID NO: 16759 - protein, 7 aa, Artificial Sequence
  Description of Artificial Sequence: Synthetic peptide
  XENP018133 vlCDR2
YASHRYT

SEQ ID NO: 16760 - protein, 9 aa, Artificial Sequence
  Description of Artificial Sequence: Synthetic peptide
  XENP018133 vlCDR3
QQDYSSPRT

SEQ ID NO: 16761 - protein, 451 aa, Artificial Sequence
  Description of Artificial Sequence: Synthetic polypeptide
  XENP018134 1G6_H1.37_L1_IgG1_PVA_/S267K Heavy Chain
EVQLVESGGGLVKPGGSLRLSCAASGFTFSNYGMNWVRQAPGKGLEWVGEIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 16762 - protein, 122 aa, Artificial Sequence; identical to SEQ ID NO: 11363
  Description of Artificial Sequence: Synthetic polypeptide
  VH of XENP018134

SEQ ID NO: 16763 - protein, 5 aa, Artificial Sequence
  Description of Artificial Sequence: Synthetic peptide
  XENP018134 vhCDR1
NYGMN

SEQ ID NO: 16764 - protein, 19 aa, Artificial Sequence
  Description of Artificial Sequence: Synthetic peptide
  XENP018134 vhCDR2
EIRLKSNNYATHYAEPVKG

SEQ ID NO: 16765 - protein, 11 aa, Artificial Sequence
  Description of Artificial Sequence: Synthetic peptide
  XENP018134 vhCDR3
YYGNYGGYFDV

SEQ ID NO: 16766 - protein, 214 aa, Artificial Sequence; identical to SEQ ID NO: 16226
  Description of Artificial Sequence: Synthetic polypeptide
  XENP018134 1G6_H1.37_L1_IgG1_PVA_/S267K Light Chain

SEQ ID NO: 16767 - protein, 107 aa, Artificial Sequence; identical to SEQ ID NO: 10923
  Description of Artificial Sequence: Synthetic polypeptide
  VL of XENP018134

SEQ ID NO: 16768 - protein, 11 aa, Artificial Sequence
  Description of Artificial Sequence: Synthetic peptide
  XENP018134 vlCDR1
RASQSVSNDVA

SEQ ID NO: 16769 - protein, 7 aa, Artificial Sequence
  Description of Artificial Sequence: Synthetic peptide
  XENP018134 vlCDR2
YASHRYT

SEQ ID NO: 16770 - protein, 9 aa, Artificial Sequence
  Description of Artificial Sequence: Synthetic peptide
  XENP018134 vlCDR3
QQDYSSPRT

SEQ ID NO: 16771 - protein, 451 aa, Artificial Sequence
  Description of Artificial Sequence: Synthetic polypeptide
  XENP018135 1G6_H1.38_L1_IgG1_PVA_/S267K Heavy Chain
EVQLVESGGGLVKPGGSLRLSCAASGFTFSNYAMNWVRQAPGKGLEWVGEIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 16772 - protein, 122 aa, Artificial Sequence; identical to SEQ ID NO: 11372
  Description of Artificial Sequence: Synthetic polypeptide
  VH of XENP018135

SEQ ID NO: 16773 - protein, 5 aa, Artificial Sequence
  Description of Artificial Sequence: Synthetic peptide
  XENP018135 vhCDR1
NYAMN

SEQ ID NO: 16774 - protein, 19 aa, Artificial Sequence
  Description of Artificial Sequence: Synthetic peptide
  XENP018135 vhCDR2
EIRLKSNNYATHYAEPVKG

SEQ ID NO: 16775 - protein, 11 aa, Artificial Sequence
  Description of Artificial Sequence: Synthetic peptide
  XENP018135 vhCDR3
YYGNYGGYFDV

SEQ ID NO: 16776 - protein, 214 aa, Artificial Sequence; identical to SEQ ID NO: 16226
  Description of Artificial Sequence: Synthetic polypeptide
  XENP018135 1G6_H1.38_L1_IgG1_PVA_/S267K Light Chain

SEQ ID NO: 16777 - protein, 107 aa, Artificial Sequence; identical to SEQ ID NO: 10923
  Description of Artificial Sequence: Synthetic polypeptide
  VL of XENP018135

SEQ ID NO: 16778 - protein, 11 aa, Artificial Sequence
  Description of Artificial Sequence: Synthetic peptide
  XENP018135 vlCDR1
RASQSVSNDVA

SEQ ID NO: 16779 - protein, 7 aa, Artificial Sequence
  Description of Artificial Sequence: Synthetic peptide
  XENP018135 vlCDR2
YASHRYT

SEQ ID NO: 16780 - protein, 9 aa, Artificial Sequence
  Description of Artificial Sequence: Synthetic peptide
  XENP018135 vlCDR3
QQDYSSPRT

SEQ ID NO: 16781 - protein, 451 aa, Artificial Sequence
  Description of Artificial Sequence: Synthetic polypeptide
  XENP018136 1G6_H1.39_L1_IgG1_PVA_/S267K Heavy Chain
EVQLVESGGGLVKPGGSLRLSCAASGFTFSNYYMNWVRQAPGKGLEWVGEIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 16782 - protein, 122 aa, Artificial Sequence; identical to SEQ ID NO: 11381
  Description of Artificial Sequence: Synthetic polypeptide
  VH of XENP018136

SEQ ID NO: 16783 - protein, 5 aa, Artificial Sequence
  Description of Artificial Sequence: Synthetic peptide
  XENP018136 vhCDR1
NYYMN

SEQ ID NO: 16784 - protein, 19 aa, Artificial Sequence
  Description of Artificial Sequence: Synthetic peptide
  XENP018136 vhCDR2
EIRLKSNNYATHYAEPVKG

SEQ ID NO: 16785 - protein, 11 aa, Artificial Sequence
  Description of Artificial Sequence: Synthetic peptide
  XENP018136 vhCDR3
YYGNYGGYFDV

SEQ ID NO: 16786 - protein, 214 aa, Artificial Sequence; identical to SEQ ID NO: 16226
  Description of Artificial Sequence: Synthetic polypeptide
  XENP018136 1G6_H1.39_L1_IgG1_PVA_/S267K Light Chain

SEQ ID NO: 16787 - protein, 107 aa, Artificial Sequence; identical to SEQ ID NO: 10923
  Description of Artificial Sequence: Synthetic polypeptide
  VL of XENP018136

SEQ ID NO: 16788 - protein, 11 aa, Artificial Sequence
  Description of Artificial Sequence: Synthetic peptide
  XENP018136 vlCDR1
RASQSVSNDVA

SEQ ID NO: 16789 - protein, 7 aa, Artificial Sequence
  Description of Artificial Sequence: Synthetic peptide
  XENP018136 vlCDR2
YASHRYT

SEQ ID NO: 16790 - protein, 9 aa, Artificial Sequence
  Description of Artificial Sequence: Synthetic peptide
  XENP018136 vlCDR3
QQDYSSPRT

SEQ ID NO: 16791 - protein, 451 aa, Artificial Sequence
  Description of Artificial Sequence: Synthetic polypeptide
  XENP018137 1G6_H1.40_L1_IgG1_PVA_/S267K Heavy Chain
EVQLVESGGGLVKPGGSLRLSCAASGFTFSNYDMNWVRQAPGKGLEWVGEIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 16792 - protein, 122 aa, Artificial Sequence; identical to SEQ ID NO: 11390
  Description of Artificial Sequence: Synthetic polypeptide
  VH of XENP018137

SEQ ID NO: 16793 - protein, 5 aa, Artificial Sequence
  Description of Artificial Sequence: Synthetic peptide
  XENP018137 vhCDR1
NYDMN

SEQ ID NO: 16794 - protein, 19 aa, Artificial Sequence
  Description of Artificial Sequence: Synthetic peptide
  XENP018137 vhCDR2
EIRLKSNNYATHYAEPVKG

SEQ ID NO: 16795 - protein, 11 aa, Artificial Sequence
  Description of Artificial Sequence: Synthetic peptide
  XENP018137 vhCDR3
YYGNYGGYFDV

SEQ ID NO: 16796 - protein, 214 aa, Artificial Sequence; identical to SEQ ID NO: 16226
  Description of Artificial Sequence: Synthetic polypeptide
  XENP018137 1G6_H1.40_L1_IgG1_PVA_/S267K Light Chain

SEQ ID NO: 16797 - protein, 107 aa, Artificial Sequence; identical to SEQ ID NO: 10923
  Description of Artificial Sequence: Synthetic polypeptide
  VL of XENP018137

SEQ ID NO: 16798 - protein, 11 aa, Artificial Sequence
  Description of Artificial Sequence: Synthetic peptide
  XENP018137 vlCDR1
RASQSVSNDVA

SEQ ID NO: 16799 - protein, 7 aa, Artificial Sequence
  Description of Artificial Sequence: Synthetic peptide
  XENP018137 vlCDR2
YASHRYT

SEQ ID NO: 16800 - protein, 9 aa, Artificial Sequence
  Description of Artificial Sequence: Synthetic peptide
  XENP018137 vlCDR3
QQDYSSPRT

SEQ ID NO: 16801 - protein, 451 aa, Artificial Sequence
  Description of Artificial Sequence: Synthetic polypeptide
  XENP018138 1G6_H1.41_L1_IgG1_PVA_/S267K Heavy Chain
EVQLVESGGGLVKPGGSLRLSCAASGFTFSNYWMSWVRQAPGKGLEWVGEIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 16802 - protein, 122 aa, Artificial Sequence; identical to SEQ ID NO: 11399
  Description of Artificial Sequence: Synthetic polypeptide
  VH of XENP018138

SEQ ID NO: 16803 - protein, 5 aa, Artificial Sequence
  Description of Artificial Sequence: Synthetic peptide
  XENP018138 vhCDR1
NYWMS

SEQ ID NO: 16804 - protein, 19 aa, Artificial Sequence
  Description of Artificial Sequence: Synthetic peptide
  XENP018138 vhCDR2
EIRLKSNNYATHYAEPVKG

SEQ ID NO: 16805 - protein, 11 aa, Artificial Sequence
  Description of Artificial Sequence: Synthetic peptide
  XENP018138 vhCDR3
YYGNYGGYFDV

SEQ ID NO: 16806 - protein, 214 aa, Artificial Sequence; identical to SEQ ID NO: 16226
  Description of Artificial Sequence: Synthetic polypeptide
  XENP018138 1G6_H1.41_L1_IgG1_PVA_/S267K Light Chain

SEQ ID NO: 16807 - protein, 107 aa, Artificial Sequence; identical to SEQ ID NO: 10923
  Description of Artificial Sequence: Synthetic polypeptide
  VL of XENP018138

SEQ ID NO: 16808 - protein, 11 aa, Artificial Sequence
  Description of Artificial Sequence: Synthetic peptide
  XENP018138 vlCDR1
RASQSVSNDVA

SEQ ID NO: 16809 - protein, 7 aa, Artificial Sequence
  Description of Artificial Sequence: Synthetic peptide
  XENP018138 vlCDR2
YASHRYT

SEQ ID NO: 16810 - protein, 9 aa, Artificial Sequence
  Description of Artificial Sequence: Synthetic peptide
  XENP018138 vlCDR3
QQDYSSPRT

SEQ ID NO: 16811 - protein, 451 aa, Artificial Sequence
  Description of Artificial Sequence: Synthetic polypeptide
  XENP018139 1G6_H1.42_L1_IgG1_PVA_/S267K Heavy Chain
EVQLVESGGGLVKPGGSLRLSCAASGFTFSNYWMHWVRQAPGKGLEWVGEIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 16812 - protein, 122 aa, Artificial Sequence; identical to SEQ ID NO: 11408
  Description of Artificial Sequence: Synthetic polypeptide
  VH of XENP018139

SEQ ID NO: 16813 - protein, 5 aa, Artificial Sequence
  Description of Artificial Sequence: Synthetic peptide
  XENP018139 vhCDR1
NYWMH

SEQ ID NO: 16814 - protein, 19 aa, Artificial Sequence
  Description of Artificial Sequence: Synthetic peptide
  XENP018139 vhCDR2
EIRLKSNNYATHYAEPVKG

SEQ ID NO: 16815 - protein, 11 aa, Artificial Sequence
  Description of Artificial Sequence: Synthetic peptide
  XENP018139 vhCDR3
YYGNYGGYFDV

SEQ ID NO: 16816 - protein, 214 aa, Artificial Sequence; identical to SEQ ID NO: 16226
  Description of Artificial Sequence: Synthetic polypeptide
  XENP018139 1G6_H1.42_L1_IgG1_PVA_/S267K Light Chain

SEQ ID NO: 16817 - protein, 107 aa, Artificial Sequence; identical to SEQ ID NO: 10923
  Description of Artificial Sequence: Synthetic polypeptide
  VL of XENP018139

SEQ ID NO: 16818 - protein, 11 aa, Artificial Sequence
  Description of Artificial Sequence: Synthetic peptide
  XENP018139 vlCDR1
RASQSVSNDVA

SEQ ID NO: 16819 - protein, 7 aa, Artificial Sequence
  Description of Artificial Sequence: Synthetic peptide
  XENP018139 vlCDR2
YASHRYT

SEQ ID NO: 16820 - protein, 9 aa, Artificial Sequence
  Description of Artificial Sequence: Synthetic peptide
  XENP018139 vlCDR3
QQDYSSPRT

SEQ ID NO: 16821 - protein, 451 aa, Artificial Sequence
  Description of Artificial Sequence: Synthetic polypeptide
  XENP018140 1G6_H1.43_L1_IgG1_PVA_/S267K Heavy Chain
EVQLVESGGGLVKPGGSLRLSCAASGFTFSNYWMDWVRQAPGKGLEWVGEIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 16822 - protein, 122 aa, Artificial Sequence; identical to SEQ ID NO: 11417
  Description of Artificial Sequence: Synthetic polypeptide
  VH of XENP018140

SEQ ID NO: 16823 - protein, 5 aa, Artificial Sequence
  Description of Artificial Sequence: Synthetic peptide
  XENP018140 vhCDR1
NYWMD

SEQ ID NO: 16824 - protein, 19 aa, Artificial Sequence
  Description of Artificial Sequence: Synthetic peptide
  XENP018140 vhCDR2
EIRLKSNNYATHYAEPVKG

SEQ ID NO: 16825 - protein, 11 aa, Artificial Sequence
  Description of Artificial Sequence: Synthetic peptide
  XENP018140 vhCDR3
YYGNYGGYFDV

SEQ ID NO: 16826 - protein, 214 aa, Artificial Sequence; identical to SEQ ID NO: 16226
  Description of Artificial Sequence: Synthetic polypeptide
  XENP018140 1G6_H1.43_L1_IgG1_PVA_/S267K Light Chain

SEQ ID NO: 16827 - protein, 107 aa, Artificial Sequence; identical to SEQ ID NO: 10923
  Description of Artificial Sequence: Synthetic polypeptide
  VL of XENP018140

SEQ ID NO: 16828 - protein, 11 aa, Artificial Sequence
  Description of Artificial Sequence: Synthetic peptide
  XENP018140 vlCDR1
RASQSVSNDVA

SEQ ID NO: 16829 - protein, 7 aa, Artificial Sequence
  Description of Artificial Sequence: Synthetic peptide
  XENP018140 vlCDR2
YASHRYT

SEQ ID NO: 16830 - protein, 9 aa, Artificial Sequence
  Description of Artificial Sequence: Synthetic peptide
  XENP018140 vlCDR3
QQDYSSPRT

SEQ ID NO: 16831 - protein, 451 aa, Artificial Sequence
  Description of Artificial Sequence: Synthetic polypeptide
  XENP018141 1G6_H1.44_L1_IgG1_PVA_/S267K Heavy Chain
EVQLVESGGGLVKPGGSLRLSCAASGFTFSNYWMGWVRQAPGKGLEWVGEIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 16832 - protein, 122 aa, Artificial Sequence; identical to SEQ ID NO: 11426
  Description of Artificial Sequence: Synthetic polypeptide
  VH of XENP018141

SEQ ID NO: 16833 - protein, 5 aa, Artificial Sequence
  Description of Artificial Sequence: Synthetic peptide
  XENP018141 vhCDR1
NYWMG

SEQ ID NO: 16834 - protein, 18 aa, Artificial Sequence
  Description of Artificial Sequence: Synthetic peptide
  XENP018141 vhCDR2
EIRLKSNNYATHYAEPVK

SEQ ID NO: 16835 - protein, 11 aa, Artificial Sequence
  Description of Artificial Sequence: Synthetic peptide
  XENP018141 vhCDR3
YYGNYGGYFDV

SEQ ID NO: 16836 - protein, 214 aa, Artificial Sequence; identical to SEQ ID NO: 16226
  Description of Artificial Sequence: Synthetic polypeptide
  XENP018141 1G6_H1.44_L1_IgG1_PVA_/S267K Light Chain

SEQ ID NO: 16837 - protein, 107 aa, Artificial Sequence; identical to SEQ ID NO: 10923
  Description of Artificial Sequence: Synthetic polypeptide
  VL of XENP018141

SEQ ID NO: 16838 - protein, 11 aa, Artificial Sequence
  Description of Artificial Sequence: Synthetic peptide
  XENP018141 vlCDR1
RASQSVSNDVA

SEQ ID NO: 16839 - protein, 7 aa, Artificial Sequence
  Description of Artificial Sequence: Synthetic peptide
  XENP018141 vlCDR2
YASHRYT

SEQ ID NO: 16840 - protein, 9 aa, Artificial Sequence
  Description of Artificial Sequence: Synthetic peptide
  XENP018141 vlCDR3
QQDYSSPRT

SEQ ID NO: 16841 - protein, 451 aa, Artificial Sequence
  Description of Artificial Sequence: Synthetic polypeptide
  XENP018142 1G6_H1.45_L1_IgG1_PVA_/S267K Heavy Chain
EVQLVESGGGLVKPGGSLRLSCAASGFTFSNYWMNWARQAPGKGLEWVGEIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 16842 - protein, 122 aa, Artificial Sequence; identical to SEQ ID NO: 11435
  Description of Artificial Sequence: Synthetic polypeptide
  VH of XENP018142

SEQ ID NO: 16843 - protein, 5 aa, Artificial Sequence
  Description of Artificial Sequence: Synthetic peptide
  XENP018142 vhCDR1
NYWMN

SEQ ID NO: 16844 - protein, 19 aa, Artificial Sequence
  Description of Artificial Sequence: Synthetic peptide
  XENP018142 vhCDR2
EIRLKSNNYATHYAEPVKG

SEQ ID NO: 16845 - protein, 11 aa, Artificial Sequence
  Description of Artificial Sequence: Synthetic peptide
  XENP018142 vhCDR3
YYGNYGGYFDV

SEQ ID NO: 16846 - protein, 214 aa, Artificial Sequence; identical to SEQ ID NO: 16226
  Description of Artificial Sequence: Synthetic polypeptide
  XENP018142 1G6_H1.45_L1_IgG1_PVA_/S267K Light Chain

SEQ ID NO: 16847 - protein, 107 aa, Artificial Sequence; identical to SEQ ID NO: 10923
  Description of Artificial Sequence: Synthetic polypeptide
  VL of XENP018142

SEQ ID NO: 16848 - protein, 11 aa, Artificial Sequence
  Description of Artificial Sequence: Synthetic peptide
  XENP018142 vlCDR1
RASQSVSNDVA

SEQ ID NO: 16849 - protein, 7 aa, Artificial Sequence
  Description of Artificial Sequence: Synthetic peptide
  XENP018142 vlCDR2
YASHRYT

SEQ ID NO: 16850 - protein, 9 aa, Artificial Sequence
  Description of Artificial Sequence: Synthetic peptide
  XENP018142 vlCDR3
QQDYSSPRT

SEQ ID NO: 16851 - protein, 451 aa, Artificial Sequence
  Description of Artificial Sequence: Synthetic polypeptide
  XENP018143 1G6_H1.46_L1_IgG1_PVA_/S267K Heavy Chain
EVQLVESGGGLVKPGGSLRLSCAASGFTFSNYWMNWIRQAPGKGLEWVGEIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 16852 - protein, 122 aa, Artificial Sequence; identical to SEQ ID NO: 11444
  Description of Artificial Sequence: Synthetic polypeptide
  VH of XENP018143

SEQ ID NO: 16853 - protein, 5 aa, Artificial Sequence
  Description of Artificial Sequence: Synthetic peptide
  XENP018143 vhCDR1
NYWMN

SEQ ID NO: 16854 - protein, 19 aa, Artificial Sequence
  Description of Artificial Sequence: Synthetic peptide
  XENP018143 vhCDR2
EIRLKSNNYATHYAEPVKG

SEQ ID NO: 16855 - protein, 11 aa, Artificial Sequence
  Description of Artificial Sequence: Synthetic peptide
  XENP018143 vhCDR3
YYGNYGGYFDV

SEQ ID NO: 16856 - protein, 214 aa, Artificial Sequence; identical to SEQ ID NO: 16226
  Description of Artificial Sequence: Synthetic polypeptide
  XENP018143 1G6_H1.46_L1_IgG1_PVA_/S267K Light Chain

SEQ ID NO: 16857 - protein, 107 aa, Artificial Sequence; identical to SEQ ID NO: 10923
  Description of Artificial Sequence: Synthetic polypeptide
  VL of XENP018143

SEQ ID NO: 16858 - protein, 11 aa, Artificial Sequence
  Description of Artificial Sequence: Synthetic peptide
  XENP018143 vlCDR1
RASQSVSNDVA

SEQ ID NO: 16859 - protein, 7 aa, Artificial Sequence
  Description of Artificial Sequence: Synthetic peptide
  XENP018143 vlCDR2
YASHRYT

SEQ ID NO: 16860 - protein, 9 aa, Artificial Sequence
  Description of Artificial Sequence: Synthetic peptide
  XENP018143 vlCDR3
QQDYSSPRT

SEQ ID NO: 16861 - protein, 451 aa, Artificial Sequence
  Description of Artificial Sequence: Synthetic polypeptide
  XENP018144 1G6_H1.47_L1_IgG1_PVA_/S267K Heavy Chain
EVQLVESGGGLVKPGGSLRLSCAASGFTFSNYWMNWFRQAPGKGLEWVGEIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 16862 - protein, 122 aa, Artificial Sequence; identical to SEQ ID NO: 11453
  Description of Artificial Sequence: Synthetic polypeptide
  VH of XENP018144

SEQ ID NO: 16863 - protein, 5 aa, Artificial Sequence
  Description of Artificial Sequence: Synthetic peptide
  XENP018144 vhCDR1
NYWMN

SEQ ID NO: 16864 - protein, 19 aa, Artificial Sequence
  Description of Artificial Sequence: Synthetic peptide
  XENP018144 vhCDR2
EIRLKSNNYATHYAEPVKG

SEQ ID NO: 16865 - protein, 11 aa, Artificial Sequence
  Description of Artificial Sequence: Synthetic peptide
  XENP018144 vhCDR3
YYGNYGGYFDV

SEQ ID NO: 16866 - protein, 214 aa, Artificial Sequence; identical to SEQ ID NO: 16226
  Description of Artificial Sequence: Synthetic polypeptide
  XENP018144 1G6_H1.47_L1_IgG1_PVA_/S267K Light Chain

SEQ ID NO: 16867 - protein, 107 aa, Artificial Sequence; identical to SEQ ID NO: 10923
  Description of Artificial Sequence: Synthetic polypeptide
  VL of XENP018144

SEQ ID NO: 16868 - protein, 11 aa, Artificial Sequence
  Description of Artificial Sequence: Synthetic peptide
  XENP018144 vlCDR1
RASQSVSNDVA

SEQ ID NO: 16869 - protein, 7 aa, Artificial Sequence
  Description of Artificial Sequence: Synthetic peptide
  XENP018144 vlCDR2
YASHRYT

SEQ ID NO: 16870 - protein, 9 aa, Artificial Sequence
  Description of Artificial Sequence: Synthetic peptide
  XENP018144 vlCDR3
QQDYSSPRT

SEQ ID NO: 16871 - protein, 451 aa, Artificial Sequence
  Description of Artificial Sequence: Synthetic polypeptide
  XENP018145 1G6_H1.48_L1_IgG1_PVA_/S267K Heavy Chain
EVQLVESGGGLVKPGGSLRLSCAASGFTFSNYWMNWVRKAPGKGLEWVGEIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 16872 - protein, 122 aa, Artificial Sequence; identical to SEQ ID NO: 11462
  Description of Artificial Sequence: Synthetic polypeptide
  VH of XENP018145

SEQ ID NO: 16873 - protein, 5 aa, Artificial Sequence
  Description of Artificial Sequence: Synthetic peptide
  XENP018145 vhCDR1
NYWMN

SEQ ID NO: 16874 - protein, 19 aa, Artificial Sequence
  Description of Artificial Sequence: Synthetic peptide
  XENP018145 vhCDR2
EIRLKSNNYATHYAEPVKG

SEQ ID NO: 16875 - protein, 11 aa, Artificial Sequence
  Description of Artificial Sequence: Synthetic peptide
  XENP018145 vhCDR3
YYGNYGGYFDV

SEQ ID NO: 16876 - protein, 214 aa, Artificial Sequence; identical to SEQ ID NO: 16226
  Description of Artificial Sequence: Synthetic polypeptide
  XENP018145 1G6_H1.48_L1_IgG1_PVA_/S267K Light Chain

SEQ ID NO: 16877 - protein, 107 aa, Artificial Sequence; identical to SEQ ID NO: 10923
  Description of Artificial Sequence: Synthetic polypeptide
  VL of XENP018145

SEQ ID NO: 16878 - protein, 11 aa, Artificial Sequence
  Description of Artificial Sequence: Synthetic peptide
  XENP018145 vlCDR1
RASQSVSNDVA

SEQ ID NO: 16879 - protein, 7 aa, Artificial Sequence
  Description of Artificial Sequence: Synthetic peptide
  XENP018145 vlCDR2
YASHRYT

SEQ ID NO: 16880 - protein, 9 aa, Artificial Sequence
  Description of Artificial Sequence: Synthetic peptide
  XENP018145 vlCDR3
QQDYSSPRT

SEQ ID NO: 16881 - protein, 451 aa, Artificial Sequence
  Description of Artificial Sequence: Synthetic polypeptide
  XENP018146 1G6_H1.49_L1_IgG1_PVA_/S267K Heavy Chain
EVQLVESGGGLVKPGGSLRLSCAASGFTFSNYWMNWVRQSPGKGLEWVGEIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 16882 - protein, 122 aa, Artificial Sequence; identical to SEQ ID NO: 11468
  Description of Artificial Sequence: Synthetic polypeptide
  VH of XENP018146

SEQ ID NO: 16883 - protein, 5 aa, Artificial Sequence
  Description of Artificial Sequence: Synthetic peptide
  XENP018146 vhCDR1
NYWMN

SEQ ID NO: 16884 - protein, 19 aa, Artificial Sequence
  Description of Artificial Sequence: Synthetic peptide
  XENP018146 vhCDR2
EIRLKSNNYATHYAEPVKG

SEQ ID NO: 16885 - protein, 11 aa, Artificial Sequence
  Description of Artificial Sequence: Synthetic peptide
  XENP018146 vhCDR3
YYGNYGGYFDV

SEQ ID NO: 16886 - protein, 214 aa, Artificial Sequence; identical to SEQ ID NO: 16226
  Description of Artificial Sequence: Synthetic polypeptide
  XENP018146 1G6_H1.49_L1_IgG1_PVA_/S267K Light Chain

SEQ ID NO: 16887 - protein, 107 aa, Artificial Sequence; identical to SEQ ID NO: 10923
  Description of Artificial Sequence: Synthetic polypeptide
  VL of XENP018146

SEQ ID NO: 16888 - protein, 11 aa, Artificial Sequence
  Description of Artificial Sequence: Synthetic peptide
  XENP018146 vlCDR1
RASQSVSNDVA

SEQ ID NO: 16889 - protein, 7 aa, Artificial Sequence
  Description of Artificial Sequence: Synthetic peptide
  XENP018146 vlCDR2
YASHRYT

SEQ ID NO: 16890 - protein, 9 aa, Artificial Sequence
  Description of Artificial Sequence: Synthetic peptide
  XENP018146 vlCDR3
QQDYSSPRT

SEQ ID NO: 16891 - protein, 451 aa, Artificial Sequence
  Description of Artificial Sequence: Synthetic polypeptide
  XENP018147 1G6_H1.50_L1_IgG1_PVA_/S267K Heavy Chain
EVQLVESGGGLVKPGGSLRLSCAASGFTFSNYWMNWVRQAPEKGLEWVGEIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 16892 - protein, 122 aa, Artificial Sequence; identical to SEQ ID NO: 11477
  Description of Artificial Sequence: Synthetic polypeptide
  VH of XENP018147

SEQ ID NO: 16893 - protein, 5 aa, Artificial Sequence
  Description of Artificial Sequence: Synthetic peptide
  XENP018147 vhCDR1
NYWMN

SEQ ID NO: 16894 - protein, 19 aa, Artificial Sequence
  Description of Artificial Sequence: Synthetic peptide
  XENP018147 vhCDR2
EIRLKSNNYATHYAEPVKG

SEQ ID NO: 16895 - protein, 11 aa, Artificial Sequence
  Description of Artificial Sequence: Synthetic peptide
  XENP018147 vhCDR3
YYGNYGGYFDV

SEQ ID NO: 16896 - protein, 214 aa, Artificial Sequence; identical to SEQ ID NO: 16226
  Description of Artificial Sequence: Synthetic polypeptide
  XENP018147 1G6_H1.50_L1_IgG1_PVA_/S267K Light Chain

SEQ ID NO: 16897 - protein, 107 aa, Artificial Sequence; identical to SEQ ID NO: 10923
  Description of Artificial Sequence: Synthetic polypeptide
  VL of XENP018147

SEQ ID NO: 16898 - protein, 11 aa, Artificial Sequence
  Description of Artificial Sequence: Synthetic peptide
  XENP018147 vlCDR1
RASQSVSNDVA

SEQ ID NO: 16899 - protein, 7 aa, Artificial Sequence
  Description of Artificial Sequence: Synthetic peptide
  XENP018147 vlCDR2
YASHRYT

SEQ ID NO: 16900 - protein, 9 aa, Artificial Sequence
  Description of Artificial Sequence: Synthetic peptide
  XENP018147 vlCDR3
QQDYSSPRT

SEQ ID NO: 16901 - protein, 451 aa, Artificial Sequence
  Description of Artificial Sequence: Synthetic polypeptide
  XENP018148 1G6_H1.51_L1_IgG1_PVA_/S267K Heavy Chain
EVQLVESGGGLVKPGGSLRLSCAASGFTFSNYWMNWVRQAPGKGLEYVGEIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 16902 - protein, 122 aa, Artificial Sequence; identical to SEQ ID NO: 11486
  Description of Artificial Sequence: Synthetic polypeptide
  VH of XENP018148

SEQ ID NO: 16903 - protein, 5 aa, Artificial Sequence
  Description of Artificial Sequence: Synthetic peptide
  XENP018148 vhCDR1
NYWMN

SEQ ID NO: 16904 - protein, 19 aa, Artificial Sequence
  Description of Artificial Sequence: Synthetic peptide
  XENP018148 vhCDR2
EIRLKSNNYATHYAEPVKG

SEQ ID NO: 16905 - protein, 11 aa, Artificial Sequence
  Description of Artificial Sequence: Synthetic peptide
  XENP018148 vhCDR3
YYGNYGGYFDV

SEQ ID NO: 16906 - protein, 214 aa, Artificial Sequence; identical to SEQ ID NO: 16226
  Description of Artificial Sequence: Synthetic polypeptide
  XENP018148 1G6_H1.51_L1_IgG1_PVA_/S267K Light Chain

SEQ ID NO: 16907 - protein, 107 aa, Artificial Sequence; identical to SEQ ID NO: 10923
  Description of Artificial Sequence: Synthetic polypeptide
  VL of XENP018148

SEQ ID NO: 16908 - protein, 11 aa, Artificial Sequence
  Description of Artificial Sequence: Synthetic peptide
  XENP018148 vlCDR1
RASQSVSNDVA

SEQ ID NO: 16909 - protein, 7 aa, Artificial Sequence
  Description of Artificial Sequence: Synthetic peptide
  XENP018148 vlCDR2
YASHRYT

SEQ ID NO: 16910 - protein, 9 aa, Artificial Sequence
  Description of Artificial Sequence: Synthetic peptide
  XENP018148 vlCDR3
QQDYSSPRT

SEQ ID NO: 16911 - protein, 451 aa, Artificial Sequence
  Description of Artificial Sequence: Synthetic polypeptide
  XENP018149 1G6_H1.52_L1_IgG1_PVA_/S267K Heavy Chain
EVQLVESGGGLVKPGGSLRLSCAASGFTFSNYWMNWVRQAPGKGLEWVAEIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 16912 - protein, 122 aa, Artificial Sequence; identical to SEQ ID NO: 11495
  Description of Artificial Sequence: Synthetic polypeptide
  VH of XENP018149

SEQ ID NO: 16913 - protein, 5 aa, Artificial Sequence
  Description of Artificial Sequence: Synthetic peptide
  XENP018149 vhCDR1
NYWMN

SEQ ID NO: 16914 - protein, 19 aa, Artificial Sequence
  Description of Artificial Sequence: Synthetic peptide
  XENP018149 vhCDR2
EIRLKSNNYATHYAEPVKG

SEQ ID NO: 16915 - protein, 11 aa, Artificial Sequence
  Description of Artificial Sequence: Synthetic peptide
  XENP018149 vhCDR3
YYGNYGGYFDV

SEQ ID NO: 16916 - protein, 214 aa, Artificial Sequence; identical to SEQ ID NO: 16226
  Description of Artificial Sequence: Synthetic polypeptide
  XENP018149 1G6_H1.52_L1_IgG1_PVA_/S267K Light Chain

SEQ ID NO: 16917 - protein, 107 aa, Artificial Sequence; identical to SEQ ID NO: 10923
  Description of Artificial Sequence: Synthetic polypeptide
  VL of XENP018149

SEQ ID NO: 16918 - protein, 11 aa, Artificial Sequence
  Description of Artificial Sequence: Synthetic peptide
  XENP018149 vlCDR1
RASQSVSNDVA

SEQ ID NO: 16919 - protein, 7 aa, Artificial Sequence
  Description of Artificial Sequence: Synthetic peptide
  XENP018149 vlCDR2
YASHRYT

SEQ ID NO: 16920 - protein, 9 aa, Artificial Sequence
  Description of Artificial Sequence: Synthetic peptide
  XENP018149 vlCDR3
QQDYSSPRT

SEQ ID NO: 16921 - protein, 451 aa, Artificial Sequence
  Description of Artificial Sequence: Synthetic polypeptide
  XENP018150 1G6_H1.53_L1_IgG1_PVA_/S267K Heavy Chain
EVQLVESGGGLVKPGGSLRLSCAASGFTFSNYWMNWVRQAPGKGLEWVSEIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 16922 - protein, 122 aa, Artificial Sequence; identical to SEQ ID NO: 11504
  Description of Artificial Sequence: Synthetic polypeptide
  VH of XENP018150

SEQ ID NO: 16923 - protein, 5 aa, Artificial Sequence
  Description of Artificial Sequence: Synthetic peptide
  XENP018150 vhCDR1
NYWMN

SEQ ID NO: 16924 - protein, 19 aa, Artificial Sequence
  Description of Artificial Sequence: Synthetic peptide
  XENP018150 vhCDR2
EIRLKSNNYATHYAEPVKG

SEQ ID NO: 16925 - protein, 11 aa, Artificial Sequence
  Description of Artificial Sequence: Synthetic peptide
  XENP018150 vhCDR3
YYGNYGGYFDV

SEQ ID NO: 16926 - protein, 214 aa, Artificial Sequence; identical to SEQ ID NO: 16226
  Description of Artificial Sequence: Synthetic polypeptide
  XENP018150 1G6_H1.53_L1_IgG1_PVA_/S267K Light Chain

SEQ ID NO: 16927 - protein, 107 aa, Artificial Sequence; identical to SEQ ID NO: 10923
  Description of Artificial Sequence: Synthetic polypeptide
  VL of XENP018150

SEQ ID NO: 16928 - protein, 11 aa, Artificial Sequence
  Description of Artificial Sequence: Synthetic peptide
  XENP018150 vlCDR1
RASQSVSNDVA

SEQ ID NO: 16929 - protein, 7 aa, Artificial Sequence
  Description of Artificial Sequence: Synthetic peptide
  XENP018150 vlCDR2
YASHRYT

SEQ ID NO: 16930 - protein, 9 aa, Artificial Sequence
  Description of Artificial Sequence: Synthetic peptide
  XENP018150 vlCDR3
QQDYSSPRT

SEQ ID NO: 16931 - protein, 451 aa, Artificial Sequence
  Description of Artificial Sequence: Synthetic polypeptide
  XENP018151 1G6_H1.54_L1_IgG1_PVA_/S267K Heavy Chain
EVQLVESGGGLVKPGGSLRLSCAASGFTFSNYWMNWVRQAPGKGLEWVGQIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 16932 - protein, 122 aa, Artificial Sequence; identical to SEQ ID NO: 11513
  Description of Artificial Sequence: Synthetic polypeptide
  VH of XENP018151

SEQ ID NO: 16933 - protein, 5 aa, Artificial Sequence
  Description of Artificial Sequence: Synthetic peptide
  XENP018151 vhCDR1
NYWMN

SEQ ID NO: 16934 - protein, 19 aa, Artificial Sequence
  Description of Artificial Sequence: Synthetic peptide
  XENP018151 vhCDR2
QIRLKSNNYATHYAEPVKG

SEQ ID NO: 16935 - protein, 11 aa, Artificial Sequence
  Description of Artificial Sequence: Synthetic peptide
  XENP018151 vhCDR3
YYGNYGGYFDV

SEQ ID NO: 16936 - protein, 214 aa, Artificial Sequence; identical to SEQ ID NO: 16226
  Description of Artificial Sequence: Synthetic polypeptide
  XENP018151 1G6_H1.54_L1_IgG1_PVA_/S267K Light Chain

SEQ ID NO: 16937 - protein, 107 aa, Artificial Sequence; identical to SEQ ID NO: 10923
  Description of Artificial Sequence: Synthetic polypeptide
  VL of XENP018151

SEQ ID NO: 16938 - protein, 11 aa, Artificial Sequence
  Description of Artificial Sequence: Synthetic peptide
  XENP018151 vlCDR1
RASQSVSNDVA

SEQ ID NO: 16939 - protein, 7 aa, Artificial Sequence
  Description of Artificial Sequence: Synthetic peptide
  XENP018151 vlCDR2
YASHRYT

SEQ ID NO: 16940 - protein, 9 aa, Artificial Sequence
  Description of Artificial Sequence: Synthetic peptide
  XENP018151 vlCDR3
QQDYSSPRT

SEQ ID NO: 16941 - protein, 451 aa, Artificial Sequence
  Description of Artificial Sequence: Synthetic polypeptide
  XENP018152 1G6_H1.55_L1_IgG1_PVA_/S267K Heavy Chain
EVQLVESGGGLVKPGGSLRLSCAASGFTFSNYWMNWVRQAPGKGLEWVGDIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 16942 - protein, 122 aa, Artificial Sequence; identical to SEQ ID NO: 11522
  Description of Artificial Sequence: Synthetic polypeptide
  VH of XENP018152

SEQ ID NO: 16943 - protein, 5 aa, Artificial Sequence
  Description of Artificial Sequence: Synthetic peptide
  XENP018152 vhCDR1
NYWMN

SEQ ID NO: 16944 - protein, 19 aa, Artificial Sequence
  Description of Artificial Sequence: Synthetic peptide
  XENP018152 vhCDR2
DIRLKSNNYATHYAEPVKG

SEQ ID NO: 16945 - protein, 11 aa, Artificial Sequence
  Description of Artificial Sequence: Synthetic peptide
  XENP018152 vhCDR3
YYGNYGGYFDV

SEQ ID NO: 16946 - protein, 214 aa, Artificial Sequence; identical to SEQ ID NO: 16226
  Description of Artificial Sequence: Synthetic polypeptide
  XENP018152 1G6_H1.55_L1_IgG1_PVA_/S267K Light Chain

SEQ ID NO: 16947 - protein, 107 aa, Artificial Sequence; identical to SEQ ID NO: 10923
  Description of Artificial Sequence: Synthetic polypeptide
  VL of XENP018152

SEQ ID NO: 16948 - protein, 11 aa, Artificial Sequence
  Description of Artificial Sequence: Synthetic peptide
  XENP018152 vlCDR1
RASQSVSNDVA

SEQ ID NO: 16949 - protein, 7 aa, Artificial Sequence
  Description of Artificial Sequence: Synthetic peptide
  XENP018152 vlCDR2
YASHRYT

SEQ ID NO: 16950 - protein, 9 aa, Artificial Sequence
  Description of Artificial Sequence: Synthetic peptide
  XENP018152 vlCDR3
QQDYSSPRT

SEQ ID NO: 16951 - protein, 451 aa, Artificial Sequence
  Description of Artificial Sequence: Synthetic polypeptide
  XENP018153 1G6_H1.56_L1_IgG1_PVA_/S267K Heavy Chain
EVQLVESGGGLVKPGGSLRLSCAASGFTFSNYWMNWVRQAPGKGLEWVGKIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 16952 - protein, 122 aa, Artificial Sequence; identical to SEQ ID NO: 11531
  Description of Artificial Sequence: Synthetic polypeptide
  VH of XENP018153

SEQ ID NO: 16953 - protein, 5 aa, Artificial Sequence
  Description of Artificial Sequence: Synthetic peptide
  XENP018153 vhCDR1
NYWMN

SEQ ID NO: 16954 - protein, 19 aa, Artificial Sequence
  Description of Artificial Sequence: Synthetic peptide
  XENP018153 vhCDR2
KIRLKSNNYATHYAEPVKG

SEQ ID NO: 16955 - protein, 11 aa, Artificial Sequence
  Description of Artificial Sequence: Synthetic peptide
  XENP018153 vhCDR3
YYGNYGGYFDV

SEQ ID NO: 16956 - protein, 214 aa, Artificial Sequence; identical to SEQ ID NO: 16226
  Description of Artificial Sequence: Synthetic polypeptide
  XENP018153 1G6_H1.56_L1_IgG1_PVA_/S267K Light Chain

SEQ ID NO: 16957 - protein, 107 aa, Artificial Sequence; identical to SEQ ID NO: 10923
  Description of Artificial Sequence: Synthetic polypeptide
  VL of XENP018153

SEQ ID NO: 16958 - protein, 11 aa, Artificial Sequence
  Description of Artificial Sequence: Synthetic peptide
  XENP018153 vlCDR1
RASQSVSNDVA

SEQ ID NO: 16959 - protein, 7 aa, Artificial Sequence
  Description of Artificial Sequence: Synthetic peptide
  XENP018153 vlCDR2
YASHRYT

SEQ ID NO: 16960 - protein, 9 aa, Artificial Sequence
  Description of Artificial Sequence: Synthetic peptide
  XENP018153 vlCDR3
QQDYSSPRT

SEQ ID NO: 16961 - protein, 451 aa, Artificial Sequence
  Description of Artificial Sequence: Synthetic polypeptide
  XENP018154 1G6_H1.57_L1_IgG1_PVA_/S267K Heavy Chain
EVQLVESGGGLVKPGGSLRLSCAASGFTFSNYWMNWVRQAPGKGLEWVGSIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 16962 - protein, 122 aa, Artificial Sequence; identical to SEQ ID NO: 11540
  Description of Artificial Sequence: Synthetic polypeptide
  VH of XENP018154

SEQ ID NO: 16963 - protein, 5 aa, Artificial Sequence
  Description of Artificial Sequence: Synthetic peptide
  XENP018154 vhCDR1
NYWMN

SEQ ID NO: 16964 - protein, 19 aa, Artificial Sequence
  Description of Artificial Sequence: Synthetic peptide
  XENP018154 vhCDR2
SIRLKSNNYATHYAEPVKG

SEQ ID NO: 16965 - protein, 11 aa, Artificial Sequence
  Description of Artificial Sequence: Synthetic peptide
  XENP018154 vhCDR3
YYGNYGGYFDV

SEQ ID NO: 16966 - protein, 214 aa, Artificial Sequence; identical to SEQ ID NO: 16226
  Description of Artificial Sequence: Synthetic polypeptide
  XENP018154 1G6_H1.57_L1_IgG1_PVA_/S267K Light Chain

SEQ ID NO: 16967 - protein, 107 aa, Artificial Sequence; identical to SEQ ID NO: 10923
  Description of Artificial Sequence: Synthetic polypeptide
  VL of XENP018154

SEQ ID NO: 16968 - protein, 11 aa, Artificial Sequence
  Description of Artificial Sequence: Synthetic peptide
  XENP018154 vlCDR1
RASQSVSNDVA

SEQ ID NO: 16969 - protein, 7 aa, Artificial Sequence
  Description of Artificial Sequence: Synthetic peptide
  XENP018154 vlCDR2
YASHRYT

SEQ ID NO: 16970 - protein, 9 aa, Artificial Sequence
  Description of Artificial Sequence: Synthetic peptide
  XENP018154 vlCDR3
QQDYSSPRT

SEQ ID NO: 16971 - protein, 451 aa, Artificial Sequence
  Description of Artificial Sequence: Synthetic polypeptide
  XENP018155 1G6_H1.58_L1_IgG1_PVA_/S267K Heavy Chain
EVQLVESGGGLVKPGGSLRLSCAASGFTFSNYWMNWVRQAPGKGLEWVGHIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 16972 - protein, 122 aa, Artificial Sequence; identical to SEQ ID NO: 11549
  Description of Artificial Sequence: Synthetic polypeptide
  VH of XENP018155

SEQ ID NO: 16973 - protein, 5 aa, Artificial Sequence
  Description of Artificial Sequence: Synthetic peptide
  XENP018155 vhCDR1
NYWMN

SEQ ID NO: 16974 - protein, 19 aa, Artificial Sequence
  Description of Artificial Sequence: Synthetic peptide
  XENP018155 vhCDR2
HIRLKSNNYATHYAEPVKG

SEQ ID NO: 16975 - protein, 11 aa, Artificial Sequence
  Description of Artificial Sequence: Synthetic peptide
  XENP018155 vhCDR3
YYGNYGGYFDV

SEQ ID NO: 16976 - protein, 214 aa, Artificial Sequence; identical to SEQ ID NO: 16226
  Description of Artificial Sequence: Synthetic polypeptide
  XENP018155 1G6_H1.58_L1_IgG1_PVA_/S267K Light Chain

SEQ ID NO: 16977 - protein, 107 aa, Artificial Sequence; identical to SEQ ID NO: 10923
  Description of Artificial Sequence: Synthetic polypeptide
  VL of XENP018155

SEQ ID NO: 16978 - protein, 11 aa, Artificial Sequence
  Description of Artificial Sequence: Synthetic peptide
  XENP018155 vlCDR1
RASQSVSNDVA

SEQ ID NO: 16979 - protein, 7 aa, Artificial Sequence
  Description of Artificial Sequence: Synthetic peptide
  XENP018155 vlCDR2
YASHRYT

SEQ ID NO: 16980 - protein, 9 aa, Artificial Sequence
  Description of Artificial Sequence: Synthetic peptide
  XENP018155 vlCDR3
QQDYSSPRT

SEQ ID NO: 16981 - protein, 451 aa, Artificial Sequence
  Description of Artificial Sequence: Synthetic polypeptide
  XENP018156 1G6_H1.59_L1_IgG1_PVA_/S267K Heavy Chain
EVQLVESGGGLVKPGGSLRLSCAASGFTFSNYWMNWVRQAPGKGLEWVGAIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 16982 - protein, 122 aa, Artificial Sequence; identical to SEQ ID NO: 11558
  Description of Artificial Sequence: Synthetic polypeptide
  VH of XENP018156

SEQ ID NO: 16983 - protein, 5 aa, Artificial Sequence
  Description of Artificial Sequence: Synthetic peptide
  XENP018156 vhCDR1
NYWMN

SEQ ID NO: 16984 - protein, 19 aa, Artificial Sequence
  Description of Artificial Sequence: Synthetic peptide
  XENP018156 vhCDR2
AIRLKSNNYATHYAEPVKG

SEQ ID NO: 16985 - protein, 11 aa, Artificial Sequence
  Description of Artificial Sequence: Synthetic peptide
  XENP018156 vhCDR3
YYGNYGGYFDV

SEQ ID NO: 16986 - protein, 214 aa, Artificial Sequence; identical to SEQ ID NO: 16226
  Description of Artificial Sequence: Synthetic polypeptide
  XENP018156 1G6_H1.59_L1_IgG1_PVA_/S267K Light Chain

SEQ ID NO: 16987 - protein, 107 aa, Artificial Sequence; identical to SEQ ID NO: 10923
  Description of Artificial Sequence: Synthetic polypeptide
  VL of XENP018156

SEQ ID NO: 16988 - protein, 11 aa, Artificial Sequence
  Description of Artificial Sequence: Synthetic peptide
  XENP018156 vlCDR1
RASQSVSNDVA

SEQ ID NO: 16989 - protein, 7 aa, Artificial Sequence
  Description of Artificial Sequence: Synthetic peptide
  XENP018156 vlCDR2
YASHRYT

SEQ ID NO: 16990 - protein, 9 aa, Artificial Sequence
  Description of Artificial Sequence: Synthetic peptide
  XENP018156 vlCDR3
QQDYSSPRT

SEQ ID NO: 16991 - protein, 451 aa, Artificial Sequence
  Description of Artificial Sequence: Synthetic polypeptide
  XENP018157 1G6_H1.60_L1_IgG1_PVA_/S267K Heavy Chain
EVQLVESGGGLVKPGGSLRLSCAASGFTFSNYWMNWVRQAPGKGLEWVGGIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 16992 - protein, 122 aa, Artificial Sequence; identical to SEQ ID NO: 11567
  Description of Artificial Sequence: Synthetic polypeptide
  VH of XENP018157

SEQ ID NO: 16993 - protein, 5 aa, Artificial Sequence
  Description of Artificial Sequence: Synthetic peptide
  XENP018157 vhCDR1
NYWMN

SEQ ID NO: 16994 - protein, 19 aa, Artificial Sequence
  Description of Artificial Sequence: Synthetic peptide
  XENP018157 vhCDR2
GIRLKSNNYATHYAEPVKG

SEQ ID NO: 16995 - protein, 11 aa, Artificial Sequence
  Description of Artificial Sequence: Synthetic peptide
  XENP018157 vhCDR3
YYGNYGGYFDV

SEQ ID NO: 16996 - protein, 214 aa, Artificial Sequence; identical to SEQ ID NO: 16226
  Description of Artificial Sequence: Synthetic polypeptide
  XENP018157 1G6_H1.60_L1_IgG1_PVA_/S267K Light Chain

SEQ ID NO: 16997 - protein, 107 aa, Artificial Sequence; identical to SEQ ID NO: 10923
  Description of Artificial Sequence: Synthetic polypeptide
  VL of XENP018157

SEQ ID NO: 16998 - protein, 11 aa, Artificial Sequence
  Description of Artificial Sequence: Synthetic peptide
  XENP018157 vlCDR1
RASQSVSNDVA

SEQ ID NO: 16999 - protein, 7 aa, Artificial Sequence
  Description of Artificial Sequence: Synthetic peptide
  XENP018157 vlCDR2
YASHRYT

SEQ ID NO: 17000 - protein, 9 aa, Artificial Sequence
  Description of Artificial Sequence: Synthetic peptide
  XENP018157 vlCDR3
QQDYSSPRT

SEQ ID NO: 17001 - protein, 451 aa, Artificial Sequence
  Description of Artificial Sequence: Synthetic polypeptide
  XENP018158 1G6_H1.61_L1_IgG1_PVA_/S267K Heavy Chain
EVQLVESGGGLVKPGGSLRLSCAASGFTFSNYWMNWVRQAPGKGLEWVGYIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 17002 - protein, 122 aa, Artificial Sequence; identical to SEQ ID NO: 11576
  Description of Artificial Sequence: Synthetic polypeptide
  VH of XENP018158

SEQ ID NO: 17003 - protein, 5 aa, Artificial Sequence
  Description of Artificial Sequence: Synthetic peptide
  XENP018158 vhCDR1
NYWMN

SEQ ID NO: 17004 - protein, 19 aa, Artificial Sequence
  Description of Artificial Sequence: Synthetic peptide
  XENP018158 vhCDR2
YIRLKSNNYATHYAEPVKG

SEQ ID NO: 17005 - protein, 11 aa, Artificial Sequence
  Description of Artificial Sequence: Synthetic peptide
  XENP018158 vhCDR3
YYGNYGGYFDV

SEQ ID NO: 17006 - protein, 214 aa, Artificial Sequence; identical to SEQ ID NO: 16226
  Description of Artificial Sequence: Synthetic polypeptide
  XENP018158 1G6_H1.61_L1_IgG1_PVA_/S267K Light Chain

SEQ ID NO: 17007 - protein, 107 aa, Artificial Sequence; identical to SEQ ID NO: 10923
  Description of Artificial Sequence: Synthetic polypeptide
  VL of XENP018158

SEQ ID NO: 17008 - protein, 11 aa, Artificial Sequence
  Description of Artificial Sequence: Synthetic peptide
  XENP018158 vlCDR1
RASQSVSNDVA

SEQ ID NO: 17009 - protein, 7 aa, Artificial Sequence
  Description of Artificial Sequence: Synthetic peptide
  XENP018158 vlCDR2
YASHRYT

SEQ ID NO: 17010 - protein, 9 aa, Artificial Sequence
  Description of Artificial Sequence: Synthetic peptide
  XENP018158 vlCDR3
QQDYSSPRT

SEQ ID NO: 17011 - protein, 451 aa, Artificial Sequence
  Description of Artificial Sequence: Synthetic polypeptide
  XENP018159 1G6_H1.62_L1_IgG1_PVA_/S267K Heavy Chain
EVQLVESGGGLVKPGGSLRLSCAASGFTFSNYWMNWVRQAPGKGLEWVGIIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 17012 - protein, 122 aa, Artificial Sequence; identical to SEQ ID NO: 11585
  Description of Artificial Sequence: Synthetic polypeptide
  VH of XENP018159

SEQ ID NO: 17013 - protein, 5 aa, Artificial Sequence
  Description of Artificial Sequence: Synthetic peptide
  XENP018159 vhCDR1
NYWMN

SEQ ID NO: 17014 - protein, 19 aa, Artificial Sequence
  Description of Artificial Sequence: Synthetic peptide
  XENP018159 vhCDR2
IIRLKSNNYATHYAEPVKG

SEQ ID NO: 17015 - protein, 11 aa, Artificial Sequence
  Description of Artificial Sequence: Synthetic peptide
  XENP018159 vhCDR3
YYGNYGGYFDV

SEQ ID NO: 17016 - protein, 214 aa, Artificial Sequence; identical to SEQ ID NO: 16226
  Description of Artificial Sequence: Synthetic polypeptide
  XENP018159 1G6_H1.62_L1_IgG1_PVA_/S267K Light Chain

SEQ ID NO: 17017 - protein, 107 aa, Artificial Sequence; identical to SEQ ID NO: 10923
  Description of Artificial Sequence: Synthetic polypeptide
  VL of XENP018159

SEQ ID NO: 17018 - protein, 11 aa, Artificial Sequence
  Description of Artificial Sequence: Synthetic peptide
  XENP018159 vlCDR1
RASQSVSNDVA

SEQ ID NO: 17019 - protein, 7 aa, Artificial Sequence
  Description of Artificial Sequence: Synthetic peptide
  XENP018159 vlCDR2
YASHRYT

SEQ ID NO: 17020 - protein, 9 aa, Artificial Sequence
  Description of Artificial Sequence: Synthetic peptide
  XENP018159 vlCDR3
QQDYSSPRT

SEQ ID NO: 17021 - protein, 451 aa, Artificial Sequence
  Description of Artificial Sequence: Synthetic polypeptide
  XENP018160 1G6_H1.63_L1_IgG1_PVA_/S267K Heavy Chain
EVQLVESGGGLVKPGGSLRLSCAASGFTFSNYWMNWVRQAPGKGLEWVGEVRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 17022 - protein, 122 aa, Artificial Sequence; identical to SEQ ID NO: 11594
  Description of Artificial Sequence: Synthetic polypeptide
  VH of XENP018160

SEQ ID NO: 17023 - protein, 5 aa, Artificial Sequence
  Description of Artificial Sequence: Synthetic peptide
  XENP018160 vhCDR1
NYWMN

SEQ ID NO: 17024 - protein, 19 aa, Artificial Sequence
  Description of Artificial Sequence: Synthetic peptide
  XENP018160 vhCDR2
EVRLKSNNYATHYAEPVKG

SEQ ID NO: 17025 - protein, 11 aa, Artificial Sequence
  Description of Artificial Sequence: Synthetic peptide
  XENP018160 vhCDR3
YYGNYGGYFDV

SEQ ID NO: 17026 - protein, 214 aa, Artificial Sequence; identical to SEQ ID NO: 16226
  Description of Artificial Sequence: Synthetic polypeptide
  XENP018160 1G6_H1.63_L1_IgG1_PVA_/S267K Light Chain

SEQ ID NO: 17027 - protein, 107 aa, Artificial Sequence; identical to SEQ ID NO: 10923
  Description of Artificial Sequence: Synthetic polypeptide
  VL of XENP018160

SEQ ID NO: 17028 - protein, 11 aa, Artificial Sequence
  Description of Artificial Sequence: Synthetic peptide
  XENP018160 vlCDR1
RASQSVSNDVA

SEQ ID NO: 17029 - protein, 7 aa, Artificial Sequence
  Description of Artificial Sequence: Synthetic peptide
  XENP018160 vlCDR2
YASHRYT

SEQ ID NO: 17030 - protein, 9 aa, Artificial Sequence
  Description of Artificial Sequence: Synthetic peptide
  XENP018160 vlCDR3
QQDYSSPRT

SEQ ID NO: 17031 - protein, 451 aa, Artificial Sequence
  Description of Artificial Sequence: Synthetic polypeptide
  XENP018161 1G6_H1.64_L1_IgG1_PVA_/S267K Heavy Chain
EVQLVESGGGLVKPGGSLRLSCAASGFTFSNYWMNWVRQAPGKGLEWVGEITLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 17032 - protein, 122 aa, Artificial Sequence; identical to SEQ ID NO: 11603
  Description of Artificial Sequence: Synthetic polypeptide
  VH of XENP018161

SEQ ID NO: 17033 - protein, 5 aa, Artificial Sequence
  Description of Artificial Sequence: Synthetic peptide
  XENP018161 vhCDR1
NYWMN

SEQ ID NO: 17034 - protein, 19 aa, Artificial Sequence
  Description of Artificial Sequence: Synthetic peptide
  XENP018161 vhCDR2
EITLKSNNYATHYAEPVKG

SEQ ID NO: 17035 - protein, 11 aa, Artificial Sequence
  Description of Artificial Sequence: Synthetic peptide
  XENP018161 vhCDR3
YYGNYGGYFDV

SEQ ID NO: 17036 - protein, 214 aa, Artificial Sequence; identical to SEQ ID NO: 16226
  Description of Artificial Sequence: Synthetic polypeptide
  XENP018161 1G6_H1.64_L1_IgG1_PVA_/S267K Light Chain

SEQ ID NO: 17037 - protein, 107 aa, Artificial Sequence; identical to SEQ ID NO: 10923
  Description of Artificial Sequence: Synthetic polypeptide
  VL of XENP018161

SEQ ID NO: 17038 - protein, 11 aa, Artificial Sequence
  Description of Artificial Sequence: Synthetic peptide
  XENP018161 vlCDR1
RASQSVSNDVA

SEQ ID NO: 17039 - protein, 7 aa, Artificial Sequence
  Description of Artificial Sequence: Synthetic peptide
  XENP018161 vlCDR2
YASHRYT

SEQ ID NO: 17040 - protein, 9 aa, Artificial Sequence
  Description of Artificial Sequence: Synthetic peptide
  XENP018161 vlCDR3
QQDYSSPRT

SEQ ID NO: 17041 - protein, 451 aa, Artificial Sequence
  Description of Artificial Sequence: Synthetic polypeptide
  XENP018162 1G6_H1.65_L1_IgG1_PVA_/S267K Heavy Chain
EVQLVESGGGLVKPGGSLRLSCAASGFTFSNYWMNWVRQAPGKGLEWVGEIKLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 17042 - protein, 122 aa, Artificial Sequence; identical to SEQ ID NO: 11612
  Description of Artificial Sequence: Synthetic polypeptide
  VH of XENP018162

SEQ ID NO: 17043 - protein, 5 aa, Artificial Sequence
  Description of Artificial Sequence: Synthetic peptide
  XENP018162 vhCDR1
NYWMN

SEQ ID NO: 17044 - protein, 19 aa, Artificial Sequence
  Description of Artificial Sequence: Synthetic peptide
  XENP018162 vhCDR2
EIKLKSNNYATHYAEPVKG

SEQ ID NO: 17045 - protein, 11 aa, Artificial Sequence
  Description of Artificial Sequence: Synthetic peptide
  XENP018162 vhCDR3
YYGNYGGYFDV

SEQ ID NO: 17046 - protein, 214 aa, Artificial Sequence; identical to SEQ ID NO: 16226
  Description of Artificial Sequence: Synthetic polypeptide
  XENP018162 1G6_H1.65_L1_IgG1_PVA_/S267K Light Chain

SEQ ID NO: 17047 - protein, 107 aa, Artificial Sequence; identical to SEQ ID NO: 10923
  Description of Artificial Sequence: Synthetic polypeptide
  VL of XENP018162

SEQ ID NO: 17048 - protein, 11 aa, Artificial Sequence
  Description of Artificial Sequence: Synthetic peptide
  XENP018162 vlCDR1
RASQSVSNDVA

SEQ ID NO: 17049 - protein, 7 aa, Artificial Sequence
  Description of Artificial Sequence: Synthetic peptide
  XENP018162 vlCDR2
YASHRYT

SEQ ID NO: 17050 - protein, 9 aa, Artificial Sequence
  Description of Artificial Sequence: Synthetic peptide
  XENP018162 vlCDR3
QQDYSSPRT

SEQ ID NO: 17051 - protein, 451 aa, Artificial Sequence
  Description of Artificial Sequence: Synthetic polypeptide
  XENP018163 1G6_H1.66_L1_IgG1_PVA_/S267K Heavy Chain
EVQLVESGGGLVKPGGSLRLSCAASGFTFSNYWMNWVRQAPGKGLEWVGEIELKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 17052 - protein, 122 aa, Artificial Sequence; identical to SEQ ID NO: 11621
  Description of Artificial Sequence: Synthetic polypeptide
  VH of XENP018163

SEQ ID NO: 17053 - protein, 5 aa, Artificial Sequence
  Description of Artificial Sequence: Synthetic peptide
  XENP018163 vhCDR1
NYWMN

SEQ ID NO: 17054 - protein, 19 aa, Artificial Sequence
  Description of Artificial Sequence: Synthetic peptide
  XENP018163 vhCDR2
EIELKSNNYATHYAEPVKG

SEQ ID NO: 17055 - protein, 11 aa, Artificial Sequence
  Description of Artificial Sequence: Synthetic peptide
  XENP018163 vhCDR3
YYGNYGGYFDV

SEQ ID NO: 17056 - protein, 214 aa, Artificial Sequence; identical to SEQ ID NO: 16226
  Description of Artificial Sequence: Synthetic polypeptide
  XENP018163 1G6_H1.66_L1_IgG1_PVA_/S267K Light Chain

SEQ ID NO: 17057 - protein, 107 aa, Artificial Sequence; identical to SEQ ID NO: 10923
  Description of Artificial Sequence: Synthetic polypeptide
  VL of XENP018163

SEQ ID NO: 17058 - protein, 11 aa, Artificial Sequence
  Description of Artificial Sequence: Synthetic peptide
  XENP018163 vlCDR1
RASQSVSNDVA

SEQ ID NO: 17059 - protein, 7 aa, Artificial Sequence
  Description of Artificial Sequence: Synthetic peptide
  XENP018163 vlCDR2
YASHRYT

SEQ ID NO: 17060 - protein, 9 aa, Artificial Sequence
  Description of Artificial Sequence: Synthetic peptide
  XENP018163 vlCDR3
QQDYSSPRT

SEQ ID NO: 17061 - protein, 451 aa, Artificial Sequence
  Description of Artificial Sequence: Synthetic polypeptide
  XENP018164 1G6_H1.67_L1_IgG1_PVA_/S267K Heavy Chain
EVQLVESGGGLVKPGGSLRLSCAASGFTFSNYWMNWVRQAPGKGLEWVGEIDLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 17062 - protein, 122 aa, Artificial Sequence; identical to SEQ ID NO: 11630
  Description of Artificial Sequence: Synthetic polypeptide
  VH of XENP018164

SEQ ID NO: 17063 - protein, 5 aa, Artificial Sequence
  Description of Artificial Sequence: Synthetic peptide
  XENP018164 vhCDR1
NYWMN

SEQ ID NO: 17064 - protein, 19 aa, Artificial Sequence
  Description of Artificial Sequence: Synthetic peptide
  XENP018164 vhCDR2
EIDLKSNNYATHYAEPVKG

SEQ ID NO: 17065 - protein, 11 aa, Artificial Sequence
  Description of Artificial Sequence: Synthetic peptide
  XENP018164 vhCDR3
YYGNYGGYFDV

SEQ ID NO: 17066 - protein, 214 aa, Artificial Sequence; identical to SEQ ID NO: 16226
  Description of Artificial Sequence: Synthetic polypeptide
  XENP018164 1G6_H1.67_L1_IgG1_PVA_/S267K Light Chain

SEQ ID NO: 17067 - protein, 107 aa, Artificial Sequence; identical to SEQ ID NO: 10923
  Description of Artificial Sequence: Synthetic polypeptide
  VL of XENP018164

SEQ ID NO: 17068 - protein, 11 aa, Artificial Sequence
  Description of Artificial Sequence: Synthetic peptide
  XENP018164 vlCDR1
RASQSVSNDVA

SEQ ID NO: 17069 - protein, 7 aa, Artificial Sequence
  Description of Artificial Sequence: Synthetic peptide
  XENP018164 vlCDR2
YASHRYT

SEQ ID NO: 17070 - protein, 9 aa, Artificial Sequence
  Description of Artificial Sequence: Synthetic peptide
  XENP018164 vlCDR3
QQDYSSPRT

SEQ ID NO: 17071 - protein, 451 aa, Artificial Sequence
  Description of Artificial Sequence: Synthetic polypeptide
  XENP018165 1G6_H1.68_L1_IgG1_PVA_/S267K Heavy Chain
EVQLVESGGGLVKPGGSLRLSCAASGFTFSNYWMNWVRQAPGKGLEWVGEIHLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 17072 - protein, 122 aa, Artificial Sequence; identical to SEQ ID NO: 11639
  Description of Artificial Sequence: Synthetic polypeptide
  VH of XENP018165

SEQ ID NO: 17073 - protein, 5 aa, Artificial Sequence
  Description of Artificial Sequence: Synthetic peptide
  XENP018165 vhCDR1
NYWMN

SEQ ID NO: 17074 - protein, 19 aa, Artificial Sequence
  Description of Artificial Sequence: Synthetic peptide
  XENP018165 vhCDR2
EIHLKSNNYATHYAEPVKG

SEQ ID NO: 17075 - protein, 11 aa, Artificial Sequence
  Description of Artificial Sequence: Synthetic peptide
  XENP018165 vhCDR3
YYGNYGGYFDV

SEQ ID NO: 17076 - protein, 214 aa, Artificial Sequence; identical to SEQ ID NO: 16226
  Description of Artificial Sequence: Synthetic polypeptide
  XENP018165 1G6_H1.68_L1_IgG1_PVA_/S267K Light Chain

SEQ ID NO: 17077 - protein, 107 aa, Artificial Sequence; identical to SEQ ID NO: 10923
  Description of Artificial Sequence: Synthetic polypeptide
  VL of XENP018165

SEQ ID NO: 17078 - protein, 11 aa, Artificial Sequence
  Description of Artificial Sequence: Synthetic peptide
  XENP018165 vlCDR1
RASQSVSNDVA

SEQ ID NO: 17079 - protein, 7 aa, Artificial Sequence
  Description of Artificial Sequence: Synthetic peptide
  XENP018165 vlCDR2
YASHRYT

SEQ ID NO: 17080 - protein, 9 aa, Artificial Sequence
  Description of Artificial Sequence: Synthetic peptide
  XENP018165 vlCDR3
QQDYSSPRT

SEQ ID NO: 17081 - protein, 451 aa, Artificial Sequence
  Description of Artificial Sequence: Synthetic polypeptide
  XENP018166 1G6_H1.69_L1_IgG1_PVA_/S267K Heavy Chain
EVQLVESGGGLVKPGGSLRLSCAASGFTFSNYWMNWVRQAPGKGLEWVGEISLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 17082 - protein, 122 aa, Artificial Sequence; identical to SEQ ID NO: 11648
  Description of Artificial Sequence: Synthetic polypeptide
  VH of XENP018166

SEQ ID NO: 17083 - protein, 5 aa, Artificial Sequence
  Description of Artificial Sequence: Synthetic peptide
  XENP018166 vhCDR1
NYWMN

SEQ ID NO: 17084 - protein, 19 aa, Artificial Sequence
  Description of Artificial Sequence: Synthetic peptide
  XENP018166 vhCDR2
EISLKSNNYATHYAEPVKG

SEQ ID NO: 17085 - protein, 11 aa, Artificial Sequence
  Description of Artificial Sequence: Synthetic peptide
  XENP018166 vhCDR3
YYGNYGGYFDV

SEQ ID NO: 17086 - protein, 214 aa, Artificial Sequence; identical to SEQ ID NO: 16226
  Description of Artificial Sequence: Synthetic polypeptide
  XENP018166 1G6_H1.69_L1_IgG1_PVA_/S267K Light Chain

SEQ ID NO: 17087 - protein, 107 aa, Artificial Sequence; identical to SEQ ID NO: 10923
  Description of Artificial Sequence: Synthetic polypeptide
  VL of XENP018166

SEQ ID NO: 17088 - protein, 11 aa, Artificial Sequence
  Description of Artificial Sequence: Synthetic peptide
  XENP018166 vlCDR1
RASQSVSNDVA

SEQ ID NO: 17089 - protein, 7 aa, Artificial Sequence
  Description of Artificial Sequence: Synthetic peptide
  XENP018166 vlCDR2
YASHRYT

SEQ ID NO: 17090 - protein, 9 aa, Artificial Sequence
  Description of Artificial Sequence: Synthetic peptide
  XENP018166 vlCDR3
QQDYSSPRT

SEQ ID NO: 17091 - protein, 451 aa, Artificial Sequence
  Description of Artificial Sequence: Synthetic polypeptide
  XENP018167 1G6_H1.70_L1_IgG1_PVA_/S267K Heavy Chain
EVQLVESGGGLVKPGGSLRLSCAASGFTFSNYWMNWVRQAPGKGLEWVGEIGLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 17092 - protein, 122 aa, Artificial Sequence; identical to SEQ ID NO: 11657
  Description of Artificial Sequence: Synthetic polypeptide
  VH of XENP018167

SEQ ID NO: 17093 - protein, 5 aa, Artificial Sequence
  Description of Artificial Sequence: Synthetic peptide
  XENP018167 vhCDR1
NYWMN

SEQ ID NO: 17094 - protein, 19 aa, Artificial Sequence
  Description of Artificial Sequence: Synthetic peptide
  XENP018167 vhCDR2
EIGLKSNNYATHYAEPVKG

SEQ ID NO: 17095 - protein, 11 aa, Artificial Sequence
  Description of Artificial Sequence: Synthetic peptide
  XENP018167 vhCDR3
YYGNYGGYFDV

SEQ ID NO: 17096 - protein, 214 aa, Artificial Sequence; identical to SEQ ID NO: 16226
  Description of Artificial Sequence: Synthetic polypeptide
  XENP018167 1G6_H1.70_L1_IgG1_PVA_/S267K Light Chain

SEQ ID NO: 17097 - protein, 107 aa, Artificial Sequence; identical to SEQ ID NO: 10923
  Description of Artificial Sequence: Synthetic polypeptide
  VL of XENP018167

SEQ ID NO: 17098 - protein, 11 aa, Artificial Sequence
  Description of Artificial Sequence: Synthetic peptide
  XENP018167 vlCDR1
RASQSVSNDVA

SEQ ID NO: 17099 - protein, 7 aa, Artificial Sequence
  Description of Artificial Sequence: Synthetic peptide
  XENP018167 vlCDR2
YASHRYT

SEQ ID NO: 17100 - protein, 9 aa, Artificial Sequence
  Description of Artificial Sequence: Synthetic peptide
  XENP018167 vlCDR3
QQDYSSPRT

SEQ ID NO: 17101 - protein, 451 aa, Artificial Sequence
  Description of Artificial Sequence: Synthetic polypeptide
  XENP018168 1G6_H1.71_L1_IgG1_PVA_/S267K Heavy Chain
EVQLVESGGGLVKPGGSLRLSCAASGFTFSNYWMNWVRQAPGKGLEWVGEIYLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 17102 - protein, 122 aa, Artificial Sequence; identical to SEQ ID NO: 11666
  Description of Artificial Sequence: Synthetic polypeptide
  VH of XENP018168

SEQ ID NO: 17103 - protein, 5 aa, Artificial Sequence
  Description of Artificial Sequence: Synthetic peptide
  XENP018168 vhCDR1
NYWMN

SEQ ID NO: 17104 - protein, 19 aa, Artificial Sequence
  Description of Artificial Sequence: Synthetic peptide
  XENP018168 vhCDR2
EIYLKSNNYATHYAEPVKG

SEQ ID NO: 17105 - protein, 11 aa, Artificial Sequence
  Description of Artificial Sequence: Synthetic peptide
  XENP018168 vhCDR3
YYGNYGGYFDV

SEQ ID NO: 17106 - protein, 214 aa, Artificial Sequence; identical to SEQ ID NO: 16226
  Description of Artificial Sequence: Synthetic polypeptide
  XENP018168 1G6_H1.71_L1_IgG1_PVA_/S267K Light Chain

SEQ ID NO: 17107 - protein, 107 aa, Artificial Sequence; identical to SEQ ID NO: 10923
  Description of Artificial Sequence: Synthetic polypeptide
  VL of XENP018168

SEQ ID NO: 17108 - protein, 11 aa, Artificial Sequence
  Description of Artificial Sequence: Synthetic peptide
  XENP018168 vlCDR1
RASQSVSNDVA

SEQ ID NO: 17109 - protein, 7 aa, Artificial Sequence
  Description of Artificial Sequence: Synthetic peptide
  XENP018168 vlCDR2
YASHRYT

SEQ ID NO: 17110 - protein, 9 aa, Artificial Sequence
  Description of Artificial Sequence: Synthetic peptide
  XENP018168 vlCDR3
QQDYSSPRT

SEQ ID NO: 17111 - protein, 451 aa, Artificial Sequence
  Description of Artificial Sequence: Synthetic polypeptide
  XENP018169 1G6_H1.72_L1_IgG1_PVA_/S267K Heavy Chain
EVQLVESGGGLVKPGGSLRLSCAASGFTFSNYWMNWVRQAPGKGLEWVGEIILKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 17112 - protein, 122 aa, Artificial Sequence; identical to SEQ ID NO: 11675
  Description of Artificial Sequence: Synthetic polypeptide
  VH of XENP018169

SEQ ID NO: 17113 - protein, 5 aa, Artificial Sequence
  Description of Artificial Sequence: Synthetic peptide
  XENP018169 vhCDR1
NYWMN

SEQ ID NO: 17114 - protein, 19 aa, Artificial Sequence
  Description of Artificial Sequence: Synthetic peptide
  XENP018169 vhCDR2
EIILKSNNYATHYAEPVKG

SEQ ID NO: 17115 - protein, 11 aa, Artificial Sequence
  Description of Artificial Sequence: Synthetic peptide
  XENP018169 vhCDR3
YYGNYGGYFDV

SEQ ID NO: 17116 - protein, 214 aa, Artificial Sequence; identical to SEQ ID NO: 16226
  Description of Artificial Sequence: Synthetic polypeptide
  XENP018169 1G6_H1.72_L1_IgG1_PVA_/S267K Light Chain

SEQ ID NO: 17117 - protein, 107 aa, Artificial Sequence; identical to SEQ ID NO: 10923
  Description of Artificial Sequence: Synthetic polypeptide
  VL of XENP018169

SEQ ID NO: 17118 - protein, 11 aa, Artificial Sequence
  Description of Artificial Sequence: Synthetic peptide
  XENP018169 vlCDR1
RASQSVSNDVA

SEQ ID NO: 17119 - protein, 7 aa, Artificial Sequence
  Description of Artificial Sequence: Synthetic peptide
  XENP018169 vlCDR2
YASHRYT

SEQ ID NO: 17120 - protein, 9 aa, Artificial Sequence
  Description of Artificial Sequence: Synthetic peptide
  XENP018169 vlCDR3
QQDYSSPRT

SEQ ID NO: 17121 - protein, 451 aa, Artificial Sequence
  Description of Artificial Sequence: Synthetic polypeptide
  XENP018170 1G6_H1.73_L1_IgG1_PVA_/S267K Heavy Chain
EVQLVESGGGLVKPGGSLRLSCAASGFTFSNYWMNWVRQAPGKGLEWVGEIWLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 17122 - protein, 122 aa, Artificial Sequence; identical to SEQ ID NO: 11684
  Description of Artificial Sequence: Synthetic polypeptide
  VH of XENP018170

SEQ ID NO: 17123 - protein, 5 aa, Artificial Sequence
  Description of Artificial Sequence: Synthetic peptide
  XENP018170 vhCDR1
NYWMN

SEQ ID NO: 17124 - protein, 19 aa, Artificial Sequence
  Description of Artificial Sequence: Synthetic peptide
  XENP018170 vhCDR2
EIWLKSNNYATHYAEPVKG

SEQ ID NO: 17125 - protein, 11 aa, Artificial Sequence
  Description of Artificial Sequence: Synthetic peptide
  XENP018170 vhCDR3
YYGNYGGYFDV

SEQ ID NO: 17126 - protein, 214 aa, Artificial Sequence; identical to SEQ ID NO: 16226
  Description of Artificial Sequence: Synthetic polypeptide
  XENP018170 1G6_H1.73_L1_IgG1_PVA_/S267K Light Chain

SEQ ID NO: 17127 - protein, 107 aa, Artificial Sequence; identical to SEQ ID NO: 10923
  Description of Artificial Sequence: Synthetic polypeptide
  VL of XENP018170

SEQ ID NO: 17128 - protein, 11 aa, Artificial Sequence
  Description of Artificial Sequence: Synthetic peptide
  XENP018170 vlCDR1
RASQSVSNDVA

SEQ ID NO: 17129 - protein, 7 aa, Artificial Sequence
  Description of Artificial Sequence: Synthetic peptide
  XENP018170 vlCDR2
YASHRYT

SEQ ID NO: 17130 - protein, 9 aa, Artificial Sequence
  Description of Artificial Sequence: Synthetic peptide
  XENP018170 vlCDR3
QQDYSSPRT

SEQ ID NO: 17131 - protein, 451 aa, Artificial Sequence
  Description of Artificial Sequence: Synthetic polypeptide
  XENP018171 1G6_H1.74_L1_IgG1_PVA_/S267K Heavy Chain
EVQLVESGGGLVKPGGSLRLSCAASGFTFSNYWMNWVRQAPGKGLEWVGEIRIKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 17132 - protein, 122 aa, Artificial Sequence; identical to SEQ ID NO: 11693
  Description of Artificial Sequence: Synthetic polypeptide
  VH of XENP018171

SEQ ID NO: 17133 - protein, 5 aa, Artificial Sequence
  Description of Artificial Sequence: Synthetic peptide
  XENP018171 vhCDR1
NYWMN

SEQ ID NO: 17134 - protein, 19 aa, Artificial Sequence
  Description of Artificial Sequence: Synthetic peptide
  XENP018171 vhCDR2
EIRIKSNNYATHYAEPVKG

SEQ ID NO: 17135 - protein, 11 aa, Artificial Sequence
  Description of Artificial Sequence: Synthetic peptide
  XENP018171 vhCDR3
YYGNYGGYFDV

SEQ ID NO: 17136 - protein, 214 aa, Artificial Sequence; identical to SEQ ID NO: 16226
  Description of Artificial Sequence: Synthetic polypeptide
  XENP018171 1G6_H1.74_L1_IgG1_PVA_/S267K Light Chain

SEQ ID NO: 17137 - protein, 107 aa, Artificial Sequence; identical to SEQ ID NO: 10923
  Description of Artificial Sequence: Synthetic polypeptide
  VL of XENP018171

SEQ ID NO: 17138 - protein, 11 aa, Artificial Sequence
  Description of Artificial Sequence: Synthetic peptide
  XENP018171 vlCDR1
RASQSVSNDVA

SEQ ID NO: 17139 - protein, 7 aa, Artificial Sequence
  Description of Artificial Sequence: Synthetic peptide
  XENP018171 vlCDR2
YASHRYT

SEQ ID NO: 17140 - protein, 9 aa, Artificial Sequence
  Description of Artificial Sequence: Synthetic peptide
  XENP018171 vlCDR3
QQDYSSPRT

SEQ ID NO: 17141 - protein, 451 aa, Artificial Sequence
  Description of Artificial Sequence: Synthetic polypeptide
  XENP018172 1G6_H1.75_L1_IgG1_PVA_/S267K Heavy Chain
EVQLVESGGGLVKPGGSLRLSCAASGFTFSNYWMNWVRQAPGKGLEWVGEIRFKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 17142 - protein, 122 aa, Artificial Sequence; identical to SEQ ID NO: 11702
  Description of Artificial Sequence: Synthetic polypeptide
  VH of XENP018172

SEQ ID NO: 17143 - protein, 5 aa, Artificial Sequence
  Description of Artificial Sequence: Synthetic peptide
  XENP018172 vhCDR1
NYWMN

SEQ ID NO: 17144 - protein, 19 aa, Artificial Sequence
  Description of Artificial Sequence: Synthetic peptide
  XENP018172 vhCDR2
EIRFKSNNYATHYAEPVKG

SEQ ID NO: 17145 - protein, 11 aa, Artificial Sequence
  Description of Artificial Sequence: Synthetic peptide
  XENP018172 vhCDR3
YYGNYGGYFDV

SEQ ID NO: 17146 - protein, 214 aa, Artificial Sequence; identical to SEQ ID NO: 16226
  Description of Artificial Sequence: Synthetic polypeptide
  XENP018172 1G6_H1.75_L1_IgG1_PVA_/S267K Light Chain

SEQ ID NO: 17147 - protein, 107 aa, Artificial Sequence; identical to SEQ ID NO: 10923
  Description of Artificial Sequence: Synthetic polypeptide
  VL of XENP018172

SEQ ID NO: 17148 - protein, 11 aa, Artificial Sequence
  Description of Artificial Sequence: Synthetic peptide
  XENP018172 vlCDR1
RASQSVSNDVA

SEQ ID NO: 17149 - protein, 7 aa, Artificial Sequence
  Description of Artificial Sequence: Synthetic peptide
  XENP018172 vlCDR2
YASHRYT

SEQ ID NO: 17150 - protein, 9 aa, Artificial Sequence
  Description of Artificial Sequence: Synthetic peptide
  XENP018172 vlCDR3
QQDYSSPRT

SEQ ID NO: 17151 - protein, 451 aa, Artificial Sequence
  Description of Artificial Sequence: Synthetic polypeptide
  XENP018173 1G6_H1.76_L1_IgG1_PVA_/S267K Heavy Chain
EVQLVESGGGLVKPGGSLRLSCAASGFTFSNYWMNWVRQAPGKGLEWVGEIRVKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 17152 - protein, 122 aa, Artificial Sequence; identical to SEQ ID NO: 11711
  Description of Artificial Sequence: Synthetic polypeptide
  VH of XENP018173

SEQ ID NO: 17153 - protein, 5 aa, Artificial Sequence
  Description of Artificial Sequence: Synthetic peptide
  XENP018173 vhCDR1
NYWMN

SEQ ID NO: 17154 - protein, 19 aa, Artificial Sequence
  Description of Artificial Sequence: Synthetic peptide
  XENP018173 vhCDR2
EIRVKSNNYATHYAEPVKG

SEQ ID NO: 17155 - protein, 11 aa, Artificial Sequence
  Description of Artificial Sequence: Synthetic peptide
  XENP018173 vhCDR3
YYGNYGGYFDV

SEQ ID NO: 17156 - protein, 214 aa, Artificial Sequence; identical to SEQ ID NO: 16226
  Description of Artificial Sequence: Synthetic polypeptide
  XENP018173 1G6_H1.76_L1_IgG1_PVA_/S267K Light Chain

SEQ ID NO: 17157 - protein, 107 aa, Artificial Sequence; identical to SEQ ID NO: 10923
  Description of Artificial Sequence: Synthetic polypeptide
  VL of XENP018173

SEQ ID NO: 17158 - protein, 11 aa, Artificial Sequence
  Description of Artificial Sequence: Synthetic peptide
  XENP018173 vlCDR1
RASQSVSNDVA

SEQ ID NO: 17159 - protein, 7 aa, Artificial Sequence
  Description of Artificial Sequence: Synthetic peptide
  XENP018173 vlCDR2
YASHRYT

SEQ ID NO: 17160 - protein, 9 aa, Artificial Sequence
  Description of Artificial Sequence: Synthetic peptide
  XENP018173 vlCDR3
QQDYSSPRT

SEQ ID NO: 17161 - protein, 451 aa, Artificial Sequence
  Description of Artificial Sequence: Synthetic polypeptide
  XENP018174 1G6_H1.77_L1_IgG1_PVA_/S267K Heavy Chain
EVQLVESGGGLVKPGGSLRLSCAASGFTFSNYWMNWVRQAPGKGLEWVGEIRYKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 17162 - protein, 122 aa, Artificial Sequence; identical to SEQ ID NO: 11720
  Description of Artificial Sequence: Synthetic polypeptide
  VH of XENP018174

SEQ ID NO: 17163 - protein, 5 aa, Artificial Sequence
  Description of Artificial Sequence: Synthetic peptide
  XENP018174 vhCDR1
NYWMN

SEQ ID NO: 17164 - protein, 19 aa, Artificial Sequence
  Description of Artificial Sequence: Synthetic peptide
  XENP018174 vhCDR2
EIRYKSNNYATHYAEPVKG

SEQ ID NO: 17165 - protein, 11 aa, Artificial Sequence
  Description of Artificial Sequence: Synthetic peptide
  XENP018174 vhCDR3
YYGNYGGYFDV

SEQ ID NO: 17166 - protein, 214 aa, Artificial Sequence; identical to SEQ ID NO: 16226
  Description of Artificial Sequence: Synthetic polypeptide
  XENP018174 1G6_H1.77_L1_IgG1_PVA_/S267K Light Chain

SEQ ID NO: 17167 - protein, 107 aa, Artificial Sequence; identical to SEQ ID NO: 10923
  Description of Artificial Sequence: Synthetic polypeptide
  VL of XENP018174

SEQ ID NO: 17168 - protein, 11 aa, Artificial Sequence
  Description of Artificial Sequence: Synthetic peptide
  XENP018174 vlCDR1
RASQSVSNDVA

SEQ ID NO: 17169 - protein, 7 aa, Artificial Sequence
  Description of Artificial Sequence: Synthetic peptide
  XENP018174 vlCDR2
YASHRYT

SEQ ID NO: 17170 - protein, 9 aa, Artificial Sequence
  Description of Artificial Sequence: Synthetic peptide
  XENP018174 vlCDR3
QQDYSSPRT

SEQ ID NO: 17171 - protein, 451 aa, Artificial Sequence
  Description of Artificial Sequence: Synthetic polypeptide
  XENP018175 1G6_H1.78_L1_IgG1_PVA_/S267K Heavy Chain
EVQLVESGGGLVKPGGSLRLSCAASGFTFSNYWMNWVRQAPGKGLEWVGEIRWKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 17172 - protein, 122 aa, Artificial Sequence; identical to SEQ ID NO: 11729
  Description of Artificial Sequence: Synthetic polypeptide
  VH of XENP018175

SEQ ID NO: 17173 - protein, 5 aa, Artificial Sequence
  Description of Artificial Sequence: Synthetic peptide
  XENP018175 vhCDR1
NYWMN

SEQ ID NO: 17174 - protein, 19 aa, Artificial Sequence
  Description of Artificial Sequence: Synthetic peptide
  XENP018175 vhCDR2
EIRWKSNNYATHYAEPVKG

SEQ ID NO: 17175 - protein, 11 aa, Artificial Sequence
  Description of Artificial Sequence: Synthetic peptide
  XENP018175 vhCDR3
YYGNYGGYFDV

SEQ ID NO: 17176 - protein, 214 aa, Artificial Sequence; identical to SEQ ID NO: 16226
  Description of Artificial Sequence: Synthetic polypeptide
  XENP018175 1G6_H1.78_L1_IgG1_PVA_/S267K Light Chain

SEQ ID NO: 17177 - protein, 107 aa, Artificial Sequence; identical to SEQ ID NO: 10923
  Description of Artificial Sequence: Synthetic polypeptide
  VL of XENP018175

SEQ ID NO: 17178 - protein, 11 aa, Artificial Sequence
  Description of Artificial Sequence: Synthetic peptide
  XENP018175 vlCDR1
RASQSVSNDVA

SEQ ID NO: 17179 - protein, 7 aa, Artificial Sequence
  Description of Artificial Sequence: Synthetic peptide
  XENP018175 vlCDR2
YASHRYT

SEQ ID NO: 17180 - protein, 9 aa, Artificial Sequence
  Description of Artificial Sequence: Synthetic peptide
  XENP018175 vlCDR3
QQDYSSPRT

SEQ ID NO: 17181 - protein, 451 aa, Artificial Sequence
  Description of Artificial Sequence: Synthetic polypeptide
  XENP018176 1G6_H1.79_L1_IgG1_PVA_/S267K Heavy Chain
EVQLVESGGGLVKPGGSLRLSCAASGFTFSNYWMNWVRQAPGKGLEWVGEIRDKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 17182 - protein, 122 aa, Artificial Sequence; identical to SEQ ID NO: 11738
  Description of Artificial Sequence: Synthetic polypeptide
  VH of XENP018176

SEQ ID NO: 17183 - protein, 5 aa, Artificial Sequence
  Description of Artificial Sequence: Synthetic peptide
  XENP018176 vhCDR1
NYWMN

SEQ ID NO: 17184 - protein, 19 aa, Artificial Sequence
  Description of Artificial Sequence: Synthetic peptide
  XENP018176 vhCDR2
EIRDKSNNYATHYAEPVKG

SEQ ID NO: 17185 - protein, 11 aa, Artificial Sequence
  Description of Artificial Sequence: Synthetic peptide
  XENP018176 vhCDR3
YYGNYGGYFDV

SEQ ID NO: 17186 - protein, 214 aa, Artificial Sequence; identical to SEQ ID NO: 16226
  Description of Artificial Sequence: Synthetic polypeptide
  XENP018176 1G6_H1.79_L1_IgG1_PVA_/S267K Light Chain

SEQ ID NO: 17187 - protein, 107 aa, Artificial Sequence; identical to SEQ ID NO: 10923
  Description of Artificial Sequence: Synthetic polypeptide
  VL of XENP018176

SEQ ID NO: 17188 - protein, 11 aa, Artificial Sequence
  Description of Artificial Sequence: Synthetic peptide
  XENP018176 vlCDR1
RASQSVSNDVA

SEQ ID NO: 17189 - protein, 7 aa, Artificial Sequence
  Description of Artificial Sequence: Synthetic peptide
  XENP018176 vlCDR2
YASHRYT

SEQ ID NO: 17190 - protein, 9 aa, Artificial Sequence
  Description of Artificial Sequence: Synthetic peptide
  XENP018176 vlCDR3
QQDYSSPRT

SEQ ID NO: 17191 - protein, 451 aa, Artificial Sequence
  Description of Artificial Sequence: Synthetic polypeptide
  XENP018177 1G6_H1.80_L1_IgG1_PVA_/S267K Heavy Chain
EVQLVESGGGLVKPGGSLRLSCAASGFTFSNYWMNWVRQAPGKGLEWVGEIRAKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 17192 - protein, 122 aa, Artificial Sequence; identical to SEQ ID NO: 11747
  Description of Artificial Sequence: Synthetic polypeptide
  VH of XENP018177

SEQ ID NO: 17193 - protein, 5 aa, Artificial Sequence
  Description of Artificial Sequence: Synthetic peptide
  XENP018177 vhCDR1
NYWMN

SEQ ID NO: 17194 - protein, 19 aa, Artificial Sequence
  Description of Artificial Sequence: Synthetic peptide
  XENP018177 vhCDR2
EIRAKSNNYATHYAEPVKG

SEQ ID NO: 17195 - protein, 11 aa, Artificial Sequence
  Description of Artificial Sequence: Synthetic peptide
  XENP018177 vhCDR3
YYGNYGGYFDV

SEQ ID NO: 17196 - protein, 214 aa, Artificial Sequence; identical to SEQ ID NO: 16226
  Description of Artificial Sequence: Synthetic polypeptide
  XENP018177 1G6_H1.80_L1_IgG1_PVA_/S267K Light Chain

SEQ ID NO: 17197 - protein, 107 aa, Artificial Sequence; identical to SEQ ID NO: 10923
  Description of Artificial Sequence: Synthetic polypeptide
  VL of XENP018177

SEQ ID NO: 17198 - protein, 11 aa, Artificial Sequence
  Description of Artificial Sequence: Synthetic peptide
  XENP018177 vlCDR1
RASQSVSNDVA

SEQ ID NO: 17199 - protein, 7 aa, Artificial Sequence
  Description of Artificial Sequence: Synthetic peptide
  XENP018177 vlCDR2
YASHRYT

SEQ ID NO: 17200 - protein, 9 aa, Artificial Sequence
  Description of Artificial Sequence: Synthetic peptide
  XENP018177 vlCDR3
QQDYSSPRT

SEQ ID NO: 17201 - protein, 451 aa, Artificial Sequence
  Description of Artificial Sequence: Synthetic polypeptide
  XENP018178 1G6_H1.81_L1_IgG1_PVA_/S267K Heavy Chain
EVQLVESGGGLVKPGGSLRLSCAASGFTFSNYWMNWVRQAPGKGLEWVGEIRQKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 17202 - protein, 122 aa, Artificial Sequence; identical to SEQ ID NO: 11756
  Description of Artificial Sequence: Synthetic polypeptide
  VH of XENP018178

SEQ ID NO: 17203 - protein, 5 aa, Artificial Sequence
  Description of Artificial Sequence: Synthetic peptide
  XENP018178 vhCDR1
NYWMN

SEQ ID NO: 17204 - protein, 19 aa, Artificial Sequence
  Description of Artificial Sequence: Synthetic peptide
  XENP018178 vhCDR2
EIRQKSNNYATHYAEPVKG

SEQ ID NO: 17205 - protein, 11 aa, Artificial Sequence
  Description of Artificial Sequence: Synthetic peptide
  XENP018178 vhCDR3
YYGNYGGYFDV

SEQ ID NO: 17206 - protein, 214 aa, Artificial Sequence; identical to SEQ ID NO: 16226
  Description of Artificial Sequence: Synthetic polypeptide
  XENP018178 1G6_H1.81_L1_IgG1_PVA_/S267K Light Chain

SEQ ID NO: 17207 - protein, 107 aa, Artificial Sequence; identical to SEQ ID NO: 10923
  Description of Artificial Sequence: Synthetic polypeptide
  VL of XENP018178

SEQ ID NO: 17208 - protein, 11 aa, Artificial Sequence
  Description of Artificial Sequence: Synthetic peptide
  XENP018178 vlCDR1
RASQSVSNDVA

SEQ ID NO: 17209 - protein, 7 aa, Artificial Sequence
  Description of Artificial Sequence: Synthetic peptide
  XENP018178 vlCDR2
YASHRYT

SEQ ID NO: 17210 - protein, 9 aa, Artificial Sequence
  Description of Artificial Sequence: Synthetic peptide
  XENP018178 vlCDR3
QQDYSSPRT

SEQ ID NO: 17211 - protein, 451 aa, Artificial Sequence
  Description of Artificial Sequence: Synthetic polypeptide
  XENP018179 1G6_H1.82_L1_IgG1_PVA_/S267K Heavy Chain
EVQLVESGGGLVKPGGSLRLSCAASGFTFSNYWMNWVRQAPGKGLEWVGEIRKKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 17212 - protein, 122 aa, Artificial Sequence; identical to SEQ ID NO: 11765
  Description of Artificial Sequence: Synthetic polypeptide
  VH of XENP018179

SEQ ID NO: 17213 - protein, 5 aa, Artificial Sequence
  Description of Artificial Sequence: Synthetic peptide
  XENP018179 vhCDR1
NYWMN

SEQ ID NO: 17214 - protein, 19 aa, Artificial Sequence
  Description of Artificial Sequence: Synthetic peptide
  XENP018179 vhCDR2
EIRKKSNNYATHYAEPVKG

SEQ ID NO: 17215 - protein, 11 aa, Artificial Sequence
  Description of Artificial Sequence: Synthetic peptide
  XENP018179 vhCDR3
YYGNYGGYFDV

SEQ ID NO: 17216 - protein, 214 aa, Artificial Sequence; identical to SEQ ID NO: 16226
  Description of Artificial Sequence: Synthetic polypeptide
  XENP018179 1G6_H1.82_L1_IgG1_PVA_/S267K Light Chain

SEQ ID NO: 17217 - protein, 107 aa, Artificial Sequence; identical to SEQ ID NO: 10923
  Description of Artificial Sequence: Synthetic polypeptide
  VL of XENP018179

SEQ ID NO: 17218 - protein, 11 aa, Artificial Sequence
  Description of Artificial Sequence: Synthetic peptide
  XENP018179 vlCDR1
RASQSVSNDVA

SEQ ID NO: 17219 - protein, 7 aa, Artificial Sequence
  Description of Artificial Sequence: Synthetic peptide
  XENP018179 vlCDR2
YASHRYT

SEQ ID NO: 17220 - protein, 9 aa, Artificial Sequence
  Description of Artificial Sequence: Synthetic peptide
  XENP018179 vlCDR3
QQDYSSPRT

SEQ ID NO: 17221 - protein, 451 aa, Artificial Sequence
  Description of Artificial Sequence: Synthetic polypeptide
  XENP018180 1G6_H1.83_L1_IgG1_PVA_/S267K Heavy Chain
EVQLVESGGGLVKPGGSLRLSCAASGFTFSNYWMNWVRQAPGKGLEWVGEIRLRSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 17222 - protein, 122 aa, Artificial Sequence; identical to SEQ ID NO: 11774
  Description of Artificial Sequence: Synthetic polypeptide
  VH of XENP018180

SEQ ID NO: 17223 - protein, 5 aa, Artificial Sequence
  Description of Artificial Sequence: Synthetic peptide
  XENP018180 vhCDR1
NYWMN

SEQ ID NO: 17224 - protein, 19 aa, Artificial Sequence
  Description of Artificial Sequence: Synthetic peptide
  XENP018180 vhCDR2
EIRLRSNNYATHYAEPVKG

SEQ ID NO: 17225 - protein, 11 aa, Artificial Sequence
  Description of Artificial Sequence: Synthetic peptide
  XENP018180 vhCDR3
YYGNYGGYFDV

SEQ ID NO: 17226 - protein, 214 aa, Artificial Sequence; identical to SEQ ID NO: 16226
  Description of Artificial Sequence: Synthetic polypeptide
  XENP018180 1G6_H1.83_L1_IgG1_PVA_/S267K Light Chain

SEQ ID NO: 17227 - protein, 107 aa, Artificial Sequence; identical to SEQ ID NO: 10923
  Description of Artificial Sequence: Synthetic polypeptide
  VL of XENP018180

SEQ ID NO: 17228 - protein, 11 aa, Artificial Sequence
  Description of Artificial Sequence: Synthetic peptide
  XENP018180 vlCDR1
RASQSVSNDVA

SEQ ID NO: 17229 - protein, 7 aa, Artificial Sequence
  Description of Artificial Sequence: Synthetic peptide
  XENP018180 vlCDR2
YASHRYT

SEQ ID NO: 17230 - protein, 9 aa, Artificial Sequence
  Description of Artificial Sequence: Synthetic peptide
  XENP018180 vlCDR3
QQDYSSPRT

SEQ ID NO: 17231 - protein, 451 aa, Artificial Sequence
  Description of Artificial Sequence: Synthetic polypeptide
  XENP018181 1G6_H1.84_L1_IgG1_PVA_/S267K Heavy Chain
EVQLVESGGGLVKPGGSLRLSCAASGFTFSNYWMNWVRQAPGKGLEWVGEIRLESNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 17232 - protein, 122 aa, Artificial Sequence; identical to SEQ ID NO: 11783
  Description of Artificial Sequence: Synthetic polypeptide
  VH of XENP018181

SEQ ID NO: 17233 - protein, 5 aa, Artificial Sequence
  Description of Artificial Sequence: Synthetic peptide
  XENP018181 vhCDR1
NYWMN

SEQ ID NO: 17234 - protein, 19 aa, Artificial Sequence
  Description of Artificial Sequence: Synthetic peptide
  XENP018181 vhCDR2
EIRLESNNYATHYAEPVKG

SEQ ID NO: 17235 - protein, 11 aa, Artificial Sequence
  Description of Artificial Sequence: Synthetic peptide
  XENP018181 vhCDR3
YYGNYGGYFDV

SEQ ID NO: 17236 - protein, 214 aa, Artificial Sequence; identical to SEQ ID NO: 16226
  Description of Artificial Sequence: Synthetic polypeptide
  XENP018181 1G6_H1.84_L1_IgG1_PVA_/S267K Light Chain

SEQ ID NO: 17237 - protein, 107 aa, Artificial Sequence; identical to SEQ ID NO: 10923
  Description of Artificial Sequence: Synthetic polypeptide
  VL of XENP018181

SEQ ID NO: 17238 - protein, 11 aa, Artificial Sequence
  Description of Artificial Sequence: Synthetic peptide
  XENP018181 vlCDR1
RASQSVSNDVA

SEQ ID NO: 17239 - protein, 7 aa, Artificial Sequence
  Description of Artificial Sequence: Synthetic peptide
  XENP018181 vlCDR2
YASHRYT

SEQ ID NO: 17240 - protein, 9 aa, Artificial Sequence
  Description of Artificial Sequence: Synthetic peptide
  XENP018181 vlCDR3
QQDYSSPRT

SEQ ID NO: 17241 - protein, 451 aa, Artificial Sequence
  Description of Artificial Sequence: Synthetic polypeptide
  XENP018182 1G6_H1.85_L1_IgG1_PVA_/S267K Heavy Chain
EVQLVESGGGLVKPGGSLRLSCAASGFTFSNYWMNWVRQAPGKGLEWVGEIRLHSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 17242 - protein, 122 aa, Artificial Sequence; identical to SEQ ID NO: 11792
  Description of Artificial Sequence: Synthetic polypeptide
  VH of XENP018182

SEQ ID NO: 17243 - protein, 5 aa, Artificial Sequence
  Description of Artificial Sequence: Synthetic peptide
  XENP018182 vhCDR1
NYWMN

SEQ ID NO: 17244 - protein, 19 aa, Artificial Sequence
  Description of Artificial Sequence: Synthetic peptide
  XENP018182 vhCDR2
EIRLHSNNYATHYAEPVKG

SEQ ID NO: 17245 - protein, 11 aa, Artificial Sequence
  Description of Artificial Sequence: Synthetic peptide
  XENP018182 vhCDR3
YYGNYGGYFDV

SEQ ID NO: 17246 - protein, 214 aa, Artificial Sequence; identical to SEQ ID NO: 16226
  Description of Artificial Sequence: Synthetic polypeptide
  XENP018182 1G6_H1.85_L1_IgG1_PVA_/S267K Light Chain

SEQ ID NO: 17247 - protein, 107 aa, Artificial Sequence; identical to SEQ ID NO: 10923
  Description of Artificial Sequence: Synthetic polypeptide
  VL of XENP018182

SEQ ID NO: 17248 - protein, 11 aa, Artificial Sequence
  Description of Artificial Sequence: Synthetic peptide
  XENP018182 vlCDR1
RASQSVSNDVA

SEQ ID NO: 17249 - protein, 7 aa, Artificial Sequence
  Description of Artificial Sequence: Synthetic peptide
  XENP018182 vlCDR2
YASHRYT

SEQ ID NO: 17250 - protein, 9 aa, Artificial Sequence
  Description of Artificial Sequence: Synthetic peptide
  XENP018182 vlCDR3
QQDYSSPRT

SEQ ID NO: 17251 - protein, 451 aa, Artificial Sequence
  Description of Artificial Sequence: Synthetic polypeptide
  XENP018183 1G6_H1.86_L1_IgG1_PVA_/S267K Heavy Chain
EVQLVESGGGLVKPGGSLRLSCAASGFTFSNYWMNWVRQAPGKGLEWVGEIRLSSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 17252 - protein, 122 aa, Artificial Sequence; identical to SEQ ID NO: 11801
  Description of Artificial Sequence: Synthetic polypeptide
  VH of XENP018183

SEQ ID NO: 17253 - protein, 5 aa, Artificial Sequence
  Description of Artificial Sequence: Synthetic peptide
  XENP018183 vhCDR1
NYWMN

SEQ ID NO: 17254 - protein, 19 aa, Artificial Sequence
  Description of Artificial Sequence: Synthetic peptide
  XENP018183 vhCDR2
EIRLSSNNYATHYAEPVKG

SEQ ID NO: 17255 - protein, 11 aa, Artificial Sequence
  Description of Artificial Sequence: Synthetic peptide
  XENP018183 vhCDR3
YYGNYGGYFDV

SEQ ID NO: 17256 - protein, 214 aa, Artificial Sequence; identical to SEQ ID NO: 16226
  Description of Artificial Sequence: Synthetic polypeptide
  XENP018183 1G6_H1.86_L1_IgG1_PVA_/S267K Light Chain

SEQ ID NO: 17257 - protein, 107 aa, Artificial Sequence; identical to SEQ ID NO: 10923
  Description of Artificial Sequence: Synthetic polypeptide
  VL of XENP018183

SEQ ID NO: 17258 - protein, 11 aa, Artificial Sequence
  Description of Artificial Sequence: Synthetic peptide
  XENP018183 vlCDR1
RASQSVSNDVA

SEQ ID NO: 17259 - protein, 7 aa, Artificial Sequence
  Description of Artificial Sequence: Synthetic peptide
  XENP018183 vlCDR2
YASHRYT

SEQ ID NO: 17260 - protein, 9 aa, Artificial Sequence
  Description of Artificial Sequence: Synthetic peptide
  XENP018183 vlCDR3
QQDYSSPRT

SEQ ID NO: 17261 - protein, 451 aa, Artificial Sequence
  Description of Artificial Sequence: Synthetic polypeptide
  XENP018184 1G6_H1.87_L1_IgG1_PVA_/S267K Heavy Chain
EVQLVESGGGLVKPGGSLRLSCAASGFTFSNYWMNWVRQAPGKGLEWVGEIRLDSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 17262 - protein, 122 aa, Artificial Sequence; identical to SEQ ID NO: 11810
  Description of Artificial Sequence: Synthetic polypeptide
  VH of XENP018184

SEQ ID NO: 17263 - protein, 5 aa, Artificial Sequence
  Description of Artificial Sequence: Synthetic peptide
  XENP018184 vhCDR1
NYWMN

SEQ ID NO: 17264 - protein, 19 aa, Artificial Sequence
  Description of Artificial Sequence: Synthetic peptide
  XENP018184 vhCDR2
EIRLDSNNYATHYAEPVKG

SEQ ID NO: 17265 - protein, 11 aa, Artificial Sequence
  Description of Artificial Sequence: Synthetic peptide
  XENP018184 vhCDR3
YYGNYGGYFDV

SEQ ID NO: 17266 - protein, 214 aa, Artificial Sequence; identical to SEQ ID NO: 16226
  Description of Artificial Sequence: Synthetic polypeptide
  XENP018184 1G6_H1.87_L1_IgG1_PVA_/S267K Light Chain

SEQ ID NO: 17267 - protein, 107 aa, Artificial Sequence; identical to SEQ ID NO: 10923
  Description of Artificial Sequence: Synthetic polypeptide
  VL of XENP018184

SEQ ID NO: 17268 - protein, 11 aa, Artificial Sequence
  Description of Artificial Sequence: Synthetic peptide
  XENP018184 vlCDR1
RASQSVSNDVA

SEQ ID NO: 17269 - protein, 7 aa, Artificial Sequence
  Description of Artificial Sequence: Synthetic peptide
  XENP018184 vlCDR2
YASHRYT

SEQ ID NO: 17270 - protein, 9 aa, Artificial Sequence
  Description of Artificial Sequence: Synthetic peptide
  XENP018184 vlCDR3
QQDYSSPRT

SEQ ID NO: 17271 - protein, 451 aa, Artificial Sequence
  Description of Artificial Sequence: Synthetic polypeptide
  XENP018185 1G6_H1.88_L1_IgG1_PVA_/S267K Heavy Chain
EVQLVESGGGLVKPGGSLRLSCAASGFTFSNYWMNWVRQAPGKGLEWVGEIRLASNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 17272 - protein, 122 aa, Artificial Sequence; identical to SEQ ID NO: 11819
  Description of Artificial Sequence: Synthetic polypeptide
  VH of XENP018185

SEQ ID NO: 17273 - protein, 5 aa, Artificial Sequence
  Description of Artificial Sequence: Synthetic peptide
  XENP018185 vhCDR1
NYWMN

SEQ ID NO: 17274 - protein, 19 aa, Artificial Sequence
  Description of Artificial Sequence: Synthetic peptide
  XENP018185 vhCDR2
EIRLASNNYATHYAEPVKG

SEQ ID NO: 17275 - protein, 11 aa, Artificial Sequence
  Description of Artificial Sequence: Synthetic peptide
  XENP018185 vhCDR3
YYGNYGGYFDV

SEQ ID NO: 17276 - protein, 214 aa, Artificial Sequence; identical to SEQ ID NO: 16226
  Description of Artificial Sequence: Synthetic polypeptide
  XENP018185 1G6_H1.88_L1_IgG1_PVA_/S267K Light Chain

SEQ ID NO: 17277 - protein, 107 aa, Artificial Sequence; identical to SEQ ID NO: 10923
  Description of Artificial Sequence: Synthetic polypeptide
  VL of XENP018185

SEQ ID NO: 17278 - protein, 11 aa, Artificial Sequence
  Description of Artificial Sequence: Synthetic peptide
  XENP018185 vlCDR1
RASQSVSNDVA

SEQ ID NO: 17279 - protein, 7 aa, Artificial Sequence
  Description of Artificial Sequence: Synthetic peptide
  XENP018185 vlCDR2
YASHRYT

SEQ ID NO: 17280 - protein, 9 aa, Artificial Sequence
  Description of Artificial Sequence: Synthetic peptide
  XENP018185 vlCDR3
QQDYSSPRT

SEQ ID NO: 17281 - protein, 451 aa, Artificial Sequence
  Description of Artificial Sequence: Synthetic polypeptide
  XENP018186 1G6_H1.89_L1_IgG1_PVA_/S267K Heavy Chain
EVQLVESGGGLVKPGGSLRLSCAASGFTFSNYWMNWVRQAPGKGLEWVGEIRLGSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 17282 - protein, 122 aa, Artificial Sequence; identical to SEQ ID NO: 11828
  Description of Artificial Sequence: Synthetic polypeptide
  VH of XENP018186

SEQ ID NO: 17283 - protein, 5 aa, Artificial Sequence
  Description of Artificial Sequence: Synthetic peptide
  XENP018186 vhCDR1
NYWMN

SEQ ID NO: 17284 - protein, 19 aa, Artificial Sequence
  Description of Artificial Sequence: Synthetic peptide
  XENP018186 vhCDR2
EIRLGSNNYATHYAEPVKG

SEQ ID NO: 17285 - protein, 11 aa, Artificial Sequence
  Description of Artificial Sequence: Synthetic peptide
  XENP018186 vhCDR3
YYGNYGGYFDV

SEQ ID NO: 17286 - protein, 214 aa, Artificial Sequence; identical to SEQ ID NO: 16226
  Description of Artificial Sequence: Synthetic polypeptide
  XENP018186 1G6_H1.89_L1_IgG1_PVA_/S267K Light Chain

SEQ ID NO: 17287 - protein, 107 aa, Artificial Sequence; identical to SEQ ID NO: 10923
  Description of Artificial Sequence: Synthetic polypeptide
  VL of XENP018186

SEQ ID NO: 17288 - protein, 11 aa, Artificial Sequence
  Description of Artificial Sequence: Synthetic peptide
  XENP018186 vlCDR1
RASQSVSNDVA

SEQ ID NO: 17289 - protein, 7 aa, Artificial Sequence
  Description of Artificial Sequence: Synthetic peptide
  XENP018186 vlCDR2
YASHRYT

SEQ ID NO: 17290 - protein, 9 aa, Artificial Sequence
  Description of Artificial Sequence: Synthetic peptide
  XENP018186 vlCDR3
QQDYSSPRT

SEQ ID NO: 17291 - protein, 451 aa, Artificial Sequence
  Description of Artificial Sequence: Synthetic polypeptide
  XENP018187 1G6_H1.90_L1_IgG1_PVA_/S267K Heavy Chain
EVQLVESGGGLVKPGGSLRLSCAASGFTFSNYWMNWVRQAPGKGLEWVGEIRLYSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 17292 - protein, 122 aa, Artificial Sequence; identical to SEQ ID NO: 11837
  Description of Artificial Sequence: Synthetic polypeptide
  VH of XENP018187

SEQ ID NO: 17293 - protein, 5 aa, Artificial Sequence
  Description of Artificial Sequence: Synthetic peptide
  XENP018187 vhCDR1
NYWMN

SEQ ID NO: 17294 - protein, 19 aa, Artificial Sequence
  Description of Artificial Sequence: Synthetic peptide
  XENP018187 vhCDR2
EIRLYSNNYATHYAEPVKG

SEQ ID NO: 17295 - protein, 11 aa, Artificial Sequence
  Description of Artificial Sequence: Synthetic peptide
  XENP018187 vhCDR3
YYGNYGGYFDV

SEQ ID NO: 17296 - protein, 214 aa, Artificial Sequence; identical to SEQ ID NO: 16226
  Description of Artificial Sequence: Synthetic polypeptide
  XENP018187 1G6_H1.90_L1_IgG1_PVA_/S267K Light Chain

SEQ ID NO: 17297 - protein, 107 aa, Artificial Sequence; identical to SEQ ID NO: 10923
  Description of Artificial Sequence: Synthetic polypeptide
  VL of XENP018187

SEQ ID NO: 17298 - protein, 11 aa, Artificial Sequence
  Description of Artificial Sequence: Synthetic peptide
  XENP018187 vlCDR1
RASQSVSNDVA

SEQ ID NO: 17299 - protein, 7 aa, Artificial Sequence
  Description of Artificial Sequence: Synthetic peptide
  XENP018187 vlCDR2
YASHRYT

SEQ ID NO: 17300 - protein, 9 aa, Artificial Sequence
  Description of Artificial Sequence: Synthetic peptide
  XENP018187 vlCDR3
QQDYSSPRT

SEQ ID NO: 17301 - protein, 451 aa, Artificial Sequence
  Description of Artificial Sequence: Synthetic polypeptide
  XENP018188 1G6_H1.91_L1_IgG1_PVA_/S267K Heavy Chain
EVQLVESGGGLVKPGGSLRLSCAASGFTFSNYWMNWVRQAPGKGLEWVGEIRLISNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 17302 - protein, 122 aa, Artificial Sequence; identical to SEQ ID NO: 11846
  Description of Artificial Sequence: Synthetic polypeptide
  VH of XENP018188

SEQ ID NO: 17303 - protein, 5 aa, Artificial Sequence
  Description of Artificial Sequence: Synthetic peptide
  XENP018188 vhCDR1
NYWMN

SEQ ID NO: 17304 - protein, 19 aa, Artificial Sequence
  Description of Artificial Sequence: Synthetic peptide
  XENP018188 vhCDR2
EIRLISNNYATHYAEPVKG

SEQ ID NO: 17305 - protein, 11 aa, Artificial Sequence
  Description of Artificial Sequence: Synthetic peptide
  XENP018188 vhCDR3
YYGNYGGYFDV

SEQ ID NO: 17306 - protein, 214 aa, Artificial Sequence; identical to SEQ ID NO: 16226
  Description of Artificial Sequence: Synthetic polypeptide
  XENP018188 1G6_H1.91_L1_IgG1_PVA_/S267K Light Chain

SEQ ID NO: 17307 - protein, 107 aa, Artificial Sequence; identical to SEQ ID NO: 10923
  Description of Artificial Sequence: Synthetic polypeptide
  VL of XENP018188

SEQ ID NO: 17308 - protein, 11 aa, Artificial Sequence
  Description of Artificial Sequence: Synthetic peptide
  XENP018188 vlCDR1
RASQSVSNDVA

SEQ ID NO: 17309 - protein, 7 aa, Artificial Sequence
  Description of Artificial Sequence: Synthetic peptide
  XENP018188 vlCDR2
YASHRYT

SEQ ID NO: 17310 - protein, 9 aa, Artificial Sequence
  Description of Artificial Sequence: Synthetic peptide
  XENP018188 vlCDR3
QQDYSSPRT

SEQ ID NO: 17311 - protein, 451 aa, Artificial Sequence
  Description of Artificial Sequence: Synthetic polypeptide
  XENP018189 1G6_H1.92_L1_IgG1_PVA_/S267K Heavy Chain
EVQLVESGGGLVKPGGSLRLSCAASGFTFSNYWMNWVRQAPGKGLEWVGEIRLKTNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 17312 - protein, 122 aa, Artificial Sequence; identical to SEQ ID NO: 11855
  Description of Artificial Sequence: Synthetic polypeptide
  VH of XENP018189

SEQ ID NO: 17313 - protein, 5 aa, Artificial Sequence
  Description of Artificial Sequence: Synthetic peptide
  XENP018189 vhCDR1
NYWMN

SEQ ID NO: 17314 - protein, 19 aa, Artificial Sequence
  Description of Artificial Sequence: Synthetic peptide
  XENP018189 vhCDR2
EIRLKTNNYATHYAEPVKG

SEQ ID NO: 17315 - protein, 11 aa, Artificial Sequence
  Description of Artificial Sequence: Synthetic peptide
  XENP018189 vhCDR3
YYGNYGGYFDV

SEQ ID NO: 17316 - protein, 214 aa, Artificial Sequence; identical to SEQ ID NO: 16226
  Description of Artificial Sequence: Synthetic polypeptide
  XENP018189 1G6_H1.92_L1_IgG1_PVA_/S267K Light Chain

SEQ ID NO: 17317 - protein, 107 aa, Artificial Sequence; identical to SEQ ID NO: 10923
  Description of Artificial Sequence: Synthetic polypeptide
  VL of XENP018189

SEQ ID NO: 17318 - protein, 11 aa, Artificial Sequence
  Description of Artificial Sequence: Synthetic peptide
  XENP018189 vlCDR1
RASQSVSNDVA

SEQ ID NO: 17319 - protein, 7 aa, Artificial Sequence
  Description of Artificial Sequence: Synthetic peptide
  XENP018189 vlCDR2
YASHRYT

SEQ ID NO: 17320 - protein, 9 aa, Artificial Sequence
  Description of Artificial Sequence: Synthetic peptide
  XENP018189 vlCDR3
QQDYSSPRT

SEQ ID NO: 17321 - protein, 451 aa, Artificial Sequence
  Description of Artificial Sequence: Synthetic polypeptide
  XENP018190 1G6_H1.93_L1_IgG1_PVA_/S267K Heavy Chain
EVQLVESGGGLVKPGGSLRLSCAASGFTFSNYWMNWVRQAPGKGLEWVGEIRLKANNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 17322 - protein, 122 aa, Artificial Sequence; identical to SEQ ID NO: 11864
  Description of Artificial Sequence: Synthetic polypeptide
  VH of XENP018190

SEQ ID NO: 17323 - protein, 5 aa, Artificial Sequence
  Description of Artificial Sequence: Synthetic peptide
  XENP018190 vhCDR1
NYWMN

SEQ ID NO: 17324 - protein, 19 aa, Artificial Sequence
  Description of Artificial Sequence: Synthetic peptide
  XENP018190 vhCDR2
EIRLKANNYATHYAEPVKG

SEQ ID NO: 17325 - protein, 11 aa, Artificial Sequence
  Description of Artificial Sequence: Synthetic peptide
  XENP018190 vhCDR3
YYGNYGGYFDV

SEQ ID NO: 17326 - protein, 214 aa, Artificial Sequence; identical to SEQ ID NO: 16226
  Description of Artificial Sequence: Synthetic polypeptide
  XENP018190 1G6_H1.93_L1_IgG1_PVA_/S267K Light Chain

SEQ ID NO: 17327 - protein, 107 aa, Artificial Sequence; identical to SEQ ID NO: 10923
  Description of Artificial Sequence: Synthetic polypeptide
  VL of XENP018190

SEQ ID NO: 17328 - protein, 11 aa, Artificial Sequence
  Description of Artificial Sequence: Synthetic peptide
  XENP018190 vlCDR1
RASQSVSNDVA

SEQ ID NO: 17329 - protein, 7 aa, Artificial Sequence
  Description of Artificial Sequence: Synthetic peptide
  XENP018190 vlCDR2
YASHRYT

SEQ ID NO: 17330 - protein, 9 aa, Artificial Sequence
  Description of Artificial Sequence: Synthetic peptide
  XENP018190 vlCDR3
QQDYSSPRT

SEQ ID NO: 17331 - protein, 451 aa, Artificial Sequence
  Description of Artificial Sequence: Synthetic polypeptide
  XENP018191 1G6_H1.94_L1_IgG1_PVA_/S267K Heavy Chain
EVQLVESGGGLVKPGGSLRLSCAASGFTFSNYWMNWVRQAPGKGLEWVGEIRLKQNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 17332 - protein, 122 aa, Artificial Sequence; identical to SEQ ID NO: 11873
  Description of Artificial Sequence: Synthetic polypeptide
  VH of XENP018191

SEQ ID NO: 17333 - protein, 5 aa, Artificial Sequence
  Description of Artificial Sequence: Synthetic peptide
  XENP018191 vhCDR1
NYWMN

SEQ ID NO: 17334 - protein, 19 aa, Artificial Sequence
  Description of Artificial Sequence: Synthetic peptide
  XENP018191 vhCDR2
EIRLKQNNYATHYAEPVKG

SEQ ID NO: 17335 - protein, 11 aa, Artificial Sequence
  Description of Artificial Sequence: Synthetic peptide
  XENP018191 vhCDR3
YYGNYGGYFDV

SEQ ID NO: 17336 - protein, 214 aa, Artificial Sequence; identical to SEQ ID NO: 16226
  Description of Artificial Sequence: Synthetic polypeptide
  XENP018191 1G6_H1.94_L1_IgG1_PVA_/S267K Light Chain

SEQ ID NO: 17337 - protein, 107 aa, Artificial Sequence; identical to SEQ ID NO: 10923
  Description of Artificial Sequence: Synthetic polypeptide
  VL of XENP018191

SEQ ID NO: 17338 - protein, 11 aa, Artificial Sequence
  Description of Artificial Sequence: Synthetic peptide
  XENP018191 vlCDR1
RASQSVSNDVA

SEQ ID NO: 17339 - protein, 7 aa, Artificial Sequence
  Description of Artificial Sequence: Synthetic peptide
  XENP018191 vlCDR2
YASHRYT

SEQ ID NO: 17340 - protein, 9 aa, Artificial Sequence
  Description of Artificial Sequence: Synthetic peptide
  XENP018191 vlCDR3
QQDYSSPRT

SEQ ID NO: 17341 - protein, 451 aa, Artificial Sequence
  Description of Artificial Sequence: Synthetic polypeptide
  XENP018192 1G6_H1.95_L1_IgG1_PVA_/S267K Heavy Chain
EVQLVESGGGLVKPGGSLRLSCAASGFTFSNYWMNWVRQAPGKGLEWVGEIRLKGNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 17342 - protein, 122 aa, Artificial Sequence; identical to SEQ ID NO: 11882
  Description of Artificial Sequence: Synthetic polypeptide
  VH of XENP018192

SEQ ID NO: 17343 - protein, 5 aa, Artificial Sequence
  Description of Artificial Sequence: Synthetic peptide
  XENP018192 vhCDR1
NYWMN

SEQ ID NO: 17344 - protein, 19 aa, Artificial Sequence
  Description of Artificial Sequence: Synthetic peptide
  XENP018192 vhCDR2
EIRLKGNNYATHYAEPVKG

SEQ ID NO: 17345 - protein, 11 aa, Artificial Sequence
  Description of Artificial Sequence: Synthetic peptide
  XENP018192 vhCDR3
YYGNYGGYFDV

SEQ ID NO: 17346 - protein, 214 aa, Artificial Sequence; identical to SEQ ID NO: 16226
  Description of Artificial Sequence: Synthetic polypeptide
  XENP018192 1G6_H1.95_L1_IgG1_PVA_/S267K Light Chain

SEQ ID NO: 17347 - protein, 107 aa, Artificial Sequence; identical to SEQ ID NO: 10923
  Description of Artificial Sequence: Synthetic polypeptide
  VL of XENP018192

SEQ ID NO: 17348 - protein, 11 aa, Artificial Sequence
  Description of Artificial Sequence: Synthetic peptide
  XENP018192 vlCDR1
RASQSVSNDVA

SEQ ID NO: 17349 - protein, 7 aa, Artificial Sequence
  Description of Artificial Sequence: Synthetic peptide
  XENP018192 vlCDR2
YASHRYT

SEQ ID NO: 17350 - protein, 9 aa, Artificial Sequence
  Description of Artificial Sequence: Synthetic peptide
  XENP018192 vlCDR3
QQDYSSPRT

SEQ ID NO: 17351 - protein, 451 aa, Artificial Sequence
  Description of Artificial Sequence: Synthetic polypeptide
  XENP018193 1G6_H1.96_L1_IgG1_PVA_/S267K Heavy Chain
EVQLVESGGGLVKPGGSLRLSCAASGFTFSNYWMNWVRQAPGKGLEWVGEIRLKVNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 17352 - protein, 122 aa, Artificial Sequence; identical to SEQ ID NO: 11891
  Description of Artificial Sequence: Synthetic polypeptide
  VH of XENP018193

SEQ ID NO: 17353 - protein, 5 aa, Artificial Sequence
  Description of Artificial Sequence: Synthetic peptide
  XENP018193 vhCDR1
NYWMN

SEQ ID NO: 17354 - protein, 19 aa, Artificial Sequence
  Description of Artificial Sequence: Synthetic peptide
  XENP018193 vhCDR2
EIRLKVNNYATHYAEPVKG

SEQ ID NO: 17355 - protein, 11 aa, Artificial Sequence
  Description of Artificial Sequence: Synthetic peptide
  XENP018193 vhCDR3
YYGNYGGYFDV

SEQ ID NO: 17356 - protein, 214 aa, Artificial Sequence; identical to SEQ ID NO: 16226
  Description of Artificial Sequence: Synthetic polypeptide
  XENP018193 1G6_H1.96_L1_IgG1_PVA_/S267K Light Chain

SEQ ID NO: 17357 - protein, 107 aa, Artificial Sequence; identical to SEQ ID NO: 10923
  Description of Artificial Sequence: Synthetic polypeptide
  VL of XENP018193

SEQ ID NO: 17358 - protein, 11 aa, Artificial Sequence
  Description of Artificial Sequence: Synthetic peptide
  XENP018193 vlCDR1
RASQSVSNDVA

SEQ ID NO: 17359 - protein, 7 aa, Artificial Sequence
  Description of Artificial Sequence: Synthetic peptide
  XENP018193 vlCDR2
YASHRYT

SEQ ID NO: 17360 - protein, 9 aa, Artificial Sequence
  Description of Artificial Sequence: Synthetic peptide
  XENP018193 vlCDR3
QQDYSSPRT

SEQ ID NO: 17361 - protein, 451 aa, Artificial Sequence
  Description of Artificial Sequence: Synthetic polypeptide
  XENP018194 1G6_H1.97_L1_IgG1_PVA_/S267K Heavy Chain
EVQLVESGGGLVKPGGSLRLSCAASGFTFSNYWMNWVRQAPGKGLEWVGEIRLKHNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 17362 - protein, 122 aa, Artificial Sequence; identical to SEQ ID NO: 11900
  Description of Artificial Sequence: Synthetic polypeptide
  VH of XENP018194

SEQ ID NO: 17363 - protein, 5 aa, Artificial Sequence
  Description of Artificial Sequence: Synthetic peptide
  XENP018194 vhCDR1
NYWMN

SEQ ID NO: 17364 - protein, 19 aa, Artificial Sequence
  Description of Artificial Sequence: Synthetic peptide
  XENP018194 vhCDR2
EIRLKHNNYATHYAEPVKG

SEQ ID NO: 17365 - protein, 11 aa, Artificial Sequence
  Description of Artificial Sequence: Synthetic peptide
  XENP018194 vhCDR3
YYGNYGGYFDV

SEQ ID NO: 17366 - protein, 214 aa, Artificial Sequence; identical to SEQ ID NO: 16226
  Description of Artificial Sequence: Synthetic polypeptide
  XENP018194 1G6_H1.97_L1_IgG1_PVA_/S267K Light Chain

SEQ ID NO: 17367 - protein, 107 aa, Artificial Sequence; identical to SEQ ID NO: 10923
  Description of Artificial Sequence: Synthetic polypeptide
  VL of XENP018194

SEQ ID NO: 17368 - protein, 11 aa, Artificial Sequence
  Description of Artificial Sequence: Synthetic peptide
  XENP018194 vlCDR1
RASQSVSNDVA

SEQ ID NO: 17369 - protein, 7 aa, Artificial Sequence
  Description of Artificial Sequence: Synthetic peptide
  XENP018194 vlCDR2
YASHRYT

SEQ ID NO: 17370 - protein, 9 aa, Artificial Sequence
  Description of Artificial Sequence: Synthetic peptide
  XENP018194 vlCDR3
QQDYSSPRT

SEQ ID NO: 17371 - protein, 451 aa, Artificial Sequence
  Description of Artificial Sequence: Synthetic polypeptide
  XENP018195 1G6_H1.98_L1_IgG1_PVA_/S267K Heavy Chain
EVQLVESGGGLVKPGGSLRLSCAASGFTFSNYWMNWVRQAPGKGLEWVGEIRLKDNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 17372 - protein, 122 aa, Artificial Sequence; identical to SEQ ID NO: 11909
  Description of Artificial Sequence: Synthetic polypeptide
  VH of XENP018195

SEQ ID NO: 17373 - protein, 5 aa, Artificial Sequence
  Description of Artificial Sequence: Synthetic peptide
  XENP018195 vhCDR1
NYWMN

SEQ ID NO: 17374 - protein, 19 aa, Artificial Sequence
  Description of Artificial Sequence: Synthetic peptide
  XENP018195 vhCDR2
EIRLKDNNYATHYAEPVKG

SEQ ID NO: 17375 - protein, 11 aa, Artificial Sequence
  Description of Artificial Sequence: Synthetic peptide
  XENP018195 vhCDR3
YYGNYGGYFDV

SEQ ID NO: 17376 - protein, 214 aa, Artificial Sequence; identical to SEQ ID NO: 16226
  Description of Artificial Sequence: Synthetic polypeptide
  XENP018195 1G6_H1.98_L1_IgG1_PVA_/S267K Light Chain

SEQ ID NO: 17377 - protein, 107 aa, Artificial Sequence; identical to SEQ ID NO: 10923
  Description of Artificial Sequence: Synthetic polypeptide
  VL of XENP018195

SEQ ID NO: 17378 - protein, 11 aa, Artificial Sequence
  Description of Artificial Sequence: Synthetic peptide
  XENP018195 vlCDR1
RASQSVSNDVA

SEQ ID NO: 17379 - protein, 7 aa, Artificial Sequence
  Description of Artificial Sequence: Synthetic peptide
  XENP018195 vlCDR2
YASHRYT

SEQ ID NO: 17380 - protein, 9 aa, Artificial Sequence
  Description of Artificial Sequence: Synthetic peptide
  XENP018195 vlCDR3
QQDYSSPRT

SEQ ID NO: 17381 - protein, 451 aa, Artificial Sequence
  Description of Artificial Sequence: Synthetic polypeptide
  XENP018196 1G6_H1.99_L1_IgG1_PVA_/S267K Heavy Chain
EVQLVESGGGLVKPGGSLRLSCAASGFTFSNYWMNWVRQAPGKGLEWVGEIRLKKNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 17382 - protein, 122 aa, Artificial Sequence; identical to SEQ ID NO: 11918
  Description of Artificial Sequence: Synthetic polypeptide
  VH of XENP018196

SEQ ID NO: 17383 - protein, 5 aa, Artificial Sequence
  Description of Artificial Sequence: Synthetic peptide
  XENP018196 vhCDR1
NYWMN

SEQ ID NO: 17384 - protein, 19 aa, Artificial Sequence
  Description of Artificial Sequence: Synthetic peptide
  XENP018196 vhCDR2
EIRLKKNNYATHYAEPVKG

SEQ ID NO: 17385 - protein, 11 aa, Artificial Sequence
  Description of Artificial Sequence: Synthetic peptide
  XENP018196 vhCDR3
YYGNYGGYFDV

SEQ ID NO: 17386 - protein, 214 aa, Artificial Sequence; identical to SEQ ID NO: 16226
  Description of Artificial Sequence: Synthetic polypeptide
  XENP018196 1G6_H1.99_L1_IgG1_PVA_/S267K Light Chain

SEQ ID NO: 17387 - protein, 107 aa, Artificial Sequence; identical to SEQ ID NO: 10923
  Description of Artificial Sequence: Synthetic polypeptide
  VL of XENP018196

SEQ ID NO: 17388 - protein, 11 aa, Artificial Sequence
  Description of Artificial Sequence: Synthetic peptide
  XENP018196 vlCDR1
RASQSVSNDVA

SEQ ID NO: 17389 - protein, 7 aa, Artificial Sequence
  Description of Artificial Sequence: Synthetic peptide
  XENP018196 vlCDR2
YASHRYT

SEQ ID NO: 17390 - protein, 9 aa, Artificial Sequence
  Description of Artificial Sequence: Synthetic peptide
  XENP018196 vlCDR3
QQDYSSPRT

SEQ ID NO: 17391 - protein, 451 aa, Artificial Sequence
  Description of Artificial Sequence: Synthetic polypeptide
  XENP018201 1G6_H1.100_L1_IgG1_PVA_/S267K Heavy Chain
EVQLVESGGGLVKPGGSLRLSCAASGFTFSNYWMNWVRQAPGKGLEWVGEIRLKYNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 17392 - protein, 122 aa, Artificial Sequence; identical to SEQ ID NO: 11927
  Description of Artificial Sequence: Synthetic polypeptide
  VH of XENP018201

SEQ ID NO: 17393 - protein, 5 aa, Artificial Sequence
  Description of Artificial Sequence: Synthetic peptide
  XENP018201 vhCDR1
NYWMN

SEQ ID NO: 17394 - protein, 19 aa, Artificial Sequence
  Description of Artificial Sequence: Synthetic peptide
  XENP018201 vhCDR2
EIRLKYNNYATHYAEPVKG

SEQ ID NO: 17395 - protein, 11 aa, Artificial Sequence
  Description of Artificial Sequence: Synthetic peptide
  XENP018201 vhCDR3
YYGNYGGYFDV

SEQ ID NO: 17396 - protein, 214 aa, Artificial Sequence; identical to SEQ ID NO: 16226
  Description of Artificial Sequence: Synthetic polypeptide
  XENP018201 1G6_H1.100_L1_IgG1_PVA_/S267K Light Chain

SEQ ID NO: 17397 - protein, 107 aa, Artificial Sequence; identical to SEQ ID NO: 10923
  Description of Artificial Sequence: Synthetic polypeptide
  VL of XENP018201

SEQ ID NO: 17398 - protein, 11 aa, Artificial Sequence
  Description of Artificial Sequence: Synthetic peptide
  XENP018201 vlCDR1
RASQSVSNDVA

SEQ ID NO: 17399 - protein, 7 aa, Artificial Sequence
  Description of Artificial Sequence: Synthetic peptide
  XENP018201 vlCDR2
YASHRYT

SEQ ID NO: 17400 - protein, 9 aa, Artificial Sequence
  Description of Artificial Sequence: Synthetic peptide
  XENP018201 vlCDR3
QQDYSSPRT

SEQ ID NO: 17401 - protein, 451 aa, Artificial Sequence
  Description of Artificial Sequence: Synthetic polypeptide
  XENP018202 1G6_H1.101_L1_IgG1_PVA_/S267K Heavy Chain
EVQLVESGGGLVKPGGSLRLSCAASGFTFSNYWMNWVRQAPGKGLEWVGEIRLKSDNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 17402 - protein, 122 aa, Artificial Sequence; identical to SEQ ID NO: 11936
  Description of Artificial Sequence: Synthetic polypeptide
  VH of XENP018202

SEQ ID NO: 17403 - protein, 5 aa, Artificial Sequence
  Description of Artificial Sequence: Synthetic peptide
  XENP018202 vhCDR1
NYWMN

SEQ ID NO: 17404 - protein, 19 aa, Artificial Sequence
  Description of Artificial Sequence: Synthetic peptide
  XENP018202 vhCDR2
EIRLKSDNYATHYAEPVKG

SEQ ID NO: 17405 - protein, 11 aa, Artificial Sequence
  Description of Artificial Sequence: Synthetic peptide
  XENP018202 vhCDR3
YYGNYGGYFDV

SEQ ID NO: 17406 - protein, 214 aa, Artificial Sequence; identical to SEQ ID NO: 16226
  Description of Artificial Sequence: Synthetic polypeptide
  XENP018202 1G6_H1.101_L1_IgG1_PVA_/S267K Light Chain

SEQ ID NO: 17407 - protein, 107 aa, Artificial Sequence; identical to SEQ ID NO: 10923
  Description of Artificial Sequence: Synthetic polypeptide
  VL of XENP018202

SEQ ID NO: 17408 - protein, 11 aa, Artificial Sequence
  Description of Artificial Sequence: Synthetic peptide
  XENP018202 vlCDR1
RASQSVSNDVA

SEQ ID NO: 17409 - protein, 7 aa, Artificial Sequence
  Description of Artificial Sequence: Synthetic peptide
  XENP018202 vlCDR2
YASHRYT

SEQ ID NO: 17410 - protein, 9 aa, Artificial Sequence
  Description of Artificial Sequence: Synthetic peptide
  XENP018202 vlCDR3
QQDYSSPRT

SEQ ID NO: 17411 - protein, 451 aa, Artificial Sequence
  Description of Artificial Sequence: Synthetic polypeptide
  XENP018203 1G6_H1.102_L1_IgG1_PVA_/S267K Heavy Chain
EVQLVESGGGLVKPGGSLRLSCAASGFTFSNYWMNWVRQAPGKGLEWVGEIRLKSHNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 17412 - protein, 122 aa, Artificial Sequence; identical to SEQ ID NO: 11945
  Description of Artificial Sequence: Synthetic polypeptide
  VH of XENP018203

SEQ ID NO: 17413 - protein, 5 aa, Artificial Sequence
  Description of Artificial Sequence: Synthetic peptide
  XENP018203 vhCDR1
NYWMN

SEQ ID NO: 17414 - protein, 19 aa, Artificial Sequence
  Description of Artificial Sequence: Synthetic peptide
  XENP018203 vhCDR2
EIRLKSHNYATHYAEPVKG

SEQ ID NO: 17415 - protein, 11 aa, Artificial Sequence
  Description of Artificial Sequence: Synthetic peptide
  XENP018203 vhCDR3
YYGNYGGYFDV

SEQ ID NO: 17416 - protein, 214 aa, Artificial Sequence; identical to SEQ ID NO: 16226
  Description of Artificial Sequence: Synthetic polypeptide
  XENP018203 1G6_H1.102_L1_IgG1_PVA_/S267K Light Chain

SEQ ID NO: 17417 - protein, 107 aa, Artificial Sequence; identical to SEQ ID NO: 10923
  Description of Artificial Sequence: Synthetic polypeptide
  VL of XENP018203

SEQ ID NO: 17418 - protein, 11 aa, Artificial Sequence
  Description of Artificial Sequence: Synthetic peptide
  XENP018203 vlCDR1
RASQSVSNDVA

SEQ ID NO: 17419 - protein, 7 aa, Artificial Sequence
  Description of Artificial Sequence: Synthetic peptide
  XENP018203 vlCDR2
YASHRYT

SEQ ID NO: 17420 - protein, 9 aa, Artificial Sequence
  Description of Artificial Sequence: Synthetic peptide
  XENP018203 vlCDR3
QQDYSSPRT

SEQ ID NO: 17421 - protein, 451 aa, Artificial Sequence
  Description of Artificial Sequence: Synthetic polypeptide
  XENP018204 1G6_H1.103_L1_IgG1_PVA_/S267K Heavy Chain
EVQLVESGGGLVKPGGSLRLSCAASGFTFSNYWMNWVRQAPGKGLEWVGEIRLKSENYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 17422 - protein, 122 aa, Artificial Sequence; identical to SEQ ID NO: 11954
  Description of Artificial Sequence: Synthetic polypeptide
  VH of XENP018204

SEQ ID NO: 17423 - protein, 5 aa, Artificial Sequence
  Description of Artificial Sequence: Synthetic peptide
  XENP018204 vhCDR1
NYWMN

SEQ ID NO: 17424 - protein, 19 aa, Artificial Sequence
  Description of Artificial Sequence: Synthetic peptide
  XENP018204 vhCDR2
EIRLKSENYATHYAEPVKG

SEQ ID NO: 17425 - protein, 11 aa, Artificial Sequence
  Description of Artificial Sequence: Synthetic peptide
  XENP018204 vhCDR3
YYGNYGGYFDV

SEQ ID NO: 17426 - protein, 214 aa, Artificial Sequence; identical to SEQ ID NO: 16226
  Description of Artificial Sequence: Synthetic polypeptide
  XENP018204 1G6_H1.103_L1_IgG1_PVA_/S267K Light Chain

SEQ ID NO: 17427 - protein, 107 aa, Artificial Sequence; identical to SEQ ID NO: 10923
  Description of Artificial Sequence: Synthetic polypeptide
  VL of XENP018204

SEQ ID NO: 17428 - protein, 11 aa, Artificial Sequence
  Description of Artificial Sequence: Synthetic peptide
  XENP018204 vlCDR1
RASQSVSNDVA

SEQ ID NO: 17429 - protein, 7 aa, Artificial Sequence
  Description of Artificial Sequence: Synthetic peptide
  XENP018204 vlCDR2
YASHRYT

SEQ ID NO: 17430 - protein, 9 aa, Artificial Sequence
  Description of Artificial Sequence: Synthetic peptide
  XENP018204 vlCDR3
QQDYSSPRT

SEQ ID NO: 17431 - protein, 451 aa, Artificial Sequence
  Description of Artificial Sequence: Synthetic polypeptide
  XENP018205 1G6_H1.104_L1_IgG1_PVA_/S267K Heavy Chain
EVQLVESGGGLVKPGGSLRLSCAASGFTFSNYWMNWVRQAPGKGLEWVGEIRLKSSNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 17432 - protein, 122 aa, Artificial Sequence; identical to SEQ ID NO: 11963
  Description of Artificial Sequence: Synthetic polypeptide
  VH of XENP018205

SEQ ID NO: 17433 - protein, 5 aa, Artificial Sequence
  Description of Artificial Sequence: Synthetic peptide
  XENP018205 vhCDR1
NYWMN

SEQ ID NO: 17434 - protein, 19 aa, Artificial Sequence
  Description of Artificial Sequence: Synthetic peptide
  XENP018205 vhCDR2
EIRLKSSNYATHYAEPVKG

SEQ ID NO: 17435 - protein, 11 aa, Artificial Sequence
  Description of Artificial Sequence: Synthetic peptide
  XENP018205 vhCDR3
YYGNYGGYFDV

SEQ ID NO: 17436 - protein, 214 aa, Artificial Sequence; identical to SEQ ID NO: 16226
  Description of Artificial Sequence: Synthetic polypeptide
  XENP018205 1G6_H1.104_L1_IgG1_PVA_/S267K Light Chain

SEQ ID NO: 17437 - protein, 107 aa, Artificial Sequence; identical to SEQ ID NO: 10923
  Description of Artificial Sequence: Synthetic polypeptide
  VL of XENP018205

SEQ ID NO: 17438 - protein, 11 aa, Artificial Sequence
  Description of Artificial Sequence: Synthetic peptide
  XENP018205 vlCDR1
RASQSVSNDVA

SEQ ID NO: 17439 - protein, 7 aa, Artificial Sequence
  Description of Artificial Sequence: Synthetic peptide
  XENP018205 vlCDR2
YASHRYT

SEQ ID NO: 17440 - protein, 9 aa, Artificial Sequence
  Description of Artificial Sequence: Synthetic peptide
  XENP018205 vlCDR3
QQDYSSPRT

SEQ ID NO: 17441 - protein, 451 aa, Artificial Sequence
  Description of Artificial Sequence: Synthetic polypeptide
  XENP018206 1G6_H1.105_L1_IgG1_PVA_/S267K Heavy Chain
EVQLVESGGGLVKPGGSLRLSCAASGFTFSNYWMNWVRQAPGKGLEWVGEIRLKSRNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 17442 - protein, 122 aa, Artificial Sequence; identical to SEQ ID NO: 11972
  Description of Artificial Sequence: Synthetic polypeptide
  VH of XENP018206

SEQ ID NO: 17443 - protein, 5 aa, Artificial Sequence
  Description of Artificial Sequence: Synthetic peptide
  XENP018206 vhCDR1
NYWMN

SEQ ID NO: 17444 - protein, 19 aa, Artificial Sequence
  Description of Artificial Sequence: Synthetic peptide
  XENP018206 vhCDR2
EIRLKSRNYATHYAEPVKG

SEQ ID NO: 17445 - protein, 11 aa, Artificial Sequence
  Description of Artificial Sequence: Synthetic peptide
  XENP018206 vhCDR3
YYGNYGGYFDV

SEQ ID NO: 17446 - protein, 214 aa, Artificial Sequence; identical to SEQ ID NO: 16226
  Description of Artificial Sequence: Synthetic polypeptide
  XENP018206 1G6_H1.105_L1_IgG1_PVA_/S267K Light Chain

SEQ ID NO: 17447 - protein, 107 aa, Artificial Sequence; identical to SEQ ID NO: 10923
  Description of Artificial Sequence: Synthetic polypeptide
  VL of XENP018206

SEQ ID NO: 17448 - protein, 11 aa, Artificial Sequence
  Description of Artificial Sequence: Synthetic peptide
  XENP018206 vlCDR1
RASQSVSNDVA

SEQ ID NO: 17449 - protein, 7 aa, Artificial Sequence
  Description of Artificial Sequence: Synthetic peptide
  XENP018206 vlCDR2
YASHRYT

SEQ ID NO: 17450 - protein, 9 aa, Artificial Sequence
  Description of Artificial Sequence: Synthetic peptide
  XENP018206 vlCDR3
QQDYSSPRT

SEQ ID NO: 17451 - protein, 451 aa, Artificial Sequence
  Description of Artificial Sequence: Synthetic polypeptide
  XENP018207 1G6_H1.106_L1_IgG1_PVA_/S267K Heavy Chain
EVQLVESGGGLVKPGGSLRLSCAASGFTFSNYWMNWVRQAPGKGLEWVGEIRLKSLNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 17452 - protein, 122 aa, Artificial Sequence; identical to SEQ ID NO: 11981
  Description of Artificial Sequence: Synthetic polypeptide
  VH of XENP018207

SEQ ID NO: 17453 - protein, 5 aa, Artificial Sequence
  Description of Artificial Sequence: Synthetic peptide
  XENP018207 vhCDR1
NYWMN

SEQ ID NO: 17454 - protein, 19 aa, Artificial Sequence
  Description of Artificial Sequence: Synthetic peptide
  XENP018207 vhCDR2
EIRLKSLNYATHYAEPVKG

SEQ ID NO: 17455 - protein, 11 aa, Artificial Sequence
  Description of Artificial Sequence: Synthetic peptide
  XENP018207 vhCDR3
YYGNYGGYFDV

SEQ ID NO: 17456 - protein, 214 aa, Artificial Sequence; identical to SEQ ID NO: 16226
  Description of Artificial Sequence: Synthetic polypeptide
  XENP018207 1G6_H1.106_L1_IgG1_PVA_/S267K Light Chain

SEQ ID NO: 17457 - protein, 107 aa, Artificial Sequence; identical to SEQ ID NO: 10923
  Description of Artificial Sequence: Synthetic polypeptide
  VL of XENP018207

SEQ ID NO: 17458 - protein, 11 aa, Artificial Sequence
  Description of Artificial Sequence: Synthetic peptide
  XENP018207 vlCDR1
RASQSVSNDVA

SEQ ID NO: 17459 - protein, 7 aa, Artificial Sequence
  Description of Artificial Sequence: Synthetic peptide
  XENP018207 vlCDR2
YASHRYT

SEQ ID NO: 17460 - protein, 9 aa, Artificial Sequence
  Description of Artificial Sequence: Synthetic peptide
  XENP018207 vlCDR3
QQDYSSPRT

SEQ ID NO: 17461 - protein, 451 aa, Artificial Sequence
  Description of Artificial Sequence: Synthetic polypeptide
  XENP018208 1G6_H1.107_L1_IgG1_PVA_/S267K Heavy Chain
EVQLVESGGGLVKPGGSLRLSCAASGFTFSNYWMNWVRQAPGKGLEWVGEIRLKSTNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 17462 - protein, 122 aa, Artificial Sequence; identical to SEQ ID NO: 11990
  Description of Artificial Sequence: Synthetic polypeptide
  VH of XENP018208

SEQ ID NO: 17463 - protein, 5 aa, Artificial Sequence
  Description of Artificial Sequence: Synthetic peptide
  XENP018208 vhCDR1
NYWMN

SEQ ID NO: 17464 - protein, 19 aa, Artificial Sequence
  Description of Artificial Sequence: Synthetic peptide
  XENP018208 vhCDR2
EIRLKSTNYATHYAEPVKG

SEQ ID NO: 17465 - protein, 11 aa, Artificial Sequence
  Description of Artificial Sequence: Synthetic peptide
  XENP018208 vhCDR3
YYGNYGGYFDV

SEQ ID NO: 17466 - protein, 214 aa, Artificial Sequence; identical to SEQ ID NO: 16226
  Description of Artificial Sequence: Synthetic polypeptide
  XENP018208 1G6_H1.107_L1_IgG1_PVA_/S267K Light Chain

SEQ ID NO: 17467 - protein, 107 aa, Artificial Sequence; identical to SEQ ID NO: 10923
  Description of Artificial Sequence: Synthetic polypeptide
  VL of XENP018208

SEQ ID NO: 17468 - protein, 11 aa, Artificial Sequence
  Description of Artificial Sequence: Synthetic peptide
  XENP018208 vlCDR1
RASQSVSNDVA

SEQ ID NO: 17469 - protein, 7 aa, Artificial Sequence
  Description of Artificial Sequence: Synthetic peptide
  XENP018208 vlCDR2
YASHRYT

SEQ ID NO: 17470 - protein, 9 aa, Artificial Sequence
  Description of Artificial Sequence: Synthetic peptide
  XENP018208 vlCDR3
QQDYSSPRT

SEQ ID NO: 17471 - protein, 451 aa, Artificial Sequence
  Description of Artificial Sequence: Synthetic polypeptide
  XENP018209 1G6_H1.108_L1_IgG1_PVA_/S267K Heavy Chain
EVQLVESGGGLVKPGGSLRLSCAASGFTFSNYWMNWVRQAPGKGLEWVGEIRLKSGNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 17472 - protein, 122 aa, Artificial Sequence; identical to SEQ ID NO: 11999
  Description of Artificial Sequence: Synthetic polypeptide
  VH of XENP018209

SEQ ID NO: 17473 - protein, 5 aa, Artificial Sequence
  Description of Artificial Sequence: Synthetic peptide
  XENP018209 vhCDR1
NYWMN

SEQ ID NO: 17474 - protein, 19 aa, Artificial Sequence
  Description of Artificial Sequence: Synthetic peptide
  XENP018209 vhCDR2
EIRLKSGNYATHYAEPVKG

SEQ ID NO: 17475 - protein, 11 aa, Artificial Sequence
  Description of Artificial Sequence: Synthetic peptide
  XENP018209 vhCDR3
YYGNYGGYFDV

SEQ ID NO: 17476 - protein, 214 aa, Artificial Sequence; identical to SEQ ID NO: 16226
  Description of Artificial Sequence: Synthetic polypeptide
  XENP018209 1G6_H1.108_L1_IgG1_PVA_/S267K Light Chain

SEQ ID NO: 17477 - protein, 107 aa, Artificial Sequence; identical to SEQ ID NO: 10923
  Description of Artificial Sequence: Synthetic polypeptide
  VL of XENP018209

SEQ ID NO: 17478 - protein, 11 aa, Artificial Sequence
  Description of Artificial Sequence: Synthetic peptide
  XENP018209 vlCDR1
RASQSVSNDVA

SEQ ID NO: 17479 - protein, 7 aa, Artificial Sequence
  Description of Artificial Sequence: Synthetic peptide
  XENP018209 vlCDR2
YASHRYT

SEQ ID NO: 17480 - protein, 9 aa, Artificial Sequence
  Description of Artificial Sequence: Synthetic peptide
  XENP018209 vlCDR3
QQDYSSPRT

SEQ ID NO: 17481 - protein, 451 aa, Artificial Sequence
  Description of Artificial Sequence: Synthetic polypeptide
  XENP018210 1G6_H1.109_L1_IgG1_PVA_/S267K Heavy Chain
EVQLVESGGGLVKPGGSLRLSCAASGFTFSNYWMNWVRQAPGKGLEWVGEIRLKSYNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 17482 - protein, 122 aa, Artificial Sequence; identical to SEQ ID NO: 12008
  Description of Artificial Sequence: Synthetic polypeptide
  VH of XENP018210

SEQ ID NO: 17483 - protein, 5 aa, Artificial Sequence
  Description of Artificial Sequence: Synthetic peptide
  XENP018210 vhCDR1
NYWMN

SEQ ID NO: 17484 - protein, 19 aa, Artificial Sequence
  Description of Artificial Sequence: Synthetic peptide
  XENP018210 vhCDR2
EIRLKSYNYATHYAEPVKG

SEQ ID NO: 17485 - protein, 11 aa, Artificial Sequence
  Description of Artificial Sequence: Synthetic peptide
  XENP018210 vhCDR3
YYGNYGGYFDV

SEQ ID NO: 17486 - protein, 214 aa, Artificial Sequence; identical to SEQ ID NO: 16226
  Description of Artificial Sequence: Synthetic polypeptide
  XENP018210 1G6_H1.109_L1_IgG1_PVA_/S267K Light Chain

SEQ ID NO: 17487 - protein, 107 aa, Artificial Sequence; identical to SEQ ID NO: 10923
  Description of Artificial Sequence: Synthetic polypeptide
  VL of XENP018210

SEQ ID NO: 17488 - protein, 11 aa, Artificial Sequence
  Description of Artificial Sequence: Synthetic peptide
  XENP018210 vlCDR1
RASQSVSNDVA

SEQ ID NO: 17489 - protein, 7 aa, Artificial Sequence
  Description of Artificial Sequence: Synthetic peptide
  XENP018210 vlCDR2
YASHRYT

SEQ ID NO: 17490 - protein, 9 aa, Artificial Sequence
  Description of Artificial Sequence: Synthetic peptide
  XENP018210 vlCDR3
QQDYSSPRT

SEQ ID NO: 17491 - protein, 451 aa, Artificial Sequence
  Description of Artificial Sequence: Synthetic polypeptide
  XENP018211 1G6_H1.110_L1_IgG1_PVA_/S267K Heavy Chain
EVQLVESGGGLVKPGGSLRLSCAASGFTFSNYWMNWVRQAPGKGLEWVGEIRLKSNDYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 17492 - protein, 122 aa, Artificial Sequence; identical to SEQ ID NO: 12017
  Description of Artificial Sequence: Synthetic polypeptide
  VH of XENP018211

SEQ ID NO: 17493 - protein, 5 aa, Artificial Sequence
  Description of Artificial Sequence: Synthetic peptide
  XENP018211 vhCDR1
NYWMN

SEQ ID NO: 17494 - protein, 19 aa, Artificial Sequence
  Description of Artificial Sequence: Synthetic peptide
  XENP018211 vhCDR2
EIRLKSNDYATHYAEPVKG

SEQ ID NO: 17495 - protein, 11 aa, Artificial Sequence
  Description of Artificial Sequence: Synthetic peptide
  XENP018211 vhCDR3
YYGNYGGYFDV

SEQ ID NO: 17496 - protein, 214 aa, Artificial Sequence; identical to SEQ ID NO: 16226
  Description of Artificial Sequence: Synthetic polypeptide
  XENP018211 1G6_H1.110_L1_IgG1_PVA_/S267K Light Chain

SEQ ID NO: 17497 - protein, 107 aa, Artificial Sequence; identical to SEQ ID NO: 10923
  Description of Artificial Sequence: Synthetic polypeptide
  VL of XENP018211

SEQ ID NO: 17498 - protein, 11 aa, Artificial Sequence
  Description of Artificial Sequence: Synthetic peptide
  XENP018211 vlCDR1
RASQSVSNDVA

SEQ ID NO: 17499 - protein, 7 aa, Artificial Sequence
  Description of Artificial Sequence: Synthetic peptide
  XENP018211 vlCDR2
YASHRYT

SEQ ID NO: 17500 - protein, 9 aa, Artificial Sequence
  Description of Artificial Sequence: Synthetic peptide
  XENP018211 vlCDR3
QQDYSSPRT

SEQ ID NO: 17501 - protein, 451 aa, Artificial Sequence
  Description of Artificial Sequence: Synthetic polypeptide
  XENP018212 1G6_H1.111_L1_IgG1_PVA_/S267K Heavy Chain
EVQLVESGGGLVKPGGSLRLSCAASGFTFSNYWMNWVRQAPGKGLEWVGEIRLKSNHYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 17502 - protein, 122 aa, Artificial Sequence; identical to SEQ ID NO: 12026
  Description of Artificial Sequence: Synthetic polypeptide
  VH of XENP018212

SEQ ID NO: 17503 - protein, 5 aa, Artificial Sequence
  Description of Artificial Sequence: Synthetic peptide
  XENP018212 vhCDR1
NYWMN

SEQ ID NO: 17504 - protein, 19 aa, Artificial Sequence
  Description of Artificial Sequence: Synthetic peptide
  XENP018212 vhCDR2
EIRLKSNHYATHYAEPVKG

SEQ ID NO: 17505 - protein, 11 aa, Artificial Sequence
  Description of Artificial Sequence: Synthetic peptide
  XENP018212 vhCDR3
YYGNYGGYFDV

SEQ ID NO: 17506 - protein, 214 aa, Artificial Sequence; identical to SEQ ID NO: 16226
  Description of Artificial Sequence: Synthetic polypeptide
  XENP018212 1G6_H1.111_L1_IgG1_PVA_/S267K Light Chain

SEQ ID NO: 17507 - protein, 107 aa, Artificial Sequence; identical to SEQ ID NO: 10923
  Description of Artificial Sequence: Synthetic polypeptide
  VL of XENP018212

SEQ ID NO: 17508 - protein, 11 aa, Artificial Sequence
  Description of Artificial Sequence: Synthetic peptide
  XENP018212 vlCDR1
RASQSVSNDVA

SEQ ID NO: 17509 - protein, 7 aa, Artificial Sequence
  Description of Artificial Sequence: Synthetic peptide
  XENP018212 vlCDR2
YASHRYT

SEQ ID NO: 17510 - protein, 9 aa, Artificial Sequence
  Description of Artificial Sequence: Synthetic peptide
  XENP018212 vlCDR3
QQDYSSPRT

SEQ ID NO: 17511 - protein, 451 aa, Artificial Sequence
  Description of Artificial Sequence: Synthetic polypeptide
  XENP018213 1G6_H1.112_L1_IgG1_PVA_/S267K Heavy Chain
EVQLVESGGGLVKPGGSLRLSCAASGFTFSNYWMNWVRQAPGKGLEWVGEIRLKSNEYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 17512 - protein, 122 aa, Artificial Sequence; identical to SEQ ID NO: 12035
  Description of Artificial Sequence: Synthetic polypeptide
  VH of XENP018213

SEQ ID NO: 17513 - protein, 5 aa, Artificial Sequence
  Description of Artificial Sequence: Synthetic peptide
  XENP018213 vhCDR1
NYWMN

SEQ ID NO: 17514 - protein, 19 aa, Artificial Sequence
  Description of Artificial Sequence: Synthetic peptide
  XENP018213 vhCDR2
EIRLKSNEYATHYAEPVKG

SEQ ID NO: 17515 - protein, 11 aa, Artificial Sequence
  Description of Artificial Sequence: Synthetic peptide
  XENP018213 vhCDR3
YYGNYGGYFDV

SEQ ID NO: 17516 - protein, 214 aa, Artificial Sequence; identical to SEQ ID NO: 16226
  Description of Artificial Sequence: Synthetic polypeptide
  XENP018213 1G6_H1.112_L1_IgG1_PVA_/S267K Light Chain

SEQ ID NO: 17517 - protein, 107 aa, Artificial Sequence; identical to SEQ ID NO: 10923
  Description of Artificial Sequence: Synthetic polypeptide
  VL of XENP018213

SEQ ID NO: 17518 - protein, 11 aa, Artificial Sequence
  Description of Artificial Sequence: Synthetic peptide
  XENP018213 vlCDR1
RASQSVSNDVA

SEQ ID NO: 17519 - protein, 7 aa, Artificial Sequence
  Description of Artificial Sequence: Synthetic peptide
  XENP018213 vlCDR2
YASHRYT

SEQ ID NO: 17520 - protein, 9 aa, Artificial Sequence
  Description of Artificial Sequence: Synthetic peptide
  XENP018213 vlCDR3
QQDYSSPRT

SEQ ID NO: 17521 - protein, 451 aa, Artificial Sequence
  Description of Artificial Sequence: Synthetic polypeptide
  XENP018214 1G6_H1.113_L1_IgG1_PVA_/S267K Heavy Chain
EVQLVESGGGLVKPGGSLRLSCAASGFTFSNYWMNWVRQAPGKGLEWVGEIRLKSNSYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 17522 - protein, 122 aa, Artificial Sequence; identical to SEQ ID NO: 12044
  Description of Artificial Sequence: Synthetic polypeptide
  VH of XENP018214

SEQ ID NO: 17523 - protein, 5 aa, Artificial Sequence
  Description of Artificial Sequence: Synthetic peptide
  XENP018214 vhCDR1
NYWMN

SEQ ID NO: 17524 - protein, 19 aa, Artificial Sequence
  Description of Artificial Sequence: Synthetic peptide
  XENP018214 vhCDR2
EIRLKSNSYATHYAEPVKG

SEQ ID NO: 17525 - protein, 11 aa, Artificial Sequence
  Description of Artificial Sequence: Synthetic peptide
  XENP018214 vhCDR3
YYGNYGGYFDV

SEQ ID NO: 17526 - protein, 214 aa, Artificial Sequence; identical to SEQ ID NO: 16226
  Description of Artificial Sequence: Synthetic polypeptide
  XENP018214 1G6_H1.113_L1_IgG1_PVA_/S267K Light Chain

SEQ ID NO: 17527 - protein, 107 aa, Artificial Sequence; identical to SEQ ID NO: 10923
  Description of Artificial Sequence: Synthetic polypeptide
  VL of XENP018214

SEQ ID NO: 17528 - protein, 11 aa, Artificial Sequence
  Description of Artificial Sequence: Synthetic peptide
  XENP018214 vlCDR1
RASQSVSNDVA

SEQ ID NO: 17529 - protein, 7 aa, Artificial Sequence
  Description of Artificial Sequence: Synthetic peptide
  XENP018214 vlCDR2
YASHRYT

SEQ ID NO: 17530 - protein, 9 aa, Artificial Sequence
  Description of Artificial Sequence: Synthetic peptide
  XENP018214 vlCDR3
QQDYSSPRT

SEQ ID NO: 17531 - protein, 451 aa, Artificial Sequence
  Description of Artificial Sequence: Synthetic polypeptide
  XENP018215 1G6_H1.114_L1_IgG1_PVA_/S267K Heavy Chain
EVQLVESGGGLVKPGGSLRLSCAASGFTFSNYWMNWVRQAPGKGLEWVGEIRLKSNRYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 17532 - protein, 122 aa, Artificial Sequence; identical to SEQ ID NO: 12053
  Description of Artificial Sequence: Synthetic polypeptide
  VH of XENP018215

SEQ ID NO: 17533 - protein, 5 aa, Artificial Sequence
  Description of Artificial Sequence: Synthetic peptide
  XENP018215 vhCDR1
NYWMN

SEQ ID NO: 17534 - protein, 19 aa, Artificial Sequence
  Description of Artificial Sequence: Synthetic peptide
  XENP018215 vhCDR2
EIRLKSNRYATHYAEPVKG

SEQ ID NO: 17535 - protein, 11 aa, Artificial Sequence
  Description of Artificial Sequence: Synthetic peptide
  XENP018215 vhCDR3
YYGNYGGYFDV

SEQ ID NO: 17536 - protein, 214 aa, Artificial Sequence; identical to SEQ ID NO: 16226
  Description of Artificial Sequence: Synthetic polypeptide
  XENP018215 1G6_H1.114_L1_IgG1_PVA_/S267K Light Chain

SEQ ID NO: 17537 - protein, 107 aa, Artificial Sequence; identical to SEQ ID NO: 10923
  Description of Artificial Sequence: Synthetic polypeptide
  VL of XENP018215

SEQ ID NO: 17538 - protein, 11 aa, Artificial Sequence
  Description of Artificial Sequence: Synthetic peptide
  XENP018215 vlCDR1
RASQSVSNDVA

SEQ ID NO: 17539 - protein, 7 aa, Artificial Sequence
  Description of Artificial Sequence: Synthetic peptide
  XENP018215 vlCDR2
YASHRYT

SEQ ID NO: 17540 - protein, 9 aa, Artificial Sequence
  Description of Artificial Sequence: Synthetic peptide
  XENP018215 vlCDR3
QQDYSSPRT

SEQ ID NO: 17541 - protein, 451 aa, Artificial Sequence
  Description of Artificial Sequence: Synthetic polypeptide
  XENP018216 1G6_H1.115_L1_IgG1_PVA_/S267K Heavy Chain
EVQLVESGGGLVKPGGSLRLSCAASGFTFSNYWMNWVRQAPGKGLEWVGEIRLKSNLYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 17542 - protein, 122 aa, Artificial Sequence; identical to SEQ ID NO: 12062
  Description of Artificial Sequence: Synthetic polypeptide
  VH of XENP018216

SEQ ID NO: 17543 - protein, 5 aa, Artificial Sequence
  Description of Artificial Sequence: Synthetic peptide
  XENP018216 vhCDR1
NYWMN

SEQ ID NO: 17544 - protein, 19 aa, Artificial Sequence
  Description of Artificial Sequence: Synthetic peptide
  XENP018216 vhCDR2
EIRLKSNLYATHYAEPVKG

SEQ ID NO: 17545 - protein, 11 aa, Artificial Sequence
  Description of Artificial Sequence: Synthetic peptide
  XENP018216 vhCDR3
YYGNYGGYFDV

SEQ ID NO: 17546 - protein, 214 aa, Artificial Sequence; identical to SEQ ID NO: 16226
  Description of Artificial Sequence: Synthetic polypeptide
  XENP018216 1G6_H1.115_L1_IgG1_PVA_/S267K Light Chain

SEQ ID NO: 17547 - protein, 107 aa, Artificial Sequence; identical to SEQ ID NO: 10923
  Description of Artificial Sequence: Synthetic polypeptide
  VL of XENP018216

SEQ ID NO: 17548 - protein, 11 aa, Artificial Sequence
  Description of Artificial Sequence: Synthetic peptide
  XENP018216 vlCDR1
RASQSVSNDVA

SEQ ID NO: 17549 - protein, 7 aa, Artificial Sequence
  Description of Artificial Sequence: Synthetic peptide
  XENP018216 vlCDR2
YASHRYT

SEQ ID NO: 17550 - protein, 9 aa, Artificial Sequence
  Description of Artificial Sequence: Synthetic peptide
  XENP018216 vlCDR3
QQDYSSPRT

SEQ ID NO: 17551 - protein, 451 aa, Artificial Sequence
  Description of Artificial Sequence: Synthetic polypeptide
  XENP018217 1G6_H1.116_L1_IgG1_PVA_/S267K Heavy Chain
EVQLVESGGGLVKPGGSLRLSCAASGFTFSNYWMNWVRQAPGKGLEWVGEIRLKSNTYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 17552 - protein, 122 aa, Artificial Sequence; identical to SEQ ID NO: 12071
  Description of Artificial Sequence: Synthetic polypeptide
  VH of XENP018217

SEQ ID NO: 17553 - protein, 5 aa, Artificial Sequence
  Description of Artificial Sequence: Synthetic peptide
  XENP018217 vhCDR1
NYWMN

SEQ ID NO: 17554 - protein, 19 aa, Artificial Sequence
  Description of Artificial Sequence: Synthetic peptide
  XENP018217 vhCDR2
EIRLKSNTYATHYAEPVKG

SEQ ID NO: 17555 - protein, 11 aa, Artificial Sequence
  Description of Artificial Sequence: Synthetic peptide
  XENP018217 vhCDR3
YYGNYGGYFDV

SEQ ID NO: 17556 - protein, 214 aa, Artificial Sequence; identical to SEQ ID NO: 16226
  Description of Artificial Sequence: Synthetic polypeptide
  XENP018217 1G6_H1.116_L1_IgG1_PVA_/S267K Light Chain

SEQ ID NO: 17557 - protein, 107 aa, Artificial Sequence; identical to SEQ ID NO: 10923
  Description of Artificial Sequence: Synthetic polypeptide
  VL of XENP018217

SEQ ID NO: 17558 - protein, 11 aa, Artificial Sequence
  Description of Artificial Sequence: Synthetic peptide
  XENP018217 vlCDR1
RASQSVSNDVA

SEQ ID NO: 17559 - protein, 7 aa, Artificial Sequence
  Description of Artificial Sequence: Synthetic peptide
  XENP018217 vlCDR2
YASHRYT

SEQ ID NO: 17560 - protein, 9 aa, Artificial Sequence
  Description of Artificial Sequence: Synthetic peptide
  XENP018217 vlCDR3
QQDYSSPRT

SEQ ID NO: 17561 - protein, 451 aa, Artificial Sequence
  Description of Artificial Sequence: Synthetic polypeptide
  XENP018218 1G6_H1.117_L1_IgG1_PVA_/S267K Heavy Chain
EVQLVESGGGLVKPGGSLRLSCAASGFTFSNYWMNWVRQAPGKGLEWVGEIRLKSNGYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 17562 - protein, 122 aa, Artificial Sequence; identical to SEQ ID NO: 12080
  Description of Artificial Sequence: Synthetic polypeptide
  VH of XENP018218

SEQ ID NO: 17563 - protein, 5 aa, Artificial Sequence
  Description of Artificial Sequence: Synthetic peptide
  XENP018218 vhCDR1
NYWMN

SEQ ID NO: 17564 - protein, 19 aa, Artificial Sequence
  Description of Artificial Sequence: Synthetic peptide
  XENP018218 vhCDR2
EIRLKSNGYATHYAEPVKG

SEQ ID NO: 17565 - protein, 11 aa, Artificial Sequence
  Description of Artificial Sequence: Synthetic peptide
  XENP018218 vhCDR3
YYGNYGGYFDV

SEQ ID NO: 17566 - protein, 214 aa, Artificial Sequence; identical to SEQ ID NO: 16226
  Description of Artificial Sequence: Synthetic polypeptide
  XENP018218 1G6_H1.117_L1_IgG1_PVA_/S267K Light Chain

SEQ ID NO: 17567 - protein, 107 aa, Artificial Sequence; identical to SEQ ID NO: 10923
  Description of Artificial Sequence: Synthetic polypeptide
  VL of XENP018218

SEQ ID NO: 17568 - protein, 11 aa, Artificial Sequence
  Description of Artificial Sequence: Synthetic peptide
  XENP018218 vlCDR1
RASQSVSNDVA

SEQ ID NO: 17569 - protein, 7 aa, Artificial Sequence
  Description of Artificial Sequence: Synthetic peptide
  XENP018218 vlCDR2
YASHRYT

SEQ ID NO: 17570 - protein, 9 aa, Artificial Sequence
  Description of Artificial Sequence: Synthetic peptide
  XENP018218 vlCDR3
QQDYSSPRT

SEQ ID NO: 17571 - protein, 451 aa, Artificial Sequence
  Description of Artificial Sequence: Synthetic polypeptide
  XENP018219 1G6_H1.118_L1_IgG1_PVA_/S267K Heavy Chain
EVQLVESGGGLVKPGGSLRLSCAASGFTFSNYWMNWVRQAPGKGLEWVGEIRLKSNYYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 17572 - protein, 122 aa, Artificial Sequence; identical to SEQ ID NO: 12089
  Description of Artificial Sequence: Synthetic polypeptide
  VH of XENP018219

SEQ ID NO: 17573 - protein, 5 aa, Artificial Sequence
  Description of Artificial Sequence: Synthetic peptide
  XENP018219 vhCDR1
NYWMN

SEQ ID NO: 17574 - protein, 19 aa, Artificial Sequence
  Description of Artificial Sequence: Synthetic peptide
  XENP018219 vhCDR2
EIRLKSNYYATHYAEPVKG

SEQ ID NO: 17575 - protein, 11 aa, Artificial Sequence
  Description of Artificial Sequence: Synthetic peptide
  XENP018219 vhCDR3
YYGNYGGYFDV

SEQ ID NO: 17576 - protein, 214 aa, Artificial Sequence; identical to SEQ ID NO: 16226
  Description of Artificial Sequence: Synthetic polypeptide
  XENP018219 1G6_H1.118_L1_IgG1_PVA_/S267K Light Chain

SEQ ID NO: 17577 - protein, 107 aa, Artificial Sequence; identical to SEQ ID NO: 10923
  Description of Artificial Sequence: Synthetic polypeptide
  VL of XENP018219

SEQ ID NO: 17578 - protein, 11 aa, Artificial Sequence
  Description of Artificial Sequence: Synthetic peptide
  XENP018219 vlCDR1
RASQSVSNDVA

SEQ ID NO: 17579 - protein, 7 aa, Artificial Sequence
  Description of Artificial Sequence: Synthetic peptide
  XENP018219 vlCDR2
YASHRYT

SEQ ID NO: 17580 - protein, 9 aa, Artificial Sequence
  Description of Artificial Sequence: Synthetic peptide
  XENP018219 vlCDR3
QQDYSSPRT

SEQ ID NO: 17581 - protein, 451 aa, Artificial Sequence
  Description of Artificial Sequence: Synthetic polypeptide
  XENP018220 1G6_H1.119_L1_IgG1_PVA_/S267K Heavy Chain
EVQLVESGGGLVKPGGSLRLSCAASGFTFSNYWMNWVRQAPGKGLEWVGEIRLKSNNFATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 17582 - protein, 122 aa, Artificial Sequence; identical to SEQ ID NO: 12098
  Description of Artificial Sequence: Synthetic polypeptide
  VH of XENP018220

SEQ ID NO: 17583 - protein, 5 aa, Artificial Sequence
  Description of Artificial Sequence: Synthetic peptide
  XENP018220 vhCDR1
NYWMN

SEQ ID NO: 17584 - protein, 19 aa, Artificial Sequence
  Description of Artificial Sequence: Synthetic peptide
  XENP018220 vhCDR2
EIRLKSNNFATHYAEPVKG

SEQ ID NO: 17585 - protein, 11 aa, Artificial Sequence
  Description of Artificial Sequence: Synthetic peptide
  XENP018220 vhCDR3
YYGNYGGYFDV

SEQ ID NO: 17586 - protein, 214 aa, Artificial Sequence; identical to SEQ ID NO: 16226
  Description of Artificial Sequence: Synthetic polypeptide
  XENP018220 1G6_H1.119_L1_IgG1_PVA_/S267K Light Chain

SEQ ID NO: 17587 - protein, 107 aa, Artificial Sequence; identical to SEQ ID NO: 10923
  Description of Artificial Sequence: Synthetic polypeptide
  VL of XENP018220

SEQ ID NO: 17588 - protein, 11 aa, Artificial Sequence
  Description of Artificial Sequence: Synthetic peptide
  XENP018220 vlCDR1
RASQSVSNDVA

SEQ ID NO: 17589 - protein, 7 aa, Artificial Sequence
  Description of Artificial Sequence: Synthetic peptide
  XENP018220 vlCDR2
YASHRYT

SEQ ID NO: 17590 - protein, 9 aa, Artificial Sequence
  Description of Artificial Sequence: Synthetic peptide
  XENP018220 vlCDR3
QQDYSSPRT

SEQ ID NO: 17591 - protein, 451 aa, Artificial Sequence
  Description of Artificial Sequence: Synthetic polypeptide
  XENP018221 1G6_H1.120_L1_IgG1_PVA_/S267K Heavy Chain
EVQLVESGGGLVKPGGSLRLSCAASGFTFSNYWMNWVRQAPGKGLEWVGEIRLKSNNHATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 17592 - protein, 122 aa, Artificial Sequence; identical to SEQ ID NO: 12107
  Description of Artificial Sequence: Synthetic polypeptide
  VH of XENP018221

SEQ ID NO: 17593 - protein, 5 aa, Artificial Sequence
  Description of Artificial Sequence: Synthetic peptide
  XENP018221 vhCDR1
NYWMN

SEQ ID NO: 17594 - protein, 19 aa, Artificial Sequence
  Description of Artificial Sequence: Synthetic peptide
  XENP018221 vhCDR2
EIRLKSNNHATHYAEPVKG

SEQ ID NO: 17595 - protein, 11 aa, Artificial Sequence
  Description of Artificial Sequence: Synthetic peptide
  XENP018221 vhCDR3
YYGNYGGYFDV

SEQ ID NO: 17596 - protein, 214 aa, Artificial Sequence; identical to SEQ ID NO: 16226
  Description of Artificial Sequence: Synthetic polypeptide
  XENP018221 1G6_H1.120_L1_IgG1_PVA_/S267K Light Chain

SEQ ID NO: 17597 - protein, 107 aa, Artificial Sequence; identical to SEQ ID NO: 10923
  Description of Artificial Sequence: Synthetic polypeptide
  VL of XENP018221

SEQ ID NO: 17598 - protein, 11 aa, Artificial Sequence
  Description of Artificial Sequence: Synthetic peptide
  XENP018221 vlCDR1
RASQSVSNDVA

SEQ ID NO: 17599 - protein, 7 aa, Artificial Sequence
  Description of Artificial Sequence: Synthetic peptide
  XENP018221 vlCDR2
YASHRYT

SEQ ID NO: 17600 - protein, 9 aa, Artificial Sequence
  Description of Artificial Sequence: Synthetic peptide
  XENP018221 vlCDR3
QQDYSSPRT

SEQ ID NO: 17601 - protein, 451 aa, Artificial Sequence
  Description of Artificial Sequence: Synthetic polypeptide
  XENP018222 1G6_H1.121_L1_IgG1_PVA_/S267K Heavy Chain
EVQLVESGGGLVKPGGSLRLSCAASGFTFSNYWMNWVRQAPGKGLEWVGEIRLKSNNLATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 17602 - protein, 122 aa, Artificial Sequence; identical to SEQ ID NO: 12116
  Description of Artificial Sequence: Synthetic polypeptide
  VH of XENP018222

SEQ ID NO: 17603 - protein, 5 aa, Artificial Sequence
  Description of Artificial Sequence: Synthetic peptide
  XENP018222 vhCDR1
NYWMN

SEQ ID NO: 17604 - protein, 19 aa, Artificial Sequence
  Description of Artificial Sequence: Synthetic peptide
  XENP018222 vhCDR2
EIRLKSNNLATHYAEPVKG

SEQ ID NO: 17605 - protein, 11 aa, Artificial Sequence
  Description of Artificial Sequence: Synthetic peptide
  XENP018222 vhCDR3
YYGNYGGYFDV

SEQ ID NO: 17606 - protein, 214 aa, Artificial Sequence; identical to SEQ ID NO: 16226
  Description of Artificial Sequence: Synthetic polypeptide
  XENP018222 1G6_H1.121_L1_IgG1_PVA_/S267K Light Chain

SEQ ID NO: 17607 - protein, 107 aa, Artificial Sequence; identical to SEQ ID NO: 10923
  Description of Artificial Sequence: Synthetic polypeptide
  VL of XENP018222

SEQ ID NO: 17608 - protein, 11 aa, Artificial Sequence
  Description of Artificial Sequence: Synthetic peptide
  XENP018222 vlCDR1
RASQSVSNDVA

SEQ ID NO: 17609 - protein, 7 aa, Artificial Sequence
  Description of Artificial Sequence: Synthetic peptide
  XENP018222 vlCDR2
YASHRYT

SEQ ID NO: 17610 - protein, 9 aa, Artificial Sequence
  Description of Artificial Sequence: Synthetic peptide
  XENP018222 vlCDR3
QQDYSSPRT

SEQ ID NO: 17611 - protein, 451 aa, Artificial Sequence
  Description of Artificial Sequence: Synthetic polypeptide
  XENP018223 1G6_H1.122_L1_IgG1_PVA_/S267K Heavy Chain
EVQLVESGGGLVKPGGSLRLSCAASGFTFSNYWMNWVRQAPGKGLEWVGEIRLKSNNWATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 17612 - protein, 122 aa, Artificial Sequence; identical to SEQ ID NO: 12125
  Description of Artificial Sequence: Synthetic polypeptide
  VH of XENP018223

SEQ ID NO: 17613 - protein, 5 aa, Artificial Sequence
  Description of Artificial Sequence: Synthetic peptide
  XENP018223 vhCDR1
NYWMN

SEQ ID NO: 17614 - protein, 19 aa, Artificial Sequence
  Description of Artificial Sequence: Synthetic peptide
  XENP018223 vhCDR2
EIRLKSNNWATHYAEPVKG

SEQ ID NO: 17615 - protein, 11 aa, Artificial Sequence
  Description of Artificial Sequence: Synthetic peptide
  XENP018223 vhCDR3
YYGNYGGYFDV

SEQ ID NO: 17616 - protein, 214 aa, Artificial Sequence; identical to SEQ ID NO: 16226
  Description of Artificial Sequence: Synthetic polypeptide
  XENP018223 1G6_H1.122_L1_IgG1_PVA_/S267K Light Chain

SEQ ID NO: 17617 - protein, 107 aa, Artificial Sequence; identical to SEQ ID NO: 10923
  Description of Artificial Sequence: Synthetic polypeptide
  VL of XENP018223

SEQ ID NO: 17618 - protein, 11 aa, Artificial Sequence
  Description of Artificial Sequence: Synthetic peptide
  XENP018223 vlCDR1
RASQSVSNDVA

SEQ ID NO: 17619 - protein, 7 aa, Artificial Sequence
  Description of Artificial Sequence: Synthetic peptide
  XENP018223 vlCDR2
YASHRYT

SEQ ID NO: 17620 - protein, 9 aa, Artificial Sequence
  Description of Artificial Sequence: Synthetic peptide
  XENP018223 vlCDR3
QQDYSSPRT

SEQ ID NO: 17621 - protein, 451 aa, Artificial Sequence
  Description of Artificial Sequence: Synthetic polypeptide
  XENP018224 1G6_H1.123_L1_IgG1_PVA_/S267K Heavy Chain
EVQLVESGGGLVKPGGSLRLSCAASGFTFSNYWMNWVRQAPGKGLEWVGEIRLKSNNVATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 17622 - protein, 122 aa, Artificial Sequence; identical to SEQ ID NO: 12134
  Description of Artificial Sequence: Synthetic polypeptide
  VH of XENP018224

SEQ ID NO: 17623 - protein, 5 aa, Artificial Sequence
  Description of Artificial Sequence: Synthetic peptide
  XENP018224 vhCDR1
NYWMN

SEQ ID NO: 17624 - protein, 19 aa, Artificial Sequence
  Description of Artificial Sequence: Synthetic peptide
  XENP018224 vhCDR2
EIRLKSNNVATHYAEPVKG

SEQ ID NO: 17625 - protein, 11 aa, Artificial Sequence
  Description of Artificial Sequence: Synthetic peptide
  XENP018224 vhCDR3
YYGNYGGYFDV

SEQ ID NO: 17626 - protein, 214 aa, Artificial Sequence; identical to SEQ ID NO: 16226
  Description of Artificial Sequence: Synthetic polypeptide
  XENP018224 1G6_H1.123_L1_IgG1_PVA_/S267K Light Chain

SEQ ID NO: 17627 - protein, 107 aa, Artificial Sequence; identical to SEQ ID NO: 10923
  Description of Artificial Sequence: Synthetic polypeptide
  VL of XENP018224

SEQ ID NO: 17628 - protein, 11 aa, Artificial Sequence
  Description of Artificial Sequence: Synthetic peptide
  XENP018224 vlCDR1
RASQSVSNDVA

SEQ ID NO: 17629 - protein, 7 aa, Artificial Sequence
  Description of Artificial Sequence: Synthetic peptide
  XENP018224 vlCDR2
YASHRYT

SEQ ID NO: 17630 - protein, 9 aa, Artificial Sequence
  Description of Artificial Sequence: Synthetic peptide
  XENP018224 vlCDR3
QQDYSSPRT

SEQ ID NO: 17631 - protein, 451 aa, Artificial Sequence
  Description of Artificial Sequence: Synthetic polypeptide
  XENP018225 1G6_H1.124_L1_IgG1_PVA_/S267K Heavy Chain
EVQLVESGGGLVKPGGSLRLSCAASGFTFSNYWMNWVRQAPGKGLEWVGEIRLKSNNAATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 17632 - protein, 122 aa, Artificial Sequence; identical to SEQ ID NO: 12143
  Description of Artificial Sequence: Synthetic polypeptide
  VH of XENP018225

SEQ ID NO: 17633 - protein, 5 aa, Artificial Sequence
  Description of Artificial Sequence: Synthetic peptide
  XENP018225 vhCDR1
NYWMN

SEQ ID NO: 17634 - protein, 19 aa, Artificial Sequence
  Description of Artificial Sequence: Synthetic peptide
  XENP018225 vhCDR2
EIRLKSNNAATHYAEPVKG

SEQ ID NO: 17635 - protein, 11 aa, Artificial Sequence
  Description of Artificial Sequence: Synthetic peptide
  XENP018225 vhCDR3
YYGNYGGYFDV

SEQ ID NO: 17636 - protein, 214 aa, Artificial Sequence; identical to SEQ ID NO: 16226
  Description of Artificial Sequence: Synthetic polypeptide
  XENP018225 1G6_H1.124_L1_IgG1_PVA_/S267K Light Chain

SEQ ID NO: 17637 - protein, 107 aa, Artificial Sequence; identical to SEQ ID NO: 10923
  Description of Artificial Sequence: Synthetic polypeptide
  VL of XENP018225

SEQ ID NO: 17638 - protein, 11 aa, Artificial Sequence
  Description of Artificial Sequence: Synthetic peptide
  XENP018225 vlCDR1
RASQSVSNDVA

SEQ ID NO: 17639 - protein, 7 aa, Artificial Sequence
  Description of Artificial Sequence: Synthetic peptide
  XENP018225 vlCDR2
YASHRYT

SEQ ID NO: 17640 - protein, 9 aa, Artificial Sequence
  Description of Artificial Sequence: Synthetic peptide
  XENP018225 vlCDR3
QQDYSSPRT

SEQ ID NO: 17641 - protein, 451 aa, Artificial Sequence
  Description of Artificial Sequence: Synthetic polypeptide
  XENP018226 1G6_H1.125_L1_IgG1_PVA_/S267K Heavy Chain
EVQLVESGGGLVKPGGSLRLSCAASGFTFSNYWMNWVRQAPGKGLEWVGEIRLKSNNQATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 17642 - protein, 122 aa, Artificial Sequence; identical to SEQ ID NO: 12152
  Description of Artificial Sequence: Synthetic polypeptide
  VH of XENP018226

SEQ ID NO: 17643 - protein, 5 aa, Artificial Sequence
  Description of Artificial Sequence: Synthetic peptide
  XENP018226 vhCDR1
NYWMN

SEQ ID NO: 17644 - protein, 19 aa, Artificial Sequence
  Description of Artificial Sequence: Synthetic peptide
  XENP018226 vhCDR2
EIRLKSNNQATHYAEPVKG

SEQ ID NO: 17645 - protein, 11 aa, Artificial Sequence
  Description of Artificial Sequence: Synthetic peptide
  XENP018226 vhCDR3
YYGNYGGYFDV

SEQ ID NO: 17646 - protein, 214 aa, Artificial Sequence; identical to SEQ ID NO: 16226
  Description of Artificial Sequence: Synthetic polypeptide
  XENP018226 1G6_H1.125_L1_IgG1_PVA_/S267K Light Chain

SEQ ID NO: 17647 - protein, 107 aa, Artificial Sequence; identical to SEQ ID NO: 10923
  Description of Artificial Sequence: Synthetic polypeptide
  VL of XENP018226

SEQ ID NO: 17648 - protein, 11 aa, Artificial Sequence
  Description of Artificial Sequence: Synthetic peptide
  XENP018226 vlCDR1
RASQSVSNDVA

SEQ ID NO: 17649 - protein, 7 aa, Artificial Sequence
  Description of Artificial Sequence: Synthetic peptide
  XENP018226 vlCDR2
YASHRYT

SEQ ID NO: 17650 - protein, 9 aa, Artificial Sequence
  Description of Artificial Sequence: Synthetic peptide
  XENP018226 vlCDR3
QQDYSSPRT

SEQ ID NO: 17651 - protein, 451 aa, Artificial Sequence
  Description of Artificial Sequence: Synthetic polypeptide
  XENP018227 1G6_H1.126_L1_IgG1_PVA_/S267K Heavy Chain
EVQLVESGGGLVKPGGSLRLSCAASGFTFSNYWMNWVRQAPGKGLEWVGEIRLKSNNDATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 17652 - protein, 122 aa, Artificial Sequence; identical to SEQ ID NO: 12161
  Description of Artificial Sequence: Synthetic polypeptide
  VH of XENP018227

SEQ ID NO: 17653 - protein, 5 aa, Artificial Sequence
  Description of Artificial Sequence: Synthetic peptide
  XENP018227 vhCDR1
NYWMN

SEQ ID NO: 17654 - protein, 19 aa, Artificial Sequence
  Description of Artificial Sequence: Synthetic peptide
  XENP018227 vhCDR2
EIRLKSNNDATHYAEPVKG

SEQ ID NO: 17655 - protein, 11 aa, Artificial Sequence
  Description of Artificial Sequence: Synthetic peptide
  XENP018227 vhCDR3
YYGNYGGYFDV

SEQ ID NO: 17656 - protein, 214 aa, Artificial Sequence; identical to SEQ ID NO: 16226
  Description of Artificial Sequence: Synthetic polypeptide
  XENP018227 1G6_H1.126_L1_IgG1_PVA_/S267K Light Chain

SEQ ID NO: 17657 - protein, 107 aa, Artificial Sequence; identical to SEQ ID NO: 10923
  Description of Artificial Sequence: Synthetic polypeptide
  VL of XENP018227

SEQ ID NO: 17658 - protein, 11 aa, Artificial Sequence
  Description of Artificial Sequence: Synthetic peptide
  XENP018227 vlCDR1
RASQSVSNDVA

SEQ ID NO: 17659 - protein, 7 aa, Artificial Sequence
  Description of Artificial Sequence: Synthetic peptide
  XENP018227 vlCDR2
YASHRYT

SEQ ID NO: 17660 - protein, 9 aa, Artificial Sequence
  Description of Artificial Sequence: Synthetic peptide
  XENP018227 vlCDR3
QQDYSSPRT

SEQ ID NO: 17661 - protein, 451 aa, Artificial Sequence
  Description of Artificial Sequence: Synthetic polypeptide
  XENP018228 1G6_H1.127_L1_IgG1_PVA_/S267K Heavy Chain
EVQLVESGGGLVKPGGSLRLSCAASGFTFSNYWMNWVRQAPGKGLEWVGEIRLKSNNKATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 17662 - protein, 122 aa, Artificial Sequence; identical to SEQ ID NO: 12170
  Description of Artificial Sequence: Synthetic polypeptide
  VH of XENP018228

SEQ ID NO: 17663 - protein, 5 aa, Artificial Sequence
  Description of Artificial Sequence: Synthetic peptide
  XENP018228 vhCDR1
NYWMN

SEQ ID NO: 17664 - protein, 19 aa, Artificial Sequence
  Description of Artificial Sequence: Synthetic peptide
  XENP018228 vhCDR2
EIRLKSNNKATHYAEPVKG

SEQ ID NO: 17665 - protein, 11 aa, Artificial Sequence
  Description of Artificial Sequence: Synthetic peptide
  XENP018228 vhCDR3
YYGNYGGYFDV

SEQ ID NO: 17666 - protein, 214 aa, Artificial Sequence; identical to SEQ ID NO: 16226
  Description of Artificial Sequence: Synthetic polypeptide
  XENP018228 1G6_H1.127_L1_IgG1_PVA_/S267K Light Chain

SEQ ID NO: 17667 - protein, 107 aa, Artificial Sequence; identical to SEQ ID NO: 10923
  Description of Artificial Sequence: Synthetic polypeptide
  VL of XENP018228

SEQ ID NO: 17668 - protein, 11 aa, Artificial Sequence
  Description of Artificial Sequence: Synthetic peptide
  XENP018228 vlCDR1
RASQSVSNDVA

SEQ ID NO: 17669 - protein, 7 aa, Artificial Sequence
  Description of Artificial Sequence: Synthetic peptide
  XENP018228 vlCDR2
YASHRYT

SEQ ID NO: 17670 - protein, 9 aa, Artificial Sequence
  Description of Artificial Sequence: Synthetic peptide
  XENP018228 vlCDR3
QQDYSSPRT

SEQ ID NO: 17671 - protein, 451 aa, Artificial Sequence
  Description of Artificial Sequence: Synthetic polypeptide
  XENP018229 1G6_H1.128_L1_IgG1_PVA_/S267K Heavy Chain
EVQLVESGGGLVKPGGSLRLSCAASGFTFSNYWMNWVRQAPGKGLEWVGEIRLKSNNYGTHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 17672 - protein, 122 aa, Artificial Sequence; identical to SEQ ID NO: 12179
  Description of Artificial Sequence: Synthetic polypeptide
  VH of XENP018229

SEQ ID NO: 17673 - protein, 5 aa, Artificial Sequence
  Description of Artificial Sequence: Synthetic peptide
  XENP018229 vhCDR1
NYWMN

SEQ ID NO: 17674 - protein, 19 aa, Artificial Sequence
  Description of Artificial Sequence: Synthetic peptide
  XENP018229 vhCDR2
EIRLKSNNYGTHYAEPVKG

SEQ ID NO: 17675 - protein, 11 aa, Artificial Sequence
  Description of Artificial Sequence: Synthetic peptide
  XENP018229 vhCDR3
YYGNYGGYFDV

SEQ ID NO: 17676 - protein, 214 aa, Artificial Sequence; identical to SEQ ID NO: 16226
  Description of Artificial Sequence: Synthetic polypeptide
  XENP018229 1G6_H1.128_L1_IgG1_PVA_/S267K Light Chain

SEQ ID NO: 17677 - protein, 107 aa, Artificial Sequence; identical to SEQ ID NO: 10923
  Description of Artificial Sequence: Synthetic polypeptide
  VL of XENP018229

SEQ ID NO: 17678 - protein, 11 aa, Artificial Sequence
  Description of Artificial Sequence: Synthetic peptide
  XENP018229 vlCDR1
RASQSVSNDVA

SEQ ID NO: 17679 - protein, 7 aa, Artificial Sequence
  Description of Artificial Sequence: Synthetic peptide
  XENP018229 vlCDR2
YASHRYT

SEQ ID NO: 17680 - protein, 9 aa, Artificial Sequence
  Description of Artificial Sequence: Synthetic peptide
  XENP018229 vlCDR3
QQDYSSPRT

SEQ ID NO: 17681 - protein, 451 aa, Artificial Sequence
  Description of Artificial Sequence: Synthetic polypeptide
  XENP018230 1G6_H1.129_L1_IgG1_PVA_/S267K Heavy Chain
EVQLVESGGGLVKPGGSLRLSCAASGFTFSNYWMNWVRQAPGKGLEWVGEIRLKSNNYHTHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 17682 - protein, 122 aa, Artificial Sequence; identical to SEQ ID NO: 12188
  Description of Artificial Sequence: Synthetic polypeptide
  VH of XENP018230

SEQ ID NO: 17683 - protein, 5 aa, Artificial Sequence
  Description of Artificial Sequence: Synthetic peptide
  XENP018230 vhCDR1
NYWMN

SEQ ID NO: 17684 - protein, 19 aa, Artificial Sequence
  Description of Artificial Sequence: Synthetic peptide
  XENP018230 vhCDR2
EIRLKSNNYHTHYAEPVKG

SEQ ID NO: 17685 - protein, 11 aa, Artificial Sequence
  Description of Artificial Sequence: Synthetic peptide
  XENP018230 vhCDR3
YYGNYGGYFDV

SEQ ID NO: 17686 - protein, 214 aa, Artificial Sequence; identical to SEQ ID NO: 16226
  Description of Artificial Sequence: Synthetic polypeptide
  XENP018230 1G6_H1.129_L1_IgG1_PVA_/S267K Light Chain

SEQ ID NO: 17687 - protein, 107 aa, Artificial Sequence; identical to SEQ ID NO: 10923
  Description of Artificial Sequence: Synthetic polypeptide
  VL of XENP018230

SEQ ID NO: 17688 - protein, 11 aa, Artificial Sequence
  Description of Artificial Sequence: Synthetic peptide
  XENP018230 vlCDR1
RASQSVSNDVA

SEQ ID NO: 17689 - protein, 7 aa, Artificial Sequence
  Description of Artificial Sequence: Synthetic peptide
  XENP018230 vlCDR2
YASHRYT

SEQ ID NO: 17690 - protein, 9 aa, Artificial Sequence
  Description of Artificial Sequence: Synthetic peptide
  XENP018230 vlCDR3
QQDYSSPRT

SEQ ID NO: 17691 - protein, 451 aa, Artificial Sequence
  Description of Artificial Sequence: Synthetic polypeptide
  XENP018231 1G6_H1.130_L1_IgG1_PVA_/S267K Heavy Chain
EVQLVESGGGLVKPGGSLRLSCAASGFTFSNYWMNWVRQAPGKGLEWVGEIRLKSNNYQTHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 17692 - protein, 122 aa, Artificial Sequence; identical to SEQ ID NO: 12197
  Description of Artificial Sequence: Synthetic polypeptide
  VH of XENP018231

SEQ ID NO: 17693 - protein, 5 aa, Artificial Sequence
  Description of Artificial Sequence: Synthetic peptide
  XENP018231 vhCDR1
NYWMN

SEQ ID NO: 17694 - protein, 19 aa, Artificial Sequence
  Description of Artificial Sequence: Synthetic peptide
  XENP018231 vhCDR2
EIRLKSNNYQTHYAEPVKG

SEQ ID NO: 17695 - protein, 11 aa, Artificial Sequence
  Description of Artificial Sequence: Synthetic peptide
  XENP018231 vhCDR3
YYGNYGGYFDV

SEQ ID NO: 17696 - protein, 214 aa, Artificial Sequence; identical to SEQ ID NO: 16226
  Description of Artificial Sequence: Synthetic polypeptide
  XENP018231 1G6_H1.130_L1_IgG1_PVA_/S267K Light Chain

SEQ ID NO: 17697 - protein, 107 aa, Artificial Sequence; identical to SEQ ID NO: 10923
  Description of Artificial Sequence: Synthetic polypeptide
  VL of XENP018231

SEQ ID NO: 17698 - protein, 11 aa, Artificial Sequence
  Description of Artificial Sequence: Synthetic peptide
  XENP018231 vlCDR1
RASQSVSNDVA

SEQ ID NO: 17699 - protein, 7 aa, Artificial Sequence
  Description of Artificial Sequence: Synthetic peptide
  XENP018231 vlCDR2
YASHRYT

SEQ ID NO: 17700 - protein, 9 aa, Artificial Sequence
  Description of Artificial Sequence: Synthetic peptide
  XENP018231 vlCDR3
QQDYSSPRT

SEQ ID NO: 17701 - protein, 451 aa, Artificial Sequence
  Description of Artificial Sequence: Synthetic polypeptide
  XENP018232 1G6_H1.131_L1_IgG1_PVA_/S267K Heavy Chain
EVQLVESGGGLVKPGGSLRLSCAASGFTFSNYWMNWVRQAPGKGLEWVGEIRLKSNNYDTHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 17702 - protein, 122 aa, Artificial Sequence; identical to SEQ ID NO: 12206
  Description of Artificial Sequence: Synthetic polypeptide
  VH of XENP018232

SEQ ID NO: 17703 - protein, 5 aa, Artificial Sequence
  Description of Artificial Sequence: Synthetic peptide
  XENP018232 vhCDR1
NYWMN

SEQ ID NO: 17704 - protein, 19 aa, Artificial Sequence
  Description of Artificial Sequence: Synthetic peptide
  XENP018232 vhCDR2
EIRLKSNNYDTHYAEPVKG

SEQ ID NO: 17705 - protein, 11 aa, Artificial Sequence
  Description of Artificial Sequence: Synthetic peptide
  XENP018232 vhCDR3
YYGNYGGYFDV

SEQ ID NO: 17706 - protein, 214 aa, Artificial Sequence; identical to SEQ ID NO: 16226
  Description of Artificial Sequence: Synthetic polypeptide
  XENP018232 1G6_H1.131_L1_IgG1_PVA_/S267K Light Chain

SEQ ID NO: 17707 - protein, 107 aa, Artificial Sequence; identical to SEQ ID NO: 10923
  Description of Artificial Sequence: Synthetic polypeptide
  VL of XENP018232

SEQ ID NO: 17708 - protein, 11 aa, Artificial Sequence
  Description of Artificial Sequence: Synthetic peptide
  XENP018232 vlCDR1
RASQSVSNDVA

SEQ ID NO: 17709 - protein, 7 aa, Artificial Sequence
  Description of Artificial Sequence: Synthetic peptide
  XENP018232 vlCDR2
YASHRYT

SEQ ID NO: 17710 - protein, 9 aa, Artificial Sequence
  Description of Artificial Sequence: Synthetic peptide
  XENP018232 vlCDR3
QQDYSSPRT

SEQ ID NO: 17711 - protein, 451 aa, Artificial Sequence
  Description of Artificial Sequence: Synthetic polypeptide
  XENP018233 1G6_H1.132_L1_IgG1_PVA_/S267K Heavy Chain
EVQLVESGGGLVKPGGSLRLSCAASGFTFSNYWMNWVRQAPGKGLEWVGEIRLKSNNYLTHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 17712 - protein, 122 aa, Artificial Sequence; identical to SEQ ID NO: 12215
  Description of Artificial Sequence: Synthetic polypeptide
  VH of XENP018233

SEQ ID NO: 17713 - protein, 5 aa, Artificial Sequence
  Description of Artificial Sequence: Synthetic peptide
  XENP018233 vhCDR1
NYWMN

SEQ ID NO: 17714 - protein, 19 aa, Artificial Sequence
  Description of Artificial Sequence: Synthetic peptide
  XENP018233 vhCDR2
EIRLKSNNYLTHYAEPVKG

SEQ ID NO: 17715 - protein, 11 aa, Artificial Sequence
  Description of Artificial Sequence: Synthetic peptide
  XENP018233 vhCDR3
YYGNYGGYFDV

SEQ ID NO: 17716 - protein, 214 aa, Artificial Sequence; identical to SEQ ID NO: 16226
  Description of Artificial Sequence: Synthetic polypeptide
  XENP018233 1G6_H1.132_L1_IgG1_PVA_/S267K Light Chain

SEQ ID NO: 17717 - protein, 107 aa, Artificial Sequence; identical to SEQ ID NO: 10923
  Description of Artificial Sequence: Synthetic polypeptide
  VL of XENP018233

SEQ ID NO: 17718 - protein, 11 aa, Artificial Sequence
  Description of Artificial Sequence: Synthetic peptide
  XENP018233 vlCDR1
RASQSVSNDVA

SEQ ID NO: 17719 - protein, 7 aa, Artificial Sequence
  Description of Artificial Sequence: Synthetic peptide
  XENP018233 vlCDR2
YASHRYT

SEQ ID NO: 17720 - protein, 9 aa, Artificial Sequence
  Description of Artificial Sequence: Synthetic peptide
  XENP018233 vlCDR3
QQDYSSPRT

SEQ ID NO: 17721 - protein, 451 aa, Artificial Sequence
  Description of Artificial Sequence: Synthetic polypeptide
  XENP018234 1G6_H1.133_L1_IgG1_PVA_/S267K Heavy Chain
EVQLVESGGGLVKPGGSLRLSCAASGFTFSNYWMNWVRQAPGKGLEWVGEIRLKSNNYKTHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 17722 - protein, 122 aa, Artificial Sequence; identical to SEQ ID NO: 12224
  Description of Artificial Sequence: Synthetic polypeptide
  VH of XENP018234

SEQ ID NO: 17723 - protein, 5 aa, Artificial Sequence
  Description of Artificial Sequence: Synthetic peptide
  XENP018234 vhCDR1
NYWMN

SEQ ID NO: 17724 - protein, 19 aa, Artificial Sequence
  Description of Artificial Sequence: Synthetic peptide
  XENP018234 vhCDR2
EIRLKSNNYKTHYAEPVKG

SEQ ID NO: 17725 - protein, 11 aa, Artificial Sequence
  Description of Artificial Sequence: Synthetic peptide
  XENP018234 vhCDR3
YYGNYGGYFDV

SEQ ID NO: 17726 - protein, 214 aa, Artificial Sequence; identical to SEQ ID NO: 16226
  Description of Artificial Sequence: Synthetic polypeptide
  XENP018234 1G6_H1.133_L1_IgG1_PVA_/S267K Light Chain

SEQ ID NO: 17727 - protein, 107 aa, Artificial Sequence; identical to SEQ ID NO: 10923
  Description of Artificial Sequence: Synthetic polypeptide
  VL of XENP018234

SEQ ID NO: 17728 - protein, 11 aa, Artificial Sequence
  Description of Artificial Sequence: Synthetic peptide
  XENP018234 vlCDR1
RASQSVSNDVA

SEQ ID NO: 17729 - protein, 7 aa, Artificial Sequence
  Description of Artificial Sequence: Synthetic peptide
  XENP018234 vlCDR2
YASHRYT

SEQ ID NO: 17730 - protein, 9 aa, Artificial Sequence
  Description of Artificial Sequence: Synthetic peptide
  XENP018234 vlCDR3
QQDYSSPRT

SEQ ID NO: 17731 - protein, 451 aa, Artificial Sequence
  Description of Artificial Sequence: Synthetic polypeptide
  XENP018235 1G6_H1.134_L1_IgG1_PVA_/S267K Heavy Chain
EVQLVESGGGLVKPGGSLRLSCAASGFTFSNYWMNWVRQAPGKGLEWVGEIRLKSNNYYTHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 17732 - protein, 122 aa, Artificial Sequence; identical to SEQ ID NO: 12233
  Description of Artificial Sequence: Synthetic polypeptide
  VH of XENP018235

SEQ ID NO: 17733 - protein, 5 aa, Artificial Sequence
  Description of Artificial Sequence: Synthetic peptide
  XENP018235 vhCDR1
NYWMN

SEQ ID NO: 17734 - protein, 19 aa, Artificial Sequence
  Description of Artificial Sequence: Synthetic peptide
  XENP018235 vhCDR2
EIRLKSNNYYTHYAEPVKG

SEQ ID NO: 17735 - protein, 11 aa, Artificial Sequence
  Description of Artificial Sequence: Synthetic peptide
  XENP018235 vhCDR3
YYGNYGGYFDV

SEQ ID NO: 17736 - protein, 214 aa, Artificial Sequence; identical to SEQ ID NO: 16226
  Description of Artificial Sequence: Synthetic polypeptide
  XENP018235 1G6_H1.134_L1_IgG1_PVA_/S267K Light Chain

SEQ ID NO: 17737 - protein, 107 aa, Artificial Sequence; identical to SEQ ID NO: 10923
  Description of Artificial Sequence: Synthetic polypeptide
  VL of XENP018235

SEQ ID NO: 17738 - protein, 11 aa, Artificial Sequence
  Description of Artificial Sequence: Synthetic peptide
  XENP018235 vlCDR1
RASQSVSNDVA

SEQ ID NO: 17739 - protein, 7 aa, Artificial Sequence
  Description of Artificial Sequence: Synthetic peptide
  XENP018235 vlCDR2
YASHRYT

SEQ ID NO: 17740 - protein, 9 aa, Artificial Sequence
  Description of Artificial Sequence: Synthetic peptide
  XENP018235 vlCDR3
QQDYSSPRT

SEQ ID NO: 17741 - protein, 451 aa, Artificial Sequence
  Description of Artificial Sequence: Synthetic polypeptide
  XENP018236 1G6_H1.135_L1_IgG1_PVA_/S267K Heavy Chain
EVQLVESGGGLVKPGGSLRLSCAASGFTFSNYWMNWVRQAPGKGLEWVGEIRLKSNNYAKHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 17742 - protein, 122 aa, Artificial Sequence; identical to SEQ ID NO: 12242
  Description of Artificial Sequence: Synthetic polypeptide
  VH of XENP018236

SEQ ID NO: 17743 - protein, 5 aa, Artificial Sequence
  Description of Artificial Sequence: Synthetic peptide
  XENP018236 vhCDR1
NYWMN

SEQ ID NO: 17744 - protein, 19 aa, Artificial Sequence
  Description of Artificial Sequence: Synthetic peptide
  XENP018236 vhCDR2
EIRLKSNNYAKHYAEPVKG

SEQ ID NO: 17745 - protein, 11 aa, Artificial Sequence
  Description of Artificial Sequence: Synthetic peptide
  XENP018236 vhCDR3
YYGNYGGYFDV

SEQ ID NO: 17746 - protein, 214 aa, Artificial Sequence; identical to SEQ ID NO: 16226
  Description of Artificial Sequence: Synthetic polypeptide
  XENP018236 1G6_H1.135_L1_IgG1_PVA_/S267K Light Chain

SEQ ID NO: 17747 - protein, 107 aa, Artificial Sequence; identical to SEQ ID NO: 10923
  Description of Artificial Sequence: Synthetic polypeptide
  VL of XENP018236

SEQ ID NO: 17748 - protein, 11 aa, Artificial Sequence
  Description of Artificial Sequence: Synthetic peptide
  XENP018236 vlCDR1
RASQSVSNDVA

SEQ ID NO: 17749 - protein, 7 aa, Artificial Sequence
  Description of Artificial Sequence: Synthetic peptide
  XENP018236 vlCDR2
YASHRYT

SEQ ID NO: 17750 - protein, 9 aa, Artificial Sequence
  Description of Artificial Sequence: Synthetic peptide
  XENP018236 vlCDR3
QQDYSSPRT

SEQ ID NO: 17751 - protein, 451 aa, Artificial Sequence
  Description of Artificial Sequence: Synthetic polypeptide
  XENP018237 1G6_H1.136_L1_IgG1_PVA_/S267K Heavy Chain
EVQLVESGGGLVKPGGSLRLSCAASGFTFSNYWMNWVRQAPGKGLEWVGEIRLKSNNYAIHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 17752 - protein, 122 aa, Artificial Sequence; identical to SEQ ID NO: 12251
  Description of Artificial Sequence: Synthetic polypeptide
  VH of XENP018237

SEQ ID NO: 17753 - protein, 5 aa, Artificial Sequence
  Description of Artificial Sequence: Synthetic peptide
  XENP018237 vhCDR1
NYWMN

SEQ ID NO: 17754 - protein, 19 aa, Artificial Sequence
  Description of Artificial Sequence: Synthetic peptide
  XENP018237 vhCDR2
EIRLKSNNYAIHYAEPVKG

SEQ ID NO: 17755 - protein, 11 aa, Artificial Sequence
  Description of Artificial Sequence: Synthetic peptide
  XENP018237 vhCDR3
YYGNYGGYFDV

SEQ ID NO: 17756 - protein, 214 aa, Artificial Sequence; identical to SEQ ID NO: 16226
  Description of Artificial Sequence: Synthetic polypeptide
  XENP018237 1G6_H1.136_L1_IgG1_PVA_/S267K Light Chain

SEQ ID NO: 17757 - protein, 107 aa, Artificial Sequence; identical to SEQ ID NO: 10923
  Description of Artificial Sequence: Synthetic polypeptide
  VL of XENP018237

SEQ ID NO: 17758 - protein, 11 aa, Artificial Sequence
  Description of Artificial Sequence: Synthetic peptide
  XENP018237 vlCDR1
RASQSVSNDVA

SEQ ID NO: 17759 - protein, 7 aa, Artificial Sequence
  Description of Artificial Sequence: Synthetic peptide
  XENP018237 vlCDR2
YASHRYT

SEQ ID NO: 17760 - protein, 9 aa, Artificial Sequence
  Description of Artificial Sequence: Synthetic peptide
  XENP018237 vlCDR3
QQDYSSPRT

SEQ ID NO: 17761 - protein, 451 aa, Artificial Sequence
  Description of Artificial Sequence: Synthetic polypeptide
  XENP018238 1G6_H1.137_L1_IgG1_PVA_/S267K Heavy Chain
EVQLVESGGGLVKPGGSLRLSCAASGFTFSNYWMNWVRQAPGKGLEWVGEIRLKSNNYATYYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 17762 - protein, 122 aa, Artificial Sequence; identical to SEQ ID NO: 12260
  Description of Artificial Sequence: Synthetic polypeptide
  VH of XENP018238

SEQ ID NO: 17763 - protein, 5 aa, Artificial Sequence
  Description of Artificial Sequence: Synthetic peptide
  XENP018238 vhCDR1
NYWMN

SEQ ID NO: 17764 - protein, 19 aa, Artificial Sequence
  Description of Artificial Sequence: Synthetic peptide
  XENP018238 vhCDR2
EIRLKSNNYATYYAEPVKG

SEQ ID NO: 17765 - protein, 11 aa, Artificial Sequence
  Description of Artificial Sequence: Synthetic peptide
  XENP018238 vhCDR3
YYGNYGGYFDV

SEQ ID NO: 17766 - protein, 214 aa, Artificial Sequence; identical to SEQ ID NO: 16226
  Description of Artificial Sequence: Synthetic polypeptide
  XENP018238 1G6_H1.137_L1_IgG1_PVA_/S267K Light Chain

SEQ ID NO: 17767 - protein, 107 aa, Artificial Sequence; identical to SEQ ID NO: 10923
  Description of Artificial Sequence: Synthetic polypeptide
  VL of XENP018238

SEQ ID NO: 17768 - protein, 11 aa, Artificial Sequence
  Description of Artificial Sequence: Synthetic peptide
  XENP018238 vlCDR1
RASQSVSNDVA

SEQ ID NO: 17769 - protein, 7 aa, Artificial Sequence
  Description of Artificial Sequence: Synthetic peptide
  XENP018238 vlCDR2
YASHRYT

SEQ ID NO: 17770 - protein, 9 aa, Artificial Sequence
  Description of Artificial Sequence: Synthetic peptide
  XENP018238 vlCDR3
QQDYSSPRT

SEQ ID NO: 17771 - protein, 451 aa, Artificial Sequence
  Description of Artificial Sequence: Synthetic polypeptide
  XENP018239 1G6_H1.138_L1_IgG1_PVA_/S267K Heavy Chain
EVQLVESGGGLVKPGGSLRLSCAASGFTFSNYWMNWVRQAPGKGLEWVGEIRLKSNNYATQYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 17772 - protein, 122 aa, Artificial Sequence; identical to SEQ ID NO: 12269
  Description of Artificial Sequence: Synthetic polypeptide
  VH of XENP018239

SEQ ID NO: 17773 - protein, 5 aa, Artificial Sequence
  Description of Artificial Sequence: Synthetic peptide
  XENP018239 vhCDR1
NYWMN

SEQ ID NO: 17774 - protein, 19 aa, Artificial Sequence
  Description of Artificial Sequence: Synthetic peptide
  XENP018239 vhCDR2
EIRLKSNNYATQYAEPVKG

SEQ ID NO: 17775 - protein, 11 aa, Artificial Sequence
  Description of Artificial Sequence: Synthetic peptide
  XENP018239 vhCDR3
YYGNYGGYFDV

SEQ ID NO: 17776 - protein, 214 aa, Artificial Sequence; identical to SEQ ID NO: 16226
  Description of Artificial Sequence: Synthetic polypeptide
  XENP018239 1G6_H1.138_L1_IgG1_PVA_/S267K Light Chain

SEQ ID NO: 17777 - protein, 107 aa, Artificial Sequence; identical to SEQ ID NO: 10923
  Description of Artificial Sequence: Synthetic polypeptide
  VL of XENP018239

SEQ ID NO: 17778 - protein, 11 aa, Artificial Sequence
  Description of Artificial Sequence: Synthetic peptide
  XENP018239 vlCDR1
RASQSVSNDVA

SEQ ID NO: 17779 - protein, 7 aa, Artificial Sequence
  Description of Artificial Sequence: Synthetic peptide
  XENP018239 vlCDR2
YASHRYT

SEQ ID NO: 17780 - protein, 9 aa, Artificial Sequence
  Description of Artificial Sequence: Synthetic peptide
  XENP018239 vlCDR3
QQDYSSPRT

SEQ ID NO: 17781 - protein, 451 aa, Artificial Sequence
  Description of Artificial Sequence: Synthetic polypeptide
  XENP018240 1G6_H1.139_L1_IgG1_PVA_/S267K Heavy Chain
EVQLVESGGGLVKPGGSLRLSCAASGFTFSNYWMNWVRQAPGKGLEWVGEIRLKSNNYATDYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 17782 - protein, 122 aa, Artificial Sequence; identical to SEQ ID NO: 12278
  Description of Artificial Sequence: Synthetic polypeptide
  VH of XENP018240

SEQ ID NO: 17783 - protein, 5 aa, Artificial Sequence
  Description of Artificial Sequence: Synthetic peptide
  XENP018240 vhCDR1
NYWMN

SEQ ID NO: 17784 - protein, 19 aa, Artificial Sequence
  Description of Artificial Sequence: Synthetic peptide
  XENP018240 vhCDR2
EIRLKSNNYATDYAEPVKG

SEQ ID NO: 17785 - protein, 11 aa, Artificial Sequence
  Description of Artificial Sequence: Synthetic peptide
  XENP018240 vhCDR3
YYGNYGGYFDV

SEQ ID NO: 17786 - protein, 214 aa, Artificial Sequence; identical to SEQ ID NO: 16226
  Description of Artificial Sequence: Synthetic polypeptide
  XENP018240 1G6_H1.139_L1_IgG1_PVA_/S267K Light Chain

SEQ ID NO: 17787 - protein, 107 aa, Artificial Sequence; identical to SEQ ID NO: 10923
  Description of Artificial Sequence: Synthetic polypeptide
  VL of XENP018240

SEQ ID NO: 17788 - protein, 11 aa, Artificial Sequence
  Description of Artificial Sequence: Synthetic peptide
  XENP018240 vlCDR1
RASQSVSNDVA

SEQ ID NO: 17789 - protein, 7 aa, Artificial Sequence
  Description of Artificial Sequence: Synthetic peptide
  XENP018240 vlCDR2
YASHRYT

SEQ ID NO: 17790 - protein, 9 aa, Artificial Sequence
  Description of Artificial Sequence: Synthetic peptide
  XENP018240 vlCDR3
QQDYSSPRT

SEQ ID NO: 17791 - protein, 451 aa, Artificial Sequence
  Description of Artificial Sequence: Synthetic polypeptide
  XENP018241 1G6_H1.140_L1_IgG1_PVA_/S267K Heavy Chain
EVQLVESGGGLVKPGGSLRLSCAASGFTFSNYWMNWVRQAPGKGLEWVGEIRLKSNNYATFYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 17792 - protein, 122 aa, Artificial Sequence; identical to SEQ ID NO: 12287
  Description of Artificial Sequence: Synthetic polypeptide
  VH of XENP018241

SEQ ID NO: 17793 - protein, 5 aa, Artificial Sequence
  Description of Artificial Sequence: Synthetic peptide
  XENP018241 vhCDR1
NYWMN

SEQ ID NO: 17794 - protein, 19 aa, Artificial Sequence
  Description of Artificial Sequence: Synthetic peptide
  XENP018241 vhCDR2
EIRLKSNNYATFYAEPVKG

SEQ ID NO: 17795 - protein, 11 aa, Artificial Sequence
  Description of Artificial Sequence: Synthetic peptide
  XENP018241 vhCDR3
YYGNYGGYFDV

SEQ ID NO: 17796 - protein, 214 aa, Artificial Sequence; identical to SEQ ID NO: 16226
  Description of Artificial Sequence: Synthetic polypeptide
  XENP018241 1G6_H1.140_L1_IgG1_PVA_/S267K Light Chain

SEQ ID NO: 17797 - protein, 107 aa, Artificial Sequence; identical to SEQ ID NO: 10923
  Description of Artificial Sequence: Synthetic polypeptide
  VL of XENP018241

SEQ ID NO: 17798 - protein, 11 aa, Artificial Sequence
  Description of Artificial Sequence: Synthetic peptide
  XENP018241 vlCDR1
RASQSVSNDVA

SEQ ID NO: 17799 - protein, 7 aa, Artificial Sequence
  Description of Artificial Sequence: Synthetic peptide
  XENP018241 vlCDR2
YASHRYT

SEQ ID NO: 17800 - protein, 9 aa, Artificial Sequence
  Description of Artificial Sequence: Synthetic peptide
  XENP018241 vlCDR3
QQDYSSPRT

SEQ ID NO: 17801 - protein, 451 aa, Artificial Sequence
  Description of Artificial Sequence: Synthetic polypeptide
  XENP018242 1G6_H1.141_L1_IgG1_PVA_/S267K Heavy Chain
EVQLVESGGGLVKPGGSLRLSCAASGFTFSNYWMNWVRQAPGKGLEWVGEIRLKSNNYATAYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 17802 - protein, 122 aa, Artificial Sequence; identical to SEQ ID NO: 12296
  Description of Artificial Sequence: Synthetic polypeptide
  VH of XENP018242

SEQ ID NO: 17803 - protein, 5 aa, Artificial Sequence
  Description of Artificial Sequence: Synthetic peptide
  XENP018242 vhCDR1
NYWMN

SEQ ID NO: 17804 - protein, 19 aa, Artificial Sequence
  Description of Artificial Sequence: Synthetic peptide
  XENP018242 vhCDR2
EIRLKSNNYATAYAEPVKG

SEQ ID NO: 17805 - protein, 11 aa, Artificial Sequence
  Description of Artificial Sequence: Synthetic peptide
  XENP018242 vhCDR3
YYGNYGGYFDV

SEQ ID NO: 17806 - protein, 214 aa, Artificial Sequence; identical to SEQ ID NO: 16226
  Description of Artificial Sequence: Synthetic polypeptide
  XENP018242 1G6_H1.141_L1_IgG1_PVA_/S267K Light Chain

SEQ ID NO: 17807 - protein, 107 aa, Artificial Sequence; identical to SEQ ID NO: 10923
  Description of Artificial Sequence: Synthetic polypeptide
  VL of XENP018242

SEQ ID NO: 17808 - protein, 11 aa, Artificial Sequence
  Description of Artificial Sequence: Synthetic peptide
  XENP018242 vlCDR1
RASQSVSNDVA

SEQ ID NO: 17809 - protein, 7 aa, Artificial Sequence
  Description of Artificial Sequence: Synthetic peptide
  XENP018242 vlCDR2
YASHRYT

SEQ ID NO: 17810 - protein, 9 aa, Artificial Sequence
  Description of Artificial Sequence: Synthetic peptide
  XENP018242 vlCDR3
QQDYSSPRT

SEQ ID NO: 17811 - protein, 451 aa, Artificial Sequence
  Description of Artificial Sequence: Synthetic polypeptide
  XENP018243 1G6_H1.142_L1_IgG1_PVA_/S267K Heavy Chain
EVQLVESGGGLVKPGGSLRLSCAASGFTFSNYWMNWVRQAPGKGLEWVGEIRLKSNNYATTYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 17812 - protein, 122 aa, Artificial Sequence; identical to SEQ ID NO: 12305
  Description of Artificial Sequence: Synthetic polypeptide
  VH of XENP018243

SEQ ID NO: 17813 - protein, 5 aa, Artificial Sequence
  Description of Artificial Sequence: Synthetic peptide
  XENP018243 vhCDR1
NYWMN

SEQ ID NO: 17814 - protein, 19 aa, Artificial Sequence
  Description of Artificial Sequence: Synthetic peptide
  XENP018243 vhCDR2
EIRLKSNNYATTYAEPVKG

SEQ ID NO: 17815 - protein, 11 aa, Artificial Sequence
  Description of Artificial Sequence: Synthetic peptide
  XENP018243 vhCDR3
YYGNYGGYFDV

SEQ ID NO: 17816 - protein, 214 aa, Artificial Sequence; identical to SEQ ID NO: 16226
  Description of Artificial Sequence: Synthetic polypeptide
  XENP018243 1G6_H1.142_L1_IgG1_PVA_/S267K Light Chain

SEQ ID NO: 17817 - protein, 107 aa, Artificial Sequence; identical to SEQ ID NO: 10923
  Description of Artificial Sequence: Synthetic polypeptide
  VL of XENP018243

SEQ ID NO: 17818 - protein, 11 aa, Artificial Sequence
  Description of Artificial Sequence: Synthetic peptide
  XENP018243 vlCDR1
RASQSVSNDVA

SEQ ID NO: 17819 - protein, 7 aa, Artificial Sequence
  Description of Artificial Sequence: Synthetic peptide
  XENP018243 vlCDR2
YASHRYT

SEQ ID NO: 17820 - protein, 9 aa, Artificial Sequence
  Description of Artificial Sequence: Synthetic peptide
  XENP018243 vlCDR3
QQDYSSPRT

SEQ ID NO: 17821 - protein, 451 aa, Artificial Sequence
  Description of Artificial Sequence: Synthetic polypeptide
  XENP018244 1G6_H1.143_L1_IgG1_PVA_/S267K Heavy Chain
EVQLVESGGGLVKPGGSLRLSCAASGFTFSNYWMNWVRQAPGKGLEWVGEIRLKSNNYATKYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 17822 - protein, 122 aa, Artificial Sequence; identical to SEQ ID NO: 12314
  Description of Artificial Sequence: Synthetic polypeptide
  VH of XENP018244

SEQ ID NO: 17823 - protein, 5 aa, Artificial Sequence
  Description of Artificial Sequence: Synthetic peptide
  XENP018244 vhCDR1
NYWMN

SEQ ID NO: 17824 - protein, 19 aa, Artificial Sequence
  Description of Artificial Sequence: Synthetic peptide
  XENP018244 vhCDR2
EIRLKSNNYATKYAEPVKG

SEQ ID NO: 17825 - protein, 11 aa, Artificial Sequence
  Description of Artificial Sequence: Synthetic peptide
  XENP018244 vhCDR3
YYGNYGGYFDV

SEQ ID NO: 17826 - protein, 214 aa, Artificial Sequence; identical to SEQ ID NO: 16226
  Description of Artificial Sequence: Synthetic polypeptide
  XENP018244 1G6_H1.143_L1_IgG1_PVA_/S267K Light Chain

SEQ ID NO: 17827 - protein, 107 aa, Artificial Sequence; identical to SEQ ID NO: 10923
  Description of Artificial Sequence: Synthetic polypeptide
  VL of XENP018244

SEQ ID NO: 17828 - protein, 11 aa, Artificial Sequence
  Description of Artificial Sequence: Synthetic peptide
  XENP018244 vlCDR1
RASQSVSNDVA

SEQ ID NO: 17829 - protein, 7 aa, Artificial Sequence
  Description of Artificial Sequence: Synthetic peptide
  XENP018244 vlCDR2
YASHRYT

SEQ ID NO: 17830 - protein, 9 aa, Artificial Sequence
  Description of Artificial Sequence: Synthetic peptide
  XENP018244 vlCDR3
QQDYSSPRT

SEQ ID NO: 17831 - protein, 451 aa, Artificial Sequence
  Description of Artificial Sequence: Synthetic polypeptide
  XENP018245 1G6_H1.144_L1_IgG1_PVA_/S267K Heavy Chain
EVQLVESGGGLVKPGGSLRLSCAASGFTFSNYWMNWVRQAPGKGLEWVGEIRLKSNNYATGYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 17832 - protein, 122 aa, Artificial Sequence; identical to SEQ ID NO: 12323
  Description of Artificial Sequence: Synthetic polypeptide
  VH of XENP018245

SEQ ID NO: 17833 - protein, 5 aa, Artificial Sequence
  Description of Artificial Sequence: Synthetic peptide
  XENP018245 vhCDR1
NYWMN

SEQ ID NO: 17834 - protein, 19 aa, Artificial Sequence
  Description of Artificial Sequence: Synthetic peptide
  XENP018245 vhCDR2
EIRLKSNNYATGYAEPVKG

SEQ ID NO: 17835 - protein, 11 aa, Artificial Sequence
  Description of Artificial Sequence: Synthetic peptide
  XENP018245 vhCDR3
YYGNYGGYFDV

SEQ ID NO: 17836 - protein, 214 aa, Artificial Sequence; identical to SEQ ID NO: 16226
  Description of Artificial Sequence: Synthetic polypeptide
  XENP018245 1G6_H1.144_L1_IgG1_PVA_/S267K Light Chain

SEQ ID NO: 17837 - protein, 107 aa, Artificial Sequence; identical to SEQ ID NO: 10923
  Description of Artificial Sequence: Synthetic polypeptide
  VL of XENP018245

SEQ ID NO: 17838 - protein, 11 aa, Artificial Sequence
  Description of Artificial Sequence: Synthetic peptide
  XENP018245 vlCDR1
RASQSVSNDVA

SEQ ID NO: 17839 - protein, 7 aa, Artificial Sequence
  Description of Artificial Sequence: Synthetic peptide
  XENP018245 vlCDR2
YASHRYT

SEQ ID NO: 17840 - protein, 9 aa, Artificial Sequence
  Description of Artificial Sequence: Synthetic peptide
  XENP018245 vlCDR3
QQDYSSPRT

SEQ ID NO: 17841 - protein, 451 aa, Artificial Sequence
  Description of Artificial Sequence: Synthetic polypeptide
  XENP018246 1G6_H1.145_L1_IgG1_PVA_/S267K Heavy Chain
EVQLVESGGGLVKPGGSLRLSCAASGFTFSNYWMNWVRQAPGKGLEWVGEIRLKSNNYATLYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 17842 - protein, 122 aa, Artificial Sequence; identical to SEQ ID NO: 12332
  Description of Artificial Sequence: Synthetic polypeptide
  VH of XENP018246

SEQ ID NO: 17843 - protein, 5 aa, Artificial Sequence
  Description of Artificial Sequence: Synthetic peptide
  XENP018246 vhCDR1
NYWMN

SEQ ID NO: 17844 - protein, 19 aa, Artificial Sequence
  Description of Artificial Sequence: Synthetic peptide
  XENP018246 vhCDR2
EIRLKSNNYATLYAEPVKG

SEQ ID NO: 17845 - protein, 11 aa, Artificial Sequence
  Description of Artificial Sequence: Synthetic peptide
  XENP018246 vhCDR3
YYGNYGGYFDV

SEQ ID NO: 17846 - protein, 214 aa, Artificial Sequence; identical to SEQ ID NO: 16226
  Description of Artificial Sequence: Synthetic polypeptide
  XENP018246 1G6_H1.145_L1_IgG1_PVA_/S267K Light Chain

SEQ ID NO: 17847 - protein, 107 aa, Artificial Sequence; identical to SEQ ID NO: 10923
  Description of Artificial Sequence: Synthetic polypeptide
  VL of XENP018246

SEQ ID NO: 17848 - protein, 11 aa, Artificial Sequence
  Description of Artificial Sequence: Synthetic peptide
  XENP018246 vlCDR1
RASQSVSNDVA

SEQ ID NO: 17849 - protein, 7 aa, Artificial Sequence
  Description of Artificial Sequence: Synthetic peptide
  XENP018246 vlCDR2
YASHRYT

SEQ ID NO: 17850 - protein, 9 aa, Artificial Sequence
  Description of Artificial Sequence: Synthetic peptide
  XENP018246 vlCDR3
QQDYSSPRT

SEQ ID NO: 17851 - protein, 451 aa, Artificial Sequence
  Description of Artificial Sequence: Synthetic polypeptide
  XENP018247 1G6_H1.146_L1_IgG1_PVA_/S267K Heavy Chain
EVQLVESGGGLVKPGGSLRLSCAASGFTFSNYWMNWVRQAPGKGLEWVGEIRLKSNNYATHYPEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 17852 - protein, 122 aa, Artificial Sequence; identical to SEQ ID NO: 12341
  Description of Artificial Sequence: Synthetic polypeptide
  VH of XENP018247

SEQ ID NO: 17853 - protein, 5 aa, Artificial Sequence
  Description of Artificial Sequence: Synthetic peptide
  XENP018247 vhCDR1
NYWMN

SEQ ID NO: 17854 - protein, 19 aa, Artificial Sequence
  Description of Artificial Sequence: Synthetic peptide
  XENP018247 vhCDR2
EIRLKSNNYATHYPEPVKG

SEQ ID NO: 17855 - protein, 11 aa, Artificial Sequence
  Description of Artificial Sequence: Synthetic peptide
  XENP018247 vhCDR3
YYGNYGGYFDV

SEQ ID NO: 17856 - protein, 214 aa, Artificial Sequence; identical to SEQ ID NO: 16226
  Description of Artificial Sequence: Synthetic polypeptide
  XENP018247 1G6_H1.146_L1_IgG1_PVA_/S267K Light Chain

SEQ ID NO: 17857 - protein, 107 aa, Artificial Sequence; identical to SEQ ID NO: 10923
  Description of Artificial Sequence: Synthetic polypeptide
  VL of XENP018247

SEQ ID NO: 17858 - protein, 11 aa, Artificial Sequence
  Description of Artificial Sequence: Synthetic peptide
  XENP018247 vlCDR1
RASQSVSNDVA

SEQ ID NO: 17859 - protein, 7 aa, Artificial Sequence
  Description of Artificial Sequence: Synthetic peptide
  XENP018247 vlCDR2
YASHRYT

SEQ ID NO: 17860 - protein, 9 aa, Artificial Sequence
  Description of Artificial Sequence: Synthetic peptide
  XENP018247 vlCDR3
QQDYSSPRT

SEQ ID NO: 17861 - protein, 451 aa, Artificial Sequence
  Description of Artificial Sequence: Synthetic polypeptide
  XENP018248 1G6_H1.147_L1_IgG1_PVA_/S267K Heavy Chain
EVQLVESGGGLVKPGGSLRLSCAASGFTFSNYWMNWVRQAPGKGLEWVGEIRLKSNNYATHYVEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 17862 - protein, 122 aa, Artificial Sequence; identical to SEQ ID NO: 12350
  Description of Artificial Sequence: Synthetic polypeptide
  VH of XENP018248

SEQ ID NO: 17863 - protein, 5 aa, Artificial Sequence
  Description of Artificial Sequence: Synthetic peptide
  XENP018248 vhCDR1
NYWMN

SEQ ID NO: 17864 - protein, 19 aa, Artificial Sequence
  Description of Artificial Sequence: Synthetic peptide
  XENP018248 vhCDR2
EIRLKSNNYATHYVEPVKG

SEQ ID NO: 17865 - protein, 11 aa, Artificial Sequence
  Description of Artificial Sequence: Synthetic peptide
  XENP018248 vhCDR3
YYGNYGGYFDV

SEQ ID NO: 17866 - protein, 214 aa, Artificial Sequence; identical to SEQ ID NO: 16226
  Description of Artificial Sequence: Synthetic polypeptide
  XENP018248 1G6_H1.147_L1_IgG1_PVA_/S267K Light Chain

SEQ ID NO: 17867 - protein, 107 aa, Artificial Sequence; identical to SEQ ID NO: 10923
  Description of Artificial Sequence: Synthetic polypeptide
  VL of XENP018248

SEQ ID NO: 17868 - protein, 11 aa, Artificial Sequence
  Description of Artificial Sequence: Synthetic peptide
  XENP018248 vlCDR1
RASQSVSNDVA

SEQ ID NO: 17869 - protein, 7 aa, Artificial Sequence
  Description of Artificial Sequence: Synthetic peptide
  XENP018248 vlCDR2
YASHRYT

SEQ ID NO: 17870 - protein, 9 aa, Artificial Sequence
  Description of Artificial Sequence: Synthetic peptide
  XENP018248 vlCDR3
QQDYSSPRT

SEQ ID NO: 17871 - protein, 451 aa, Artificial Sequence
  Description of Artificial Sequence: Synthetic polypeptide
  XENP018249 1G6_H1.148_L1_IgG1_PVA_/S267K Heavy Chain
EVQLVESGGGLVKPGGSLRLSCAASGFTFSNYWMNWVRQAPGKGLEWVGEIRLKSNNYATHYADPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 17872 - protein, 122 aa, Artificial Sequence; identical to SEQ ID NO: 12359
  Description of Artificial Sequence: Synthetic polypeptide
  VH of XENP018249

SEQ ID NO: 17873 - protein, 5 aa, Artificial Sequence
  Description of Artificial Sequence: Synthetic peptide
  XENP018249 vhCDR1
NYWMN

SEQ ID NO: 17874 - protein, 19 aa, Artificial Sequence
  Description of Artificial Sequence: Synthetic peptide
  XENP018249 vhCDR2
EIRLKSNNYATHYADPVKG

SEQ ID NO: 17875 - protein, 11 aa, Artificial Sequence
  Description of Artificial Sequence: Synthetic peptide
  XENP018249 vhCDR3
YYGNYGGYFDV

SEQ ID NO: 17876 - protein, 214 aa, Artificial Sequence; identical to SEQ ID NO: 16226
  Description of Artificial Sequence: Synthetic polypeptide
  XENP018249 1G6_H1.148_L1_IgG1_PVA_/S267K Light Chain

SEQ ID NO: 17877 - protein, 107 aa, Artificial Sequence; identical to SEQ ID NO: 10923
  Description of Artificial Sequence: Synthetic polypeptide
  VL of XENP018249

SEQ ID NO: 17878 - protein, 11 aa, Artificial Sequence
  Description of Artificial Sequence: Synthetic peptide
  XENP018249 vlCDR1
RASQSVSNDVA

SEQ ID NO: 17879 - protein, 7 aa, Artificial Sequence
  Description of Artificial Sequence: Synthetic peptide
  XENP018249 vlCDR2
YASHRYT

SEQ ID NO: 17880 - protein, 9 aa, Artificial Sequence
  Description of Artificial Sequence: Synthetic peptide
  XENP018249 vlCDR3
QQDYSSPRT

SEQ ID NO: 17881 - protein, 451 aa, Artificial Sequence
  Description of Artificial Sequence: Synthetic polypeptide
  XENP018250 1G6_H1.149_L1_IgG1_PVA_/S267K Heavy Chain
EVQLVESGGGLVKPGGSLRLSCAASGFTFSNYWMNWVRQAPGKGLEWVGEIRLKSNNYATHYAGPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 17882 - protein, 122 aa, Artificial Sequence; identical to SEQ ID NO: 12368
  Description of Artificial Sequence: Synthetic polypeptide
  VH of XENP018250

SEQ ID NO: 17883 - protein, 5 aa, Artificial Sequence
  Description of Artificial Sequence: Synthetic peptide
  XENP018250 vhCDR1
NYWMN

SEQ ID NO: 17884 - protein, 19 aa, Artificial Sequence
  Description of Artificial Sequence: Synthetic peptide
  XENP018250 vhCDR2
EIRLKSNNYATHYAGPVKG

SEQ ID NO: 17885 - protein, 11 aa, Artificial Sequence
  Description of Artificial Sequence: Synthetic peptide
  XENP018250 vhCDR3
YYGNYGGYFDV

SEQ ID NO: 17886 - protein, 214 aa, Artificial Sequence; identical to SEQ ID NO: 16226
  Description of Artificial Sequence: Synthetic polypeptide
  XENP018250 1G6_H1.149_L1_IgG1_PVA_/S267K Light Chain

SEQ ID NO: 17887 - protein, 107 aa, Artificial Sequence; identical to SEQ ID NO: 10923
  Description of Artificial Sequence: Synthetic polypeptide
  VL of XENP018250

SEQ ID NO: 17888 - protein, 11 aa, Artificial Sequence
  Description of Artificial Sequence: Synthetic peptide
  XENP018250 vlCDR1
RASQSVSNDVA

SEQ ID NO: 17889 - protein, 7 aa, Artificial Sequence
  Description of Artificial Sequence: Synthetic peptide
  XENP018250 vlCDR2
YASHRYT

SEQ ID NO: 17890 - protein, 9 aa, Artificial Sequence
  Description of Artificial Sequence: Synthetic peptide
  XENP018250 vlCDR3
QQDYSSPRT

SEQ ID NO: 17891 - protein, 451 aa, Artificial Sequence
  Description of Artificial Sequence: Synthetic polypeptide
  XENP018251 1G6_H1.150_L1_IgG1_PVA_/S267K Heavy Chain
EVQLVESGGGLVKPGGSLRLSCAASGFTFSNYWMNWVRQAPGKGLEWVGEIRLKSNNYATHYAAPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 17892 - protein, 122 aa, Artificial Sequence; identical to SEQ ID NO: 12377
  Description of Artificial Sequence: Synthetic polypeptide
  VH of XENP018251

SEQ ID NO: 17893 - protein, 5 aa, Artificial Sequence
  Description of Artificial Sequence: Synthetic peptide
  XENP018251 vhCDR1
NYWMN

SEQ ID NO: 17894 - protein, 19 aa, Artificial Sequence
  Description of Artificial Sequence: Synthetic peptide
  XENP018251 vhCDR2
EIRLKSNNYATHYAAPVKG

SEQ ID NO: 17895 - protein, 11 aa, Artificial Sequence
  Description of Artificial Sequence: Synthetic peptide
  XENP018251 vhCDR3
YYGNYGGYFDV

SEQ ID NO: 17896 - protein, 214 aa, Artificial Sequence; identical to SEQ ID NO: 16226
  Description of Artificial Sequence: Synthetic polypeptide
  XENP018251 1G6_H1.150_L1_IgG1_PVA_/S267K Light Chain

SEQ ID NO: 17897 - protein, 107 aa, Artificial Sequence; identical to SEQ ID NO: 10923
  Description of Artificial Sequence: Synthetic polypeptide
  VL of XENP018251

SEQ ID NO: 17898 - protein, 11 aa, Artificial Sequence
  Description of Artificial Sequence: Synthetic peptide
  XENP018251 vlCDR1
RASQSVSNDVA

SEQ ID NO: 17899 - protein, 7 aa, Artificial Sequence
  Description of Artificial Sequence: Synthetic peptide
  XENP018251 vlCDR2
YASHRYT

SEQ ID NO: 17900 - protein, 9 aa, Artificial Sequence
  Description of Artificial Sequence: Synthetic peptide
  XENP018251 vlCDR3
QQDYSSPRT

SEQ ID NO: 17901 - protein, 451 aa, Artificial Sequence
  Description of Artificial Sequence: Synthetic polypeptide
  XENP018252 1G6_H1.151_L1_IgG1_PVA_/S267K Heavy Chain
EVQLVESGGGLVKPGGSLRLSCAASGFTFSNYWMNWVRQAPGKGLEWVGEIRLKSNNYATHYAESVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 17902 - protein, 122 aa, Artificial Sequence; identical to SEQ ID NO: 12386
  Description of Artificial Sequence: Synthetic polypeptide
  VH of XENP018252

SEQ ID NO: 17903 - protein, 5 aa, Artificial Sequence
  Description of Artificial Sequence: Synthetic peptide
  XENP018252 vhCDR1
NYWMN

SEQ ID NO: 17904 - protein, 19 aa, Artificial Sequence
  Description of Artificial Sequence: Synthetic peptide
  XENP018252 vhCDR2
EIRLKSNNYATHYAESVKG

SEQ ID NO: 17905 - protein, 11 aa, Artificial Sequence
  Description of Artificial Sequence: Synthetic peptide
  XENP018252 vhCDR3
YYGNYGGYFDV

SEQ ID NO: 17906 - protein, 214 aa, Artificial Sequence; identical to SEQ ID NO: 16226
  Description of Artificial Sequence: Synthetic polypeptide
  XENP018252 1G6_H1.151_L1_IgG1_PVA_/S267K Light Chain

SEQ ID NO: 17907 - protein, 107 aa, Artificial Sequence; identical to SEQ ID NO: 10923
  Description of Artificial Sequence: Synthetic polypeptide
  VL of XENP018252

SEQ ID NO: 17908 - protein, 11 aa, Artificial Sequence
  Description of Artificial Sequence: Synthetic peptide
  XENP018252 vlCDR1
RASQSVSNDVA

SEQ ID NO: 17909 - protein, 7 aa, Artificial Sequence
  Description of Artificial Sequence: Synthetic peptide
  XENP018252 vlCDR2
YASHRYT

SEQ ID NO: 17910 - protein, 9 aa, Artificial Sequence
  Description of Artificial Sequence: Synthetic peptide
  XENP018252 vlCDR3
QQDYSSPRT

SEQ ID NO: 17911 - protein, 451 aa, Artificial Sequence
  Description of Artificial Sequence: Synthetic polypeptide
  XENP018253 1G6_H1.152_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDNSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 17912 - protein, 122 aa, Artificial Sequence; identical to SEQ ID NO: 12395
  Description of Artificial Sequence: Synthetic polypeptide
  VH of XENP018253

SEQ ID NO: 17913 - protein, 5 aa, Artificial Sequence
  Description of Artificial Sequence: Synthetic peptide
  XENP018253 vhCDR1
NYWMN

SEQ ID NO: 17914 - protein, 19 aa, Artificial Sequence
  Description of Artificial Sequence: Synthetic peptide
  XENP018253 vhCDR2
EIRLKSNNYATHYAEPVKG

SEQ ID NO: 17915 - protein, 11 aa, Artificial Sequence
  Description of Artificial Sequence: Synthetic peptide
  XENP018253 vhCDR3
YYGNYGGYFDV

SEQ ID NO: 17916 - protein, 214 aa, Artificial Sequence; identical to SEQ ID NO: 16226
  Description of Artificial Sequence: Synthetic polypeptide
  XENP018253 1G6_H1.152_L1_IgG1_PVA_/S267K Light Chain

SEQ ID NO: 17917 - protein, 107 aa, Artificial Sequence; identical to SEQ ID NO: 10923
  Description of Artificial Sequence: Synthetic polypeptide
  VL of XENP018253

SEQ ID NO: 17918 - protein, 11 aa, Artificial Sequence
  Description of Artificial Sequence: Synthetic peptide
  XENP018253 vlCDR1
RASQSVSNDVA

SEQ ID NO: 17919 - protein, 7 aa, Artificial Sequence
  Description of Artificial Sequence: Synthetic peptide
  XENP018253 vlCDR2
YASHRYT

SEQ ID NO: 17920 - protein, 9 aa, Artificial Sequence
  Description of Artificial Sequence: Synthetic peptide
  XENP018253 vlCDR3
QQDYSSPRT

SEQ ID NO: 17921 - protein, 451 aa, Artificial Sequence
  Description of Artificial Sequence: Synthetic polypeptide
  XENP018254 1G6_H1.153_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKNTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 17922 - protein, 122 aa, Artificial Sequence; identical to SEQ ID NO: 12404
  Description of Artificial Sequence: Synthetic polypeptide
  VH of XENP018254

SEQ ID NO: 17923 - protein, 5 aa, Artificial Sequence
  Description of Artificial Sequence: Synthetic peptide
  XENP018254 vhCDR1
NYWMN

SEQ ID NO: 17924 - protein, 19 aa, Artificial Sequence
  Description of Artificial Sequence: Synthetic peptide
  XENP018254 vhCDR2
EIRLKSNNYATHYAEPVKG

SEQ ID NO: 17925 - protein, 11 aa, Artificial Sequence
  Description of Artificial Sequence: Synthetic peptide
  XENP018254 vhCDR3
YYGNYGGYFDV

SEQ ID NO: 17926 - protein, 214 aa, Artificial Sequence; identical to SEQ ID NO: 16226
  Description of Artificial Sequence: Synthetic polypeptide
  XENP018254 1G6_H1.153_L1_IgG1_PVA_/S267K Light Chain

SEQ ID NO: 17927 - protein, 107 aa, Artificial Sequence; identical to SEQ ID NO: 10923
  Description of Artificial Sequence: Synthetic polypeptide
  VL of XENP018254

SEQ ID NO: 17928 - protein, 11 aa, Artificial Sequence
  Description of Artificial Sequence: Synthetic peptide
  XENP018254 vlCDR1
RASQSVSNDVA

SEQ ID NO: 17929 - protein, 7 aa, Artificial Sequence
  Description of Artificial Sequence: Synthetic peptide
  XENP018254 vlCDR2
YASHRYT

SEQ ID NO: 17930 - protein, 9 aa, Artificial Sequence
  Description of Artificial Sequence: Synthetic peptide
  XENP018254 vlCDR3
QQDYSSPRT

SEQ ID NO: 17931 - protein, 451 aa, Artificial Sequence
  Description of Artificial Sequence: Synthetic polypeptide
  XENP018255 1G6_H1.154_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSSVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 17932 - protein, 122 aa, Artificial Sequence; identical to SEQ ID NO: 12413
  Description of Artificial Sequence: Synthetic polypeptide
  VH of XENP018255

SEQ ID NO: 17933 - protein, 5 aa, Artificial Sequence
  Description of Artificial Sequence: Synthetic peptide
  XENP018255 vhCDR1
NYWMN

SEQ ID NO: 17934 - protein, 19 aa, Artificial Sequence
  Description of Artificial Sequence: Synthetic peptide
  XENP018255 vhCDR2
EIRLKSNNYATHYAEPVKG

SEQ ID NO: 17935 - protein, 11 aa, Artificial Sequence
  Description of Artificial Sequence: Synthetic peptide
  XENP018255 vhCDR3
YYGNYGGYFDV

SEQ ID NO: 17936 - protein, 214 aa, Artificial Sequence; identical to SEQ ID NO: 16226
  Description of Artificial Sequence: Synthetic polypeptide
  XENP018255 1G6_H1.154_L1_IgG1_PVA_/S267K Light Chain

SEQ ID NO: 17937 - protein, 107 aa, Artificial Sequence; identical to SEQ ID NO: 10923
  Description of Artificial Sequence: Synthetic polypeptide
  VL of XENP018255

SEQ ID NO: 17938 - protein, 11 aa, Artificial Sequence
  Description of Artificial Sequence: Synthetic peptide
  XENP018255 vlCDR1
RASQSVSNDVA

SEQ ID NO: 17939 - protein, 7 aa, Artificial Sequence
  Description of Artificial Sequence: Synthetic peptide
  XENP018255 vlCDR2
YASHRYT

SEQ ID NO: 17940 - protein, 9 aa, Artificial Sequence
  Description of Artificial Sequence: Synthetic peptide
  XENP018255 vlCDR3
QQDYSSPRT

SEQ ID NO: 17941 - protein, 451 aa, Artificial Sequence
  Description of Artificial Sequence: Synthetic polypeptide
  XENP018256 1G6_H1.155_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSTLYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 17942 - protein, 122 aa, Artificial Sequence; identical to SEQ ID NO: 12422
  Description of Artificial Sequence: Synthetic polypeptide
  VH of XENP018256

SEQ ID NO: 17943 - protein, 5 aa, Artificial Sequence
  Description of Artificial Sequence: Synthetic peptide
  XENP018256 vhCDR1
NYWMN

SEQ ID NO: 17944 - protein, 19 aa, Artificial Sequence
  Description of Artificial Sequence: Synthetic peptide
  XENP018256 vhCDR2
EIRLKSNNYATHYAEPVKG

SEQ ID NO: 17945 - protein, 11 aa, Artificial Sequence
  Description of Artificial Sequence: Synthetic peptide
  XENP018256 vhCDR3
YYGNYGGYFDV

SEQ ID NO: 17946 - protein, 214 aa, Artificial Sequence; identical to SEQ ID NO: 16226
  Description of Artificial Sequence: Synthetic polypeptide
  XENP018256 1G6_H1.155_L1_IgG1_PVA_/S267K Light Chain

SEQ ID NO: 17947 - protein, 107 aa, Artificial Sequence; identical to SEQ ID NO: 10923
  Description of Artificial Sequence: Synthetic polypeptide
  VL of XENP018256

SEQ ID NO: 17948 - protein, 11 aa, Artificial Sequence
  Description of Artificial Sequence: Synthetic peptide
  XENP018256 vlCDR1
RASQSVSNDVA

SEQ ID NO: 17949 - protein, 7 aa, Artificial Sequence
  Description of Artificial Sequence: Synthetic peptide
  XENP018256 vlCDR2
YASHRYT

SEQ ID NO: 17950 - protein, 9 aa, Artificial Sequence
  Description of Artificial Sequence: Synthetic peptide
  XENP018256 vlCDR3
QQDYSSPRT

SEQ ID NO: 17951 - protein, 451 aa, Artificial Sequence
  Description of Artificial Sequence: Synthetic polypeptide
  XENP018257 1G6_H1.156_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSTAYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 17952 - protein, 122 aa, Artificial Sequence; identical to SEQ ID NO: 12431
  Description of Artificial Sequence: Synthetic polypeptide
  VH of XENP018257

SEQ ID NO: 17953 - protein, 5 aa, Artificial Sequence
  Description of Artificial Sequence: Synthetic peptide
  XENP018257 vhCDR1
NYWMN

SEQ ID NO: 17954 - protein, 19 aa, Artificial Sequence
  Description of Artificial Sequence: Synthetic peptide
  XENP018257 vhCDR2
EIRLKSNNYATHYAEPVKG

SEQ ID NO: 17955 - protein, 11 aa, Artificial Sequence
  Description of Artificial Sequence: Synthetic peptide
  XENP018257 vhCDR3
YYGNYGGYFDV

SEQ ID NO: 17956 - protein, 214 aa, Artificial Sequence; identical to SEQ ID NO: 16226
  Description of Artificial Sequence: Synthetic polypeptide
  XENP018257 1G6_H1.156_L1_IgG1_PVA_/S267K Light Chain

SEQ ID NO: 17957 - protein, 107 aa, Artificial Sequence; identical to SEQ ID NO: 10923
  Description of Artificial Sequence: Synthetic polypeptide
  VL of XENP018257

SEQ ID NO: 17958 - protein, 11 aa, Artificial Sequence
  Description of Artificial Sequence: Synthetic peptide
  XENP018257 vlCDR1
RASQSVSNDVA

SEQ ID NO: 17959 - protein, 7 aa, Artificial Sequence
  Description of Artificial Sequence: Synthetic peptide
  XENP018257 vlCDR2
YASHRYT

SEQ ID NO: 17960 - protein, 9 aa, Artificial Sequence
  Description of Artificial Sequence: Synthetic peptide
  XENP018257 vlCDR3
QQDYSSPRT

SEQ ID NO: 17961 - protein, 451 aa, Artificial Sequence
  Description of Artificial Sequence: Synthetic polypeptide
  XENP018258 1G6_H1.157_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSTVYLQMNNLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 17962 - protein, 122 aa, Artificial Sequence; identical to SEQ ID NO: 12440
  Description of Artificial Sequence: Synthetic polypeptide
  VH of XENP018258

SEQ ID NO: 17963 - protein, 5 aa, Artificial Sequence
  Description of Artificial Sequence: Synthetic peptide
  XENP018258 vhCDR1
NYWMN

SEQ ID NO: 17964 - protein, 19 aa, Artificial Sequence
  Description of Artificial Sequence: Synthetic peptide
  XENP018258 vhCDR2
EIRLKSNNYATHYAEPVKG

SEQ ID NO: 17965 - protein, 11 aa, Artificial Sequence
  Description of Artificial Sequence: Synthetic peptide
  XENP018258 vhCDR3
YYGNYGGYFDV

SEQ ID NO: 17966 - protein, 214 aa, Artificial Sequence; identical to SEQ ID NO: 16226
  Description of Artificial Sequence: Synthetic polypeptide
  XENP018258 1G6_H1.157_L1_IgG1_PVA_/S267K Light Chain

SEQ ID NO: 17967 - protein, 107 aa, Artificial Sequence; identical to SEQ ID NO: 10923
  Description of Artificial Sequence: Synthetic polypeptide
  VL of XENP018258

SEQ ID NO: 17968 - protein, 11 aa, Artificial Sequence
  Description of Artificial Sequence: Synthetic peptide
  XENP018258 vlCDR1
RASQSVSNDVA

SEQ ID NO: 17969 - protein, 7 aa, Artificial Sequence
  Description of Artificial Sequence: Synthetic peptide
  XENP018258 vlCDR2
YASHRYT

SEQ ID NO: 17970 - protein, 9 aa, Artificial Sequence
  Description of Artificial Sequence: Synthetic peptide
  XENP018258 vlCDR3
QQDYSSPRT

SEQ ID NO: 17971 - protein, 451 aa, Artificial Sequence
  Description of Artificial Sequence: Synthetic polypeptide
  XENP018259 1G6_H1.158_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSTVYLQMNSLRTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 17972 - protein, 122 aa, Artificial Sequence; identical to SEQ ID NO: 12449
  Description of Artificial Sequence: Synthetic polypeptide
  VH of XENP018259

SEQ ID NO: 17973 - protein, 5 aa, Artificial Sequence
  Description of Artificial Sequence: Synthetic peptide
  XENP018259 vhCDR1
NYWMN

SEQ ID NO: 17974 - protein, 19 aa, Artificial Sequence
  Description of Artificial Sequence: Synthetic peptide
  XENP018259 vhCDR2
EIRLKSNNYATHYAEPVKG

SEQ ID NO: 17975 - protein, 11 aa, Artificial Sequence
  Description of Artificial Sequence: Synthetic peptide
  XENP018259 vhCDR3
YYGNYGGYFDV

SEQ ID NO: 17976 - protein, 214 aa, Artificial Sequence; identical to SEQ ID NO: 16226
  Description of Artificial Sequence: Synthetic polypeptide
  XENP018259 1G6_H1.158_L1_IgG1_PVA_/S267K Light Chain

SEQ ID NO: 17977 - protein, 107 aa, Artificial Sequence; identical to SEQ ID NO: 10923
  Description of Artificial Sequence: Synthetic polypeptide
  VL of XENP018259

SEQ ID NO: 17978 - protein, 11 aa, Artificial Sequence
  Description of Artificial Sequence: Synthetic peptide
  XENP018259 vlCDR1
RASQSVSNDVA

SEQ ID NO: 17979 - protein, 7 aa, Artificial Sequence
  Description of Artificial Sequence: Synthetic peptide
  XENP018259 vlCDR2
YASHRYT

SEQ ID NO: 17980 - protein, 9 aa, Artificial Sequence
  Description of Artificial Sequence: Synthetic peptide
  XENP018259 vlCDR3
QQDYSSPRT

SEQ ID NO: 17981 - protein, 451 aa, Artificial Sequence
  Description of Artificial Sequence: Synthetic polypeptide
  XENP018260 1G6_H1.159_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSTVYLQMNSLKAEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 17982 - protein, 122 aa, Artificial Sequence; identical to SEQ ID NO: 12458
  Description of Artificial Sequence: Synthetic polypeptide
  VH of XENP018260

SEQ ID NO: 17983 - protein, 5 aa, Artificial Sequence
  Description of Artificial Sequence: Synthetic peptide
  XENP018260 vhCDR1
NYWMN

SEQ ID NO: 17984 - protein, 19 aa, Artificial Sequence
  Description of Artificial Sequence: Synthetic peptide
  XENP018260 vhCDR2
EIRLKSNNYATHYAEPVKG

SEQ ID NO: 17985 - protein, 11 aa, Artificial Sequence
  Description of Artificial Sequence: Synthetic peptide
  XENP018260 vhCDR3
YYGNYGGYFDV

SEQ ID NO: 17986 - protein, 214 aa, Artificial Sequence; identical to SEQ ID NO: 16226
  Description of Artificial Sequence: Synthetic polypeptide
  XENP018260 1G6_H1.159_L1_IgG1_PVA_/S267K Light Chain

SEQ ID NO: 17987 - protein, 107 aa, Artificial Sequence; identical to SEQ ID NO: 10923
  Description of Artificial Sequence: Synthetic polypeptide
  VL of XENP018260

SEQ ID NO: 17988 - protein, 11 aa, Artificial Sequence
  Description of Artificial Sequence: Synthetic peptide
  XENP018260 vlCDR1
RASQSVSNDVA

SEQ ID NO: 17989 - protein, 7 aa, Artificial Sequence
  Description of Artificial Sequence: Synthetic peptide
  XENP018260 vlCDR2
YASHRYT

SEQ ID NO: 17990 - protein, 9 aa, Artificial Sequence
  Description of Artificial Sequence: Synthetic peptide
  XENP018260 vlCDR3
QQDYSSPRT

SEQ ID NO: 17991 - protein, 451 aa, Artificial Sequence
  Description of Artificial Sequence: Synthetic polypeptide
  XENP018261 1G6_H1.160_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTGVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 17992 - protein, 122 aa, Artificial Sequence; identical to SEQ ID NO: 12467
  Description of Artificial Sequence: Synthetic polypeptide
  VH of XENP018261

SEQ ID NO: 17993 - protein, 5 aa, Artificial Sequence
  Description of Artificial Sequence: Synthetic peptide
  XENP018261 vhCDR1
NYWMN

SEQ ID NO: 17994 - protein, 19 aa, Artificial Sequence
  Description of Artificial Sequence: Synthetic peptide
  XENP018261 vhCDR2
EIRLKSNNYATHYAEPVKG

SEQ ID NO: 17995 - protein, 11 aa, Artificial Sequence
  Description of Artificial Sequence: Synthetic peptide
  XENP018261 vhCDR3
YYGNYGGYFDV

SEQ ID NO: 17996 - protein, 214 aa, Artificial Sequence; identical to SEQ ID NO: 16226
  Description of Artificial Sequence: Synthetic polypeptide
  XENP018261 1G6_H1.160_L1_IgG1_PVA_/S267K Light Chain

SEQ ID NO: 17997 - protein, 107 aa, Artificial Sequence; identical to SEQ ID NO: 10923
  Description of Artificial Sequence: Synthetic polypeptide
  VL of XENP018261

SEQ ID NO: 17998 - protein, 11 aa, Artificial Sequence
  Description of Artificial Sequence: Synthetic peptide
  XENP018261 vlCDR1
RASQSVSNDVA

SEQ ID NO: 17999 - protein, 7 aa, Artificial Sequence
  Description of Artificial Sequence: Synthetic peptide
  XENP018261 vlCDR2
YASHRYT

SEQ ID NO: 18000 - protein, 9 aa, Artificial Sequence
  Description of Artificial Sequence: Synthetic peptide
  XENP018261 vlCDR3
QQDYSSPRT

SEQ ID NO: 18001 - protein, 451 aa, Artificial Sequence
  Description of Artificial Sequence: Synthetic polypeptide
  XENP018262 1G6_H1.161_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAIYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 18002 - protein, 122 aa, Artificial Sequence; identical to SEQ ID NO: 12476
  Description of Artificial Sequence: Synthetic polypeptide
  VH of XENP018262

SEQ ID NO: 18003 - protein, 5 aa, Artificial Sequence
  Description of Artificial Sequence: Synthetic peptide
  XENP018262 vhCDR1
NYWMN

SEQ ID NO: 18004 - protein, 19 aa, Artificial Sequence
  Description of Artificial Sequence: Synthetic peptide
  XENP018262 vhCDR2
EIRLKSNNYATHYAEPVKG

SEQ ID NO: 18005 - protein, 11 aa, Artificial Sequence
  Description of Artificial Sequence: Synthetic peptide
  XENP018262 vhCDR3
YYGNYGGYFDV

SEQ ID NO: 18006 - protein, 214 aa, Artificial Sequence; identical to SEQ ID NO: 16226
  Description of Artificial Sequence: Synthetic polypeptide
  XENP018262 1G6_H1.161_L1_IgG1_PVA_/S267K Light Chain

SEQ ID NO: 18007 - protein, 107 aa, Artificial Sequence; identical to SEQ ID NO: 10923
  Description of Artificial Sequence: Synthetic polypeptide
  VL of XENP018262

SEQ ID NO: 18008 - protein, 11 aa, Artificial Sequence
  Description of Artificial Sequence: Synthetic peptide
  XENP018262 vlCDR1
RASQSVSNDVA

SEQ ID NO: 18009 - protein, 7 aa, Artificial Sequence
  Description of Artificial Sequence: Synthetic peptide
  XENP018262 vlCDR2
YASHRYT

SEQ ID NO: 18010 - protein, 9 aa, Artificial Sequence
  Description of Artificial Sequence: Synthetic peptide
  XENP018262 vlCDR3
QQDYSSPRT

SEQ ID NO: 18011 - protein, 451 aa, Artificial Sequence
  Description of Artificial Sequence: Synthetic polypeptide
  XENP018263 1G6_H1.162_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYHCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 18012 - protein, 122 aa, Artificial Sequence; identical to SEQ ID NO: 12485
  Description of Artificial Sequence: Synthetic polypeptide
  VH of XENP018263

SEQ ID NO: 18013 - protein, 5 aa, Artificial Sequence
  Description of Artificial Sequence: Synthetic peptide
  XENP018263 vhCDR1
NYWMN

SEQ ID NO: 18014 - protein, 19 aa, Artificial Sequence
  Description of Artificial Sequence: Synthetic peptide
  XENP018263 vhCDR2
EIRLKSNNYATHYAEPVKG

SEQ ID NO: 18015 - protein, 11 aa, Artificial Sequence
  Description of Artificial Sequence: Synthetic peptide
  XENP018263 vhCDR3
YYGNYGGYFDV

SEQ ID NO: 18016 - protein, 214 aa, Artificial Sequence; identical to SEQ ID NO: 16226
  Description of Artificial Sequence: Synthetic polypeptide
  XENP018263 1G6_H1.162_L1_IgG1_PVA_/S267K Light Chain

SEQ ID NO: 18017 - protein, 107 aa, Artificial Sequence; identical to SEQ ID NO: 10923
  Description of Artificial Sequence: Synthetic polypeptide
  VL of XENP018263

SEQ ID NO: 18018 - protein, 11 aa, Artificial Sequence
  Description of Artificial Sequence: Synthetic peptide
  XENP018263 vlCDR1
RASQSVSNDVA

SEQ ID NO: 18019 - protein, 7 aa, Artificial Sequence
  Description of Artificial Sequence: Synthetic peptide
  XENP018263 vlCDR2
YASHRYT

SEQ ID NO: 18020 - protein, 9 aa, Artificial Sequence
  Description of Artificial Sequence: Synthetic peptide
  XENP018263 vlCDR3
QQDYSSPRT

SEQ ID NO: 18021 - protein, 451 aa, Artificial Sequence
  Description of Artificial Sequence: Synthetic polypeptide
  XENP018264 1G6_H1.163_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCARYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 18022 - protein, 122 aa, Artificial Sequence; identical to SEQ ID NO: 12494
  Description of Artificial Sequence: Synthetic polypeptide
  VH of XENP018264

SEQ ID NO: 18023 - protein, 5 aa, Artificial Sequence
  Description of Artificial Sequence: Synthetic peptide
  XENP018264 vhCDR1
NYWMN

SEQ ID NO: 18024 - protein, 19 aa, Artificial Sequence
  Description of Artificial Sequence: Synthetic peptide
  XENP018264 vhCDR2
EIRLKSNNYATHYAEPVKG

SEQ ID NO: 18025 - protein, 11 aa, Artificial Sequence
  Description of Artificial Sequence: Synthetic peptide
  XENP018264 vhCDR3
YYGNYGGYFDV

SEQ ID NO: 18026 - protein, 214 aa, Artificial Sequence; identical to SEQ ID NO: 16226
  Description of Artificial Sequence: Synthetic polypeptide
  XENP018264 1G6_H1.163_L1_IgG1_PVA_/S267K Light Chain

SEQ ID NO: 18027 - protein, 107 aa, Artificial Sequence; identical to SEQ ID NO: 10923
  Description of Artificial Sequence: Synthetic polypeptide
  VL of XENP018264

SEQ ID NO: 18028 - protein, 11 aa, Artificial Sequence
  Description of Artificial Sequence: Synthetic peptide
  XENP018264 vlCDR1
RASQSVSNDVA

SEQ ID NO: 18029 - protein, 7 aa, Artificial Sequence
  Description of Artificial Sequence: Synthetic peptide
  XENP018264 vlCDR2
YASHRYT

SEQ ID NO: 18030 - protein, 9 aa, Artificial Sequence
  Description of Artificial Sequence: Synthetic peptide
  XENP018264 vlCDR3
QQDYSSPRT

SEQ ID NO: 18031 - protein, 451 aa, Artificial Sequence
  Description of Artificial Sequence: Synthetic polypeptide
  XENP018265 1G6_H1.164_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCVRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 18032 - protein, 122 aa, Artificial Sequence; identical to SEQ ID NO: 12503
  Description of Artificial Sequence: Synthetic polypeptide
  VH of XENP018265

SEQ ID NO: 18033 - protein, 5 aa, Artificial Sequence
  Description of Artificial Sequence: Synthetic peptide
  XENP018265 vhCDR1
NYWMN

SEQ ID NO: 18034 - protein, 19 aa, Artificial Sequence
  Description of Artificial Sequence: Synthetic peptide
  XENP018265 vhCDR2
EIRLKSNNYATHYAEPVKG

SEQ ID NO: 18035 - protein, 11 aa, Artificial Sequence
  Description of Artificial Sequence: Synthetic peptide
  XENP018265 vhCDR3
YYGNYGGYFDV

SEQ ID NO: 18036 - protein, 214 aa, Artificial Sequence; identical to SEQ ID NO: 16226
  Description of Artificial Sequence: Synthetic polypeptide
  XENP018265 1G6_H1.164_L1_IgG1_PVA_/S267K Light Chain

SEQ ID NO: 18037 - protein, 107 aa, Artificial Sequence; identical to SEQ ID NO: 10923
  Description of Artificial Sequence: Synthetic polypeptide
  VL of XENP018265

SEQ ID NO: 18038 - protein, 11 aa, Artificial Sequence
  Description of Artificial Sequence: Synthetic peptide
  XENP018265 vlCDR1
RASQSVSNDVA

SEQ ID NO: 18039 - protein, 7 aa, Artificial Sequence
  Description of Artificial Sequence: Synthetic peptide
  XENP018265 vlCDR2
YASHRYT

SEQ ID NO: 18040 - protein, 9 aa, Artificial Sequence
  Description of Artificial Sequence: Synthetic peptide
  XENP018265 vlCDR3
QQDYSSPRT

SEQ ID NO: 18041 - protein, 451 aa, Artificial Sequence
  Description of Artificial Sequence: Synthetic polypeptide
  XENP018266 1G6_H1.165_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTTYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 18042 - protein, 122 aa, Artificial Sequence; identical to SEQ ID NO: 12512
  Description of Artificial Sequence: Synthetic polypeptide
  VH of XENP018266

SEQ ID NO: 18043 - protein, 5 aa, Artificial Sequence
  Description of Artificial Sequence: Synthetic peptide
  XENP018266 vhCDR1
NYWMN

SEQ ID NO: 18044 - protein, 19 aa, Artificial Sequence
  Description of Artificial Sequence: Synthetic peptide
  XENP018266 vhCDR2
EIRLKSNNYATHYAEPVKG

SEQ ID NO: 18045 - protein, 11 aa, Artificial Sequence
  Description of Artificial Sequence: Synthetic peptide
  XENP018266 vhCDR3
YYGNYGGYFDV

SEQ ID NO: 18046 - protein, 214 aa, Artificial Sequence; identical to SEQ ID NO: 16226
  Description of Artificial Sequence: Synthetic polypeptide
  XENP018266 1G6_H1.165_L1_IgG1_PVA_/S267K Light Chain

SEQ ID NO: 18047 - protein, 107 aa, Artificial Sequence; identical to SEQ ID NO: 10923
  Description of Artificial Sequence: Synthetic polypeptide
  VL of XENP018266

SEQ ID NO: 18048 - protein, 11 aa, Artificial Sequence
  Description of Artificial Sequence: Synthetic peptide
  XENP018266 vlCDR1
RASQSVSNDVA

SEQ ID NO: 18049 - protein, 7 aa, Artificial Sequence
  Description of Artificial Sequence: Synthetic peptide
  XENP018266 vlCDR2
YASHRYT

SEQ ID NO: 18050 - protein, 9 aa, Artificial Sequence
  Description of Artificial Sequence: Synthetic peptide
  XENP018266 vlCDR3
QQDYSSPRT

SEQ ID NO: 18051 - protein, 451 aa, Artificial Sequence
  Description of Artificial Sequence: Synthetic polypeptide
  XENP018267 1G6_H1.166_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTKYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 18052 - protein, 122 aa, Artificial Sequence; identical to SEQ ID NO: 12521
  Description of Artificial Sequence: Synthetic polypeptide
  VH of XENP018267

SEQ ID NO: 18053 - protein, 5 aa, Artificial Sequence
  Description of Artificial Sequence: Synthetic peptide
  XENP018267 vhCDR1
NYWMN

SEQ ID NO: 18054 - protein, 19 aa, Artificial Sequence
  Description of Artificial Sequence: Synthetic peptide
  XENP018267 vhCDR2
EIRLKSNNYATHYAEPVKG

SEQ ID NO: 18055 - protein, 11 aa, Artificial Sequence
  Description of Artificial Sequence: Synthetic peptide
  XENP018267 vhCDR3
YYGNYGGYFDV

SEQ ID NO: 18056 - protein, 214 aa, Artificial Sequence; identical to SEQ ID NO: 16226
  Description of Artificial Sequence: Synthetic polypeptide
  XENP018267 1G6_H1.166_L1_IgG1_PVA_/S267K Light Chain

SEQ ID NO: 18057 - protein, 107 aa, Artificial Sequence; identical to SEQ ID NO: 10923
  Description of Artificial Sequence: Synthetic polypeptide
  VL of XENP018267

SEQ ID NO: 18058 - protein, 11 aa, Artificial Sequence
  Description of Artificial Sequence: Synthetic peptide
  XENP018267 vlCDR1
RASQSVSNDVA

SEQ ID NO: 18059 - protein, 7 aa, Artificial Sequence
  Description of Artificial Sequence: Synthetic peptide
  XENP018267 vlCDR2
YASHRYT

SEQ ID NO: 18060 - protein, 9 aa, Artificial Sequence
  Description of Artificial Sequence: Synthetic peptide
  XENP018267 vlCDR3
QQDYSSPRT

SEQ ID NO: 18061 - protein, 451 aa, Artificial Sequence
  Description of Artificial Sequence: Synthetic polypeptide
  XENP018268 1G6_H1.167_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRFYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 18062 - protein, 122 aa, Artificial Sequence; identical to SEQ ID NO: 12530
  Description of Artificial Sequence: Synthetic polypeptide
  VH of XENP018268

SEQ ID NO: 18063 - protein, 5 aa, Artificial Sequence
  Description of Artificial Sequence: Synthetic peptide
  XENP018268 vhCDR1
NYWMN

SEQ ID NO: 18064 - protein, 19 aa, Artificial Sequence
  Description of Artificial Sequence: Synthetic peptide
  XENP018268 vhCDR2
EIRLKSNNYATHYAEPVKG

SEQ ID NO: 18065 - protein, 11 aa, Artificial Sequence
  Description of Artificial Sequence: Synthetic peptide
  XENP018268 vhCDR3
FYGNYGGYFDV

SEQ ID NO: 18066 - protein, 214 aa, Artificial Sequence; identical to SEQ ID NO: 16226
  Description of Artificial Sequence: Synthetic polypeptide
  XENP018268 1G6_H1.167_L1_IgG1_PVA_/S267K Light Chain

SEQ ID NO: 18067 - protein, 107 aa, Artificial Sequence; identical to SEQ ID NO: 10923
  Description of Artificial Sequence: Synthetic polypeptide
  VL of XENP018268

SEQ ID NO: 18068 - protein, 11 aa, Artificial Sequence
  Description of Artificial Sequence: Synthetic peptide
  XENP018268 vlCDR1
RASQSVSNDVA

SEQ ID NO: 18069 - protein, 7 aa, Artificial Sequence
  Description of Artificial Sequence: Synthetic peptide
  XENP018268 vlCDR2
YASHRYT

SEQ ID NO: 18070 - protein, 9 aa, Artificial Sequence
  Description of Artificial Sequence: Synthetic peptide
  XENP018268 vlCDR3
QQDYSSPRT

SEQ ID NO: 18071 - protein, 451 aa, Artificial Sequence
  Description of Artificial Sequence: Synthetic polypeptide
  XENP018269 1G6_H1.168_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRHYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 18072 - protein, 122 aa, Artificial Sequence; identical to SEQ ID NO: 12539
  Description of Artificial Sequence: Synthetic polypeptide
  VH of XENP018269

SEQ ID NO: 18073 - protein, 5 aa, Artificial Sequence
  Description of Artificial Sequence: Synthetic peptide
  XENP018269 vhCDR1
NYWMN

SEQ ID NO: 18074 - protein, 19 aa, Artificial Sequence
  Description of Artificial Sequence: Synthetic peptide
  XENP018269 vhCDR2
EIRLKSNNYATHYAEPVKG

SEQ ID NO: 18075 - protein, 11 aa, Artificial Sequence
  Description of Artificial Sequence: Synthetic peptide
  XENP018269 vhCDR3
HYGNYGGYFDV

SEQ ID NO: 18076 - protein, 214 aa, Artificial Sequence; identical to SEQ ID NO: 16226
  Description of Artificial Sequence: Synthetic polypeptide
  XENP018269 1G6_H1.168_L1_IgG1_PVA_/S267K Light Chain

SEQ ID NO: 18077 - protein, 107 aa, Artificial Sequence; identical to SEQ ID NO: 10923
  Description of Artificial Sequence: Synthetic polypeptide
  VL of XENP018269

SEQ ID NO: 18078 - protein, 11 aa, Artificial Sequence
  Description of Artificial Sequence: Synthetic peptide
  XENP018269 vlCDR1
RASQSVSNDVA

SEQ ID NO: 18079 - protein, 7 aa, Artificial Sequence
  Description of Artificial Sequence: Synthetic peptide
  XENP018269 vlCDR2
YASHRYT

SEQ ID NO: 18080 - protein, 9 aa, Artificial Sequence
  Description of Artificial Sequence: Synthetic peptide
  XENP018269 vlCDR3
QQDYSSPRT

SEQ ID NO: 18081 - protein, 451 aa, Artificial Sequence
  Description of Artificial Sequence: Synthetic polypeptide
  XENP018270 1G6_H1.169_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRLYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 18082 - protein, 122 aa, Artificial Sequence; identical to SEQ ID NO: 12548
  Description of Artificial Sequence: Synthetic polypeptide
  VH of XENP018270

SEQ ID NO: 18083 - protein, 5 aa, Artificial Sequence
  Description of Artificial Sequence: Synthetic peptide
  XENP018270 vhCDR1
NYWMN

SEQ ID NO: 18084 - protein, 19 aa, Artificial Sequence
  Description of Artificial Sequence: Synthetic peptide
  XENP018270 vhCDR2
EIRLKSNNYATHYAEPVKG

SEQ ID NO: 18085 - protein, 11 aa, Artificial Sequence
  Description of Artificial Sequence: Synthetic peptide
  XENP018270 vhCDR3
LYGNYGGYFDV

SEQ ID NO: 18086 - protein, 214 aa, Artificial Sequence; identical to SEQ ID NO: 16226
  Description of Artificial Sequence: Synthetic polypeptide
  XENP018270 1G6_H1.169_L1_IgG1_PVA_/S267K Light Chain

SEQ ID NO: 18087 - protein, 107 aa, Artificial Sequence; identical to SEQ ID NO: 10923
  Description of Artificial Sequence: Synthetic polypeptide
  VL of XENP018270

SEQ ID NO: 18088 - protein, 11 aa, Artificial Sequence
  Description of Artificial Sequence: Synthetic peptide
  XENP018270 vlCDR1
RASQSVSNDVA

SEQ ID NO: 18089 - protein, 7 aa, Artificial Sequence
  Description of Artificial Sequence: Synthetic peptide
  XENP018270 vlCDR2
YASHRYT

SEQ ID NO: 18090 - protein, 9 aa, Artificial Sequence
  Description of Artificial Sequence: Synthetic peptide
  XENP018270 vlCDR3
QQDYSSPRT

SEQ ID NO: 18091 - protein, 451 aa, Artificial Sequence
  Description of Artificial Sequence: Synthetic polypeptide
  XENP018271 1G6_H1.170_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRWYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 18092 - protein, 122 aa, Artificial Sequence; identical to SEQ ID NO: 12557
  Description of Artificial Sequence: Synthetic polypeptide
  VH of XENP018271

SEQ ID NO: 18093 - protein, 5 aa, Artificial Sequence
  Description of Artificial Sequence: Synthetic peptide
  XENP018271 vhCDR1
NYWMN

SEQ ID NO: 18094 - protein, 19 aa, Artificial Sequence
  Description of Artificial Sequence: Synthetic peptide
  XENP018271 vhCDR2
EIRLKSNNYATHYAEPVKG

SEQ ID NO: 18095 - protein, 11 aa, Artificial Sequence
  Description of Artificial Sequence: Synthetic peptide
  XENP018271 vhCDR3
WYGNYGGYFDV

SEQ ID NO: 18096 - protein, 214 aa, Artificial Sequence; identical to SEQ ID NO: 16226
  Description of Artificial Sequence: Synthetic polypeptide
  XENP018271 1G6_H1.170_L1_IgG1_PVA_/S267K Light Chain

SEQ ID NO: 18097 - protein, 107 aa, Artificial Sequence; identical to SEQ ID NO: 10923
  Description of Artificial Sequence: Synthetic polypeptide
  VL of XENP018271

SEQ ID NO: 18098 - protein, 11 aa, Artificial Sequence
  Description of Artificial Sequence: Synthetic peptide
  XENP018271 vlCDR1
RASQSVSNDVA

SEQ ID NO: 18099 - protein, 7 aa, Artificial Sequence
  Description of Artificial Sequence: Synthetic peptide
  XENP018271 vlCDR2
YASHRYT

SEQ ID NO: 18100 - protein, 9 aa, Artificial Sequence
  Description of Artificial Sequence: Synthetic peptide
  XENP018271 vlCDR3
QQDYSSPRT

SEQ ID NO: 18101 - protein, 451 aa, Artificial Sequence
  Description of Artificial Sequence: Synthetic polypeptide
  XENP018272 1G6_H1.171_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRVYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 18102 - protein, 122 aa, Artificial Sequence; identical to SEQ ID NO: 12566
  Description of Artificial Sequence: Synthetic polypeptide
  VH of XENP018272

SEQ ID NO: 18103 - protein, 5 aa, Artificial Sequence
  Description of Artificial Sequence: Synthetic peptide
  XENP018272 vhCDR1
NYWMN

SEQ ID NO: 18104 - protein, 19 aa, Artificial Sequence
  Description of Artificial Sequence: Synthetic peptide
  XENP018272 vhCDR2
EIRLKSNNYATHYAEPVKG

SEQ ID NO: 18105 - protein, 11 aa, Artificial Sequence
  Description of Artificial Sequence: Synthetic peptide
  XENP018272 vhCDR3
VYGNYGGYFDV

SEQ ID NO: 18106 - protein, 214 aa, Artificial Sequence; identical to SEQ ID NO: 16226
  Description of Artificial Sequence: Synthetic polypeptide
  XENP018272 1G6_H1.171_L1_IgG1_PVA_/S267K Light Chain

SEQ ID NO: 18107 - protein, 107 aa, Artificial Sequence; identical to SEQ ID NO: 10923
  Description of Artificial Sequence: Synthetic polypeptide
  VL of XENP018272

SEQ ID NO: 18108 - protein, 11 aa, Artificial Sequence
  Description of Artificial Sequence: Synthetic peptide
  XENP018272 vlCDR1
RASQSVSNDVA

SEQ ID NO: 18109 - protein, 7 aa, Artificial Sequence
  Description of Artificial Sequence: Synthetic peptide
  XENP018272 vlCDR2
YASHRYT

SEQ ID NO: 18110 - protein, 9 aa, Artificial Sequence
  Description of Artificial Sequence: Synthetic peptide
  XENP018272 vlCDR3
QQDYSSPRT

SEQ ID NO: 18111 - protein, 451 aa, Artificial Sequence
  Description of Artificial Sequence: Synthetic polypeptide
  XENP018273 1G6_H1.172_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRAYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 18112 - protein, 122 aa, Artificial Sequence; identical to SEQ ID NO: 12575
  Description of Artificial Sequence: Synthetic polypeptide
  VH of XENP018273

SEQ ID NO: 18113 - protein, 5 aa, Artificial Sequence
  Description of Artificial Sequence: Synthetic peptide
  XENP018273 vhCDR1
NYWMN

SEQ ID NO: 18114 - protein, 19 aa, Artificial Sequence
  Description of Artificial Sequence: Synthetic peptide
  XENP018273 vhCDR2
EIRLKSNNYATHYAEPVKG

SEQ ID NO: 18115 - protein, 11 aa, Artificial Sequence
  Description of Artificial Sequence: Synthetic peptide
  XENP018273 vhCDR3
AYGNYGGYFDV

SEQ ID NO: 18116 - protein, 214 aa, Artificial Sequence; identical to SEQ ID NO: 16226
  Description of Artificial Sequence: Synthetic polypeptide
  XENP018273 1G6_H1.172_L1_IgG1_PVA_/S267K Light Chain

SEQ ID NO: 18117 - protein, 107 aa, Artificial Sequence; identical to SEQ ID NO: 10923
  Description of Artificial Sequence: Synthetic polypeptide
  VL of XENP018273

SEQ ID NO: 18118 - protein, 11 aa, Artificial Sequence
  Description of Artificial Sequence: Synthetic peptide
  XENP018273 vlCDR1
RASQSVSNDVA

SEQ ID NO: 18119 - protein, 7 aa, Artificial Sequence
  Description of Artificial Sequence: Synthetic peptide
  XENP018273 vlCDR2
YASHRYT

SEQ ID NO: 18120 - protein, 9 aa, Artificial Sequence
  Description of Artificial Sequence: Synthetic peptide
  XENP018273 vlCDR3
QQDYSSPRT

SEQ ID NO: 18121 - protein, 451 aa, Artificial Sequence
  Description of Artificial Sequence: Synthetic polypeptide
  XENP018274 1G6_H1.173_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRQYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 18122 - protein, 122 aa, Artificial Sequence; identical to SEQ ID NO: 12584
  Description of Artificial Sequence: Synthetic polypeptide
  VH of XENP018274

SEQ ID NO: 18123 - protein, 5 aa, Artificial Sequence
  Description of Artificial Sequence: Synthetic peptide
  XENP018274 vhCDR1
NYWMN

SEQ ID NO: 18124 - protein, 19 aa, Artificial Sequence
  Description of Artificial Sequence: Synthetic peptide
  XENP018274 vhCDR2
EIRLKSNNYATHYAEPVKG

SEQ ID NO: 18125 - protein, 11 aa, Artificial Sequence
  Description of Artificial Sequence: Synthetic peptide
  XENP018274 vhCDR3
QYGNYGGYFDV

SEQ ID NO: 18126 - protein, 214 aa, Artificial Sequence; identical to SEQ ID NO: 16226
  Description of Artificial Sequence: Synthetic polypeptide
  XENP018274 1G6_H1.173_L1_IgG1_PVA_/S267K Light Chain

SEQ ID NO: 18127 - protein, 107 aa, Artificial Sequence; identical to SEQ ID NO: 10923
  Description of Artificial Sequence: Synthetic polypeptide
  VL of XENP018274

SEQ ID NO: 18128 - protein, 11 aa, Artificial Sequence
  Description of Artificial Sequence: Synthetic peptide
  XENP018274 vlCDR1
RASQSVSNDVA

SEQ ID NO: 18129 - protein, 7 aa, Artificial Sequence
  Description of Artificial Sequence: Synthetic peptide
  XENP018274 vlCDR2
YASHRYT

SEQ ID NO: 18130 - protein, 9 aa, Artificial Sequence
  Description of Artificial Sequence: Synthetic peptide
  XENP018274 vlCDR3
QQDYSSPRT

SEQ ID NO: 18131 - protein, 451 aa, Artificial Sequence
  Description of Artificial Sequence: Synthetic polypeptide
  XENP018275 1G6_H1.174_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRDYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 18132 - protein, 122 aa, Artificial Sequence; identical to SEQ ID NO: 12593
  Description of Artificial Sequence: Synthetic polypeptide
  VH of XENP018275

SEQ ID NO: 18133 - protein, 5 aa, Artificial Sequence
  Description of Artificial Sequence: Synthetic peptide
  XENP018275 vhCDR1
NYWMN

SEQ ID NO: 18134 - protein, 19 aa, Artificial Sequence
  Description of Artificial Sequence: Synthetic peptide
  XENP018275 vhCDR2
EIRLKSNNYATHYAEPVKG

SEQ ID NO: 18135 - protein, 11 aa, Artificial Sequence
  Description of Artificial Sequence: Synthetic peptide
  XENP018275 vhCDR3
DYGNYGGYFDV

SEQ ID NO: 18136 - protein, 214 aa, Artificial Sequence; identical to SEQ ID NO: 16226
  Description of Artificial Sequence: Synthetic polypeptide
  XENP018275 1G6_H1.174_L1_IgG1_PVA_/S267K Light Chain

SEQ ID NO: 18137 - protein, 107 aa, Artificial Sequence; identical to SEQ ID NO: 10923
  Description of Artificial Sequence: Synthetic polypeptide
  VL of XENP018275

SEQ ID NO: 18138 - protein, 11 aa, Artificial Sequence
  Description of Artificial Sequence: Synthetic peptide
  XENP018275 vlCDR1
RASQSVSNDVA

SEQ ID NO: 18139 - protein, 7 aa, Artificial Sequence
  Description of Artificial Sequence: Synthetic peptide
  XENP018275 vlCDR2
YASHRYT

SEQ ID NO: 18140 - protein, 9 aa, Artificial Sequence
  Description of Artificial Sequence: Synthetic peptide
  XENP018275 vlCDR3
QQDYSSPRT

SEQ ID NO: 18141 - protein, 451 aa, Artificial Sequence
  Description of Artificial Sequence: Synthetic polypeptide
  XENP018276 1G6_H1.175_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRKYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 18142 - protein, 122 aa, Artificial Sequence; identical to SEQ ID NO: 12602
  Description of Artificial Sequence: Synthetic polypeptide
  VH of XENP018276

SEQ ID NO: 18143 - protein, 5 aa, Artificial Sequence
  Description of Artificial Sequence: Synthetic peptide
  XENP018276 vhCDR1
NYWMN

SEQ ID NO: 18144 - protein, 19 aa, Artificial Sequence
  Description of Artificial Sequence: Synthetic peptide
  XENP018276 vhCDR2
EIRLKSNNYATHYAEPVKG

SEQ ID NO: 18145 - protein, 11 aa, Artificial Sequence
  Description of Artificial Sequence: Synthetic peptide
  XENP018276 vhCDR3
KYGNYGGYFDV

SEQ ID NO: 18146 - protein, 214 aa, Artificial Sequence; identical to SEQ ID NO: 16226
  Description of Artificial Sequence: Synthetic polypeptide
  XENP018276 1G6_H1.175_L1_IgG1_PVA_/S267K Light Chain

SEQ ID NO: 18147 - protein, 107 aa, Artificial Sequence; identical to SEQ ID NO: 10923
  Description of Artificial Sequence: Synthetic polypeptide
  VL of XENP018276

SEQ ID NO: 18148 - protein, 11 aa, Artificial Sequence
  Description of Artificial Sequence: Synthetic peptide
  XENP018276 vlCDR1
RASQSVSNDVA

SEQ ID NO: 18149 - protein, 7 aa, Artificial Sequence
  Description of Artificial Sequence: Synthetic peptide
  XENP018276 vlCDR2
YASHRYT

SEQ ID NO: 18150 - protein, 9 aa, Artificial Sequence
  Description of Artificial Sequence: Synthetic peptide
  XENP018276 vlCDR3
QQDYSSPRT

SEQ ID NO: 18151 - protein, 451 aa, Artificial Sequence
  Description of Artificial Sequence: Synthetic polypeptide
  XENP018277 1G6_H1.176_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYFGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 18152 - protein, 122 aa, Artificial Sequence; identical to SEQ ID NO: 12611
  Description of Artificial Sequence: Synthetic polypeptide
  VH of XENP018277

SEQ ID NO: 18153 - protein, 5 aa, Artificial Sequence
  Description of Artificial Sequence: Synthetic peptide
  XENP018277 vhCDR1
NYWMN

SEQ ID NO: 18154 - protein, 19 aa, Artificial Sequence
  Description of Artificial Sequence: Synthetic peptide
  XENP018277 vhCDR2
EIRLKSNNYATHYAEPVKG

SEQ ID NO: 18155 - protein, 11 aa, Artificial Sequence
  Description of Artificial Sequence: Synthetic peptide
  XENP018277 vhCDR3
YFGNYGGYFDV

SEQ ID NO: 18156 - protein, 214 aa, Artificial Sequence; identical to SEQ ID NO: 16226
  Description of Artificial Sequence: Synthetic polypeptide
  XENP018277 1G6_H1.176_L1_IgG1_PVA_/S267K Light Chain

SEQ ID NO: 18157 - protein, 107 aa, Artificial Sequence; identical to SEQ ID NO: 10923
  Description of Artificial Sequence: Synthetic polypeptide
  VL of XENP018277

SEQ ID NO: 18158 - protein, 11 aa, Artificial Sequence
  Description of Artificial Sequence: Synthetic peptide
  XENP018277 vlCDR1
RASQSVSNDVA

SEQ ID NO: 18159 - protein, 7 aa, Artificial Sequence
  Description of Artificial Sequence: Synthetic peptide
  XENP018277 vlCDR2
YASHRYT

SEQ ID NO: 18160 - protein, 9 aa, Artificial Sequence
  Description of Artificial Sequence: Synthetic peptide
  XENP018277 vlCDR3
QQDYSSPRT

SEQ ID NO: 18161 - protein, 451 aa, Artificial Sequence
  Description of Artificial Sequence: Synthetic polypeptide
  XENP018278 1G6_H1.177_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYHGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 18162 - protein, 122 aa, Artificial Sequence; identical to SEQ ID NO: 12620
  Description of Artificial Sequence: Synthetic polypeptide
  VH of XENP018278

SEQ ID NO: 18163 - protein, 5 aa, Artificial Sequence
  Description of Artificial Sequence: Synthetic peptide
  XENP018278 vhCDR1
NYWMN

SEQ ID NO: 18164 - protein, 19 aa, Artificial Sequence
  Description of Artificial Sequence: Synthetic peptide
  XENP018278 vhCDR2
EIRLKSNNYATHYAEPVKG

SEQ ID NO: 18165 - protein, 11 aa, Artificial Sequence
  Description of Artificial Sequence: Synthetic peptide
  XENP018278 vhCDR3
YHGNYGGYFDV

SEQ ID NO: 18166 - protein, 214 aa, Artificial Sequence; identical to SEQ ID NO: 16226
  Description of Artificial Sequence: Synthetic polypeptide
  XENP018278 1G6_H1.177_L1_IgG1_PVA_/S267K Light Chain

SEQ ID NO: 18167 - protein, 107 aa, Artificial Sequence; identical to SEQ ID NO: 10923
  Description of Artificial Sequence: Synthetic polypeptide
  VL of XENP018278

SEQ ID NO: 18168 - protein, 11 aa, Artificial Sequence
  Description of Artificial Sequence: Synthetic peptide
  XENP018278 vlCDR1
RASQSVSNDVA

SEQ ID NO: 18169 - protein, 7 aa, Artificial Sequence
  Description of Artificial Sequence: Synthetic peptide
  XENP018278 vlCDR2
YASHRYT

SEQ ID NO: 18170 - protein, 9 aa, Artificial Sequence
  Description of Artificial Sequence: Synthetic peptide
  XENP018278 vlCDR3
QQDYSSPRT

SEQ ID NO: 18171 - protein, 451 aa, Artificial Sequence
  Description of Artificial Sequence: Synthetic polypeptide
  XENP018279 1G6_H1.178_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYLGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 18172 - protein, 122 aa, Artificial Sequence; identical to SEQ ID NO: 12629
  Description of Artificial Sequence: Synthetic polypeptide
  VH of XENP018279

SEQ ID NO: 18173 - protein, 5 aa, Artificial Sequence
  Description of Artificial Sequence: Synthetic peptide
  XENP018279 vhCDR1
NYWMN

SEQ ID NO: 18174 - protein, 19 aa, Artificial Sequence
  Description of Artificial Sequence: Synthetic peptide
  XENP018279 vhCDR2
EIRLKSNNYATHYAEPVKG

SEQ ID NO: 18175 - protein, 11 aa, Artificial Sequence
  Description of Artificial Sequence: Synthetic peptide
  XENP018279 vhCDR3
YLGNYGGYFDV

SEQ ID NO: 18176 - protein, 214 aa, Artificial Sequence; identical to SEQ ID NO: 16226
  Description of Artificial Sequence: Synthetic polypeptide
  XENP018279 1G6_H1.178_L1_IgG1_PVA_/S267K Light Chain

SEQ ID NO: 18177 - protein, 107 aa, Artificial Sequence; identical to SEQ ID NO: 10923
  Description of Artificial Sequence: Synthetic polypeptide
  VL of XENP018279

SEQ ID NO: 18178 - protein, 11 aa, Artificial Sequence
  Description of Artificial Sequence: Synthetic peptide
  XENP018279 vlCDR1
RASQSVSNDVA

SEQ ID NO: 18179 - protein, 7 aa, Artificial Sequence
  Description of Artificial Sequence: Synthetic peptide
  XENP018279 vlCDR2
YASHRYT

SEQ ID NO: 18180 - protein, 9 aa, Artificial Sequence
  Description of Artificial Sequence: Synthetic peptide
  XENP018279 vlCDR3
QQDYSSPRT

SEQ ID NO: 18181 - protein, 451 aa, Artificial Sequence
  Description of Artificial Sequence: Synthetic polypeptide
  XENP018280 1G6_H1.179_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYWGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 18182 - protein, 122 aa, Artificial Sequence; identical to SEQ ID NO: 12638
  Description of Artificial Sequence: Synthetic polypeptide
  VH of XENP018280

SEQ ID NO: 18183 - protein, 5 aa, Artificial Sequence
  Description of Artificial Sequence: Synthetic peptide
  XENP018280 vhCDR1
NYWMN

SEQ ID NO: 18184 - protein, 19 aa, Artificial Sequence
  Description of Artificial Sequence: Synthetic peptide
  XENP018280 vhCDR2
EIRLKSNNYATHYAEPVKG

SEQ ID NO: 18185 - protein, 11 aa, Artificial Sequence
  Description of Artificial Sequence: Synthetic peptide
  XENP018280 vhCDR3
YWGNYGGYFDV

SEQ ID NO: 18186 - protein, 214 aa, Artificial Sequence; identical to SEQ ID NO: 16226
  Description of Artificial Sequence: Synthetic polypeptide
  XENP018280 1G6_H1.179_L1_IgG1_PVA_/S267K Light Chain

SEQ ID NO: 18187 - protein, 107 aa, Artificial Sequence; identical to SEQ ID NO: 10923
  Description of Artificial Sequence: Synthetic polypeptide
  VL of XENP018280

SEQ ID NO: 18188 - protein, 11 aa, Artificial Sequence
  Description of Artificial Sequence: Synthetic peptide
  XENP018280 vlCDR1
RASQSVSNDVA

SEQ ID NO: 18189 - protein, 7 aa, Artificial Sequence
  Description of Artificial Sequence: Synthetic peptide
  XENP018280 vlCDR2
YASHRYT

SEQ ID NO: 18190 - protein, 9 aa, Artificial Sequence
  Description of Artificial Sequence: Synthetic peptide
  XENP018280 vlCDR3
QQDYSSPRT

SEQ ID NO: 18191 - protein, 451 aa, Artificial Sequence
  Description of Artificial Sequence: Synthetic polypeptide
  XENP018281 1G6_H1.180_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYVGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 18192 - protein, 122 aa, Artificial Sequence; identical to SEQ ID NO: 12647
  Description of Artificial Sequence: Synthetic polypeptide
  VH of XENP018281

SEQ ID NO: 18193 - protein, 5 aa, Artificial Sequence
  Description of Artificial Sequence: Synthetic peptide
  XENP018281 vhCDR1
NYWMN

SEQ ID NO: 18194 - protein, 19 aa, Artificial Sequence
  Description of Artificial Sequence: Synthetic peptide
  XENP018281 vhCDR2
EIRLKSNNYATHYAEPVKG

SEQ ID NO: 18195 - protein, 11 aa, Artificial Sequence
  Description of Artificial Sequence: Synthetic peptide
  XENP018281 vhCDR3
YVGNYGGYFDV

SEQ ID NO: 18196 - protein, 214 aa, Artificial Sequence; identical to SEQ ID NO: 16226
  Description of Artificial Sequence: Synthetic polypeptide
  XENP018281 1G6_H1.180_L1_IgG1_PVA_/S267K Light Chain

SEQ ID NO: 18197 - protein, 107 aa, Artificial Sequence; identical to SEQ ID NO: 10923
  Description of Artificial Sequence: Synthetic polypeptide
  VL of XENP018281

SEQ ID NO: 18198 - protein, 11 aa, Artificial Sequence
  Description of Artificial Sequence: Synthetic peptide
  XENP018281 vlCDR1
RASQSVSNDVA

SEQ ID NO: 18199 - protein, 7 aa, Artificial Sequence
  Description of Artificial Sequence: Synthetic peptide
  XENP018281 vlCDR2
YASHRYT

SEQ ID NO: 18200 - protein, 9 aa, Artificial Sequence
  Description of Artificial Sequence: Synthetic peptide
  XENP018281 vlCDR3
QQDYSSPRT

SEQ ID NO: 18201 - protein, 451 aa, Artificial Sequence
  Description of Artificial Sequence: Synthetic polypeptide
  XENP018282 1G6_H1.181_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYAGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 18202 - protein, 122 aa, Artificial Sequence; identical to SEQ ID NO: 12656
  Description of Artificial Sequence: Synthetic polypeptide
  VH of XENP018282

SEQ ID NO: 18203 - protein, 5 aa, Artificial Sequence
  Description of Artificial Sequence: Synthetic peptide
  XENP018282 vhCDR1
NYWMN

SEQ ID NO: 18204 - protein, 19 aa, Artificial Sequence
  Description of Artificial Sequence: Synthetic peptide
  XENP018282 vhCDR2
EIRLKSNNYATHYAEPVKG

SEQ ID NO: 18205 - protein, 11 aa, Artificial Sequence
  Description of Artificial Sequence: Synthetic peptide
  XENP018282 vhCDR3
YAGNYGGYFDV

SEQ ID NO: 18206 - protein, 214 aa, Artificial Sequence; identical to SEQ ID NO: 16226
  Description of Artificial Sequence: Synthetic polypeptide
  XENP018282 1G6_H1.181_L1_IgG1_PVA_/S267K Light Chain

SEQ ID NO: 18207 - protein, 107 aa, Artificial Sequence; identical to SEQ ID NO: 10923
  Description of Artificial Sequence: Synthetic polypeptide
  VL of XENP018282

SEQ ID NO: 18208 - protein, 11 aa, Artificial Sequence
  Description of Artificial Sequence: Synthetic peptide
  XENP018282 vlCDR1
RASQSVSNDVA

SEQ ID NO: 18209 - protein, 7 aa, Artificial Sequence
  Description of Artificial Sequence: Synthetic peptide
  XENP018282 vlCDR2
YASHRYT

SEQ ID NO: 18210 - protein, 9 aa, Artificial Sequence
  Description of Artificial Sequence: Synthetic peptide
  XENP018282 vlCDR3
QQDYSSPRT

SEQ ID NO: 18211 - protein, 451 aa, Artificial Sequence
  Description of Artificial Sequence: Synthetic polypeptide
  XENP018283 1G6_H1.182_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYQGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 18212 - protein, 122 aa, Artificial Sequence; identical to SEQ ID NO: 12665
  Description of Artificial Sequence: Synthetic polypeptide
  VH of XENP018283

SEQ ID NO: 18213 - protein, 5 aa, Artificial Sequence
  Description of Artificial Sequence: Synthetic peptide
  XENP018283 vhCDR1
NYWMN

SEQ ID NO: 18214 - protein, 19 aa, Artificial Sequence
  Description of Artificial Sequence: Synthetic peptide
  XENP018283 vhCDR2
EIRLKSNNYATHYAEPVKG

SEQ ID NO: 18215 - protein, 11 aa, Artificial Sequence
  Description of Artificial Sequence: Synthetic peptide
  XENP018283 vhCDR3
YQGNYGGYFDV

SEQ ID NO: 18216 - protein, 214 aa, Artificial Sequence; identical to SEQ ID NO: 16226
  Description of Artificial Sequence: Synthetic polypeptide
  XENP018283 1G6_H1.182_L1_IgG1_PVA_/S267K Light Chain

SEQ ID NO: 18217 - protein, 107 aa, Artificial Sequence; identical to SEQ ID NO: 10923
  Description of Artificial Sequence: Synthetic polypeptide
  VL of XENP018283

SEQ ID NO: 18218 - protein, 11 aa, Artificial Sequence
  Description of Artificial Sequence: Synthetic peptide
  XENP018283 vlCDR1
RASQSVSNDVA

SEQ ID NO: 18219 - protein, 7 aa, Artificial Sequence
  Description of Artificial Sequence: Synthetic peptide
  XENP018283 vlCDR2
YASHRYT

SEQ ID NO: 18220 - protein, 9 aa, Artificial Sequence
  Description of Artificial Sequence: Synthetic peptide
  XENP018283 vlCDR3
QQDYSSPRT

SEQ ID NO: 18221 - protein, 451 aa, Artificial Sequence
  Description of Artificial Sequence: Synthetic polypeptide
  XENP018284 1G6_H1.183_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYDGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 18222 - protein, 122 aa, Artificial Sequence; identical to SEQ ID NO: 12674
  Description of Artificial Sequence: Synthetic polypeptide
  VH of XENP018284

SEQ ID NO: 18223 - protein, 5 aa, Artificial Sequence
  Description of Artificial Sequence: Synthetic peptide
  XENP018284 vhCDR1
NYWMN

SEQ ID NO: 18224 - protein, 19 aa, Artificial Sequence
  Description of Artificial Sequence: Synthetic peptide
  XENP018284 vhCDR2
EIRLKSNNYATHYAEPVKG

SEQ ID NO: 18225 - protein, 11 aa, Artificial Sequence
  Description of Artificial Sequence: Synthetic peptide
  XENP018284 vhCDR3
YDGNYGGYFDV

SEQ ID NO: 18226 - protein, 214 aa, Artificial Sequence; identical to SEQ ID NO: 16226
  Description of Artificial Sequence: Synthetic polypeptide
  XENP018284 1G6_H1.183_L1_IgG1_PVA_/S267K Light Chain

SEQ ID NO: 18227 - protein, 107 aa, Artificial Sequence; identical to SEQ ID NO: 10923
  Description of Artificial Sequence: Synthetic polypeptide
  VL of XENP018284

SEQ ID NO: 18228 - protein, 11 aa, Artificial Sequence
  Description of Artificial Sequence: Synthetic peptide
  XENP018284 vlCDR1
RASQSVSNDVA

SEQ ID NO: 18229 - protein, 7 aa, Artificial Sequence
  Description of Artificial Sequence: Synthetic peptide
  XENP018284 vlCDR2
YASHRYT

SEQ ID NO: 18230 - protein, 9 aa, Artificial Sequence
  Description of Artificial Sequence: Synthetic peptide
  XENP018284 vlCDR3
QQDYSSPRT

SEQ ID NO: 18231 - protein, 451 aa, Artificial Sequence
  Description of Artificial Sequence: Synthetic polypeptide
  XENP018285 1G6_H1.184_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYKGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 18232 - protein, 122 aa, Artificial Sequence; identical to SEQ ID NO: 12683
  Description of Artificial Sequence: Synthetic polypeptide
  VH of XENP018285

SEQ ID NO: 18233 - protein, 5 aa, Artificial Sequence
  Description of Artificial Sequence: Synthetic peptide
  XENP018285 vhCDR1
NYWMN

SEQ ID NO: 18234 - protein, 19 aa, Artificial Sequence
  Description of Artificial Sequence: Synthetic peptide
  XENP018285 vhCDR2
EIRLKSNNYATHYAEPVKG

SEQ ID NO: 18235 - protein, 11 aa, Artificial Sequence
  Description of Artificial Sequence: Synthetic peptide
  XENP018285 vhCDR3
YKGNYGGYFDV

SEQ ID NO: 18236 - protein, 214 aa, Artificial Sequence; identical to SEQ ID NO: 16226
  Description of Artificial Sequence: Synthetic polypeptide
  XENP018285 1G6_H1.184_L1_IgG1_PVA_/S267K Light Chain

SEQ ID NO: 18237 - protein, 107 aa, Artificial Sequence; identical to SEQ ID NO: 10923
  Description of Artificial Sequence: Synthetic polypeptide
  VL of XENP018285

SEQ ID NO: 18238 - protein, 11 aa, Artificial Sequence
  Description of Artificial Sequence: Synthetic peptide
  XENP018285 vlCDR1
RASQSVSNDVA

SEQ ID NO: 18239 - protein, 7 aa, Artificial Sequence
  Description of Artificial Sequence: Synthetic peptide
  XENP018285 vlCDR2
YASHRYT

SEQ ID NO: 18240 - protein, 9 aa, Artificial Sequence
  Description of Artificial Sequence: Synthetic peptide
  XENP018285 vlCDR3
QQDYSSPRT

SEQ ID NO: 18241 - protein, 451 aa, Artificial Sequence
  Description of Artificial Sequence: Synthetic polypeptide
  XENP018286 1G6_H1.185_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYANYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 18242 - protein, 122 aa, Artificial Sequence; identical to SEQ ID NO: 12692
  Description of Artificial Sequence: Synthetic polypeptide
  VH of XENP018286

SEQ ID NO: 18243 - protein, 5 aa, Artificial Sequence
  Description of Artificial Sequence: Synthetic peptide
  XENP018286 vhCDR1
NYWMN

SEQ ID NO: 18244 - protein, 19 aa, Artificial Sequence
  Description of Artificial Sequence: Synthetic peptide
  XENP018286 vhCDR2
EIRLKSNNYATHYAEPVKG

SEQ ID NO: 18245 - protein, 11 aa, Artificial Sequence
  Description of Artificial Sequence: Synthetic peptide
  XENP018286 vhCDR3
YYANYGGYFDV

SEQ ID NO: 18246 - protein, 214 aa, Artificial Sequence; identical to SEQ ID NO: 16226
  Description of Artificial Sequence: Synthetic polypeptide
  XENP018286 1G6_H1.185_L1_IgG1_PVA_/S267K Light Chain

SEQ ID NO: 18247 - protein, 107 aa, Artificial Sequence; identical to SEQ ID NO: 10923
  Description of Artificial Sequence: Synthetic polypeptide
  VL of XENP018286

SEQ ID NO: 18248 - protein, 11 aa, Artificial Sequence
  Description of Artificial Sequence: Synthetic peptide
  XENP018286 vlCDR1
RASQSVSNDVA

SEQ ID NO: 18249 - protein, 7 aa, Artificial Sequence
  Description of Artificial Sequence: Synthetic peptide
  XENP018286 vlCDR2
YASHRYT

SEQ ID NO: 18250 - protein, 9 aa, Artificial Sequence
  Description of Artificial Sequence: Synthetic peptide
  XENP018286 vlCDR3
QQDYSSPRT

SEQ ID NO: 18251 - protein, 451 aa, Artificial Sequence
  Description of Artificial Sequence: Synthetic polypeptide
  XENP018287 1G6_H1.186_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYSNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 18252 - protein, 122 aa, Artificial Sequence; identical to SEQ ID NO: 12701
  Description of Artificial Sequence: Synthetic polypeptide
  VH of XENP018287

SEQ ID NO: 18253 - protein, 5 aa, Artificial Sequence
  Description of Artificial Sequence: Synthetic peptide
  XENP018287 vhCDR1
NYWMN

SEQ ID NO: 18254 - protein, 19 aa, Artificial Sequence
  Description of Artificial Sequence: Synthetic peptide
  XENP018287 vhCDR2
EIRLKSNNYATHYAEPVKG

SEQ ID NO: 18255 - protein, 11 aa, Artificial Sequence
  Description of Artificial Sequence: Synthetic peptide
  XENP018287 vhCDR3
YYSNYGGYFDV

SEQ ID NO: 18256 - protein, 214 aa, Artificial Sequence; identical to SEQ ID NO: 16226
  Description of Artificial Sequence: Synthetic polypeptide
  XENP018287 1G6_H1.186_L1_IgG1_PVA_/S267K Light Chain

SEQ ID NO: 18257 - protein, 107 aa, Artificial Sequence; identical to SEQ ID NO: 10923
  Description of Artificial Sequence: Synthetic polypeptide
  VL of XENP018287

SEQ ID NO: 18258 - protein, 11 aa, Artificial Sequence
  Description of Artificial Sequence: Synthetic peptide
  XENP018287 vlCDR1
RASQSVSNDVA

SEQ ID NO: 18259 - protein, 7 aa, Artificial Sequence
  Description of Artificial Sequence: Synthetic peptide
  XENP018287 vlCDR2
YASHRYT

SEQ ID NO: 18260 - protein, 9 aa, Artificial Sequence
  Description of Artificial Sequence: Synthetic peptide
  XENP018287 vlCDR3
QQDYSSPRT

SEQ ID NO: 18261 - protein, 451 aa, Artificial Sequence
  Description of Artificial Sequence: Synthetic polypeptide
  XENP018288 1G6_H1.187_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYTNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 18262 - protein, 122 aa, Artificial Sequence; identical to SEQ ID NO: 12710
  Description of Artificial Sequence: Synthetic polypeptide
  VH of XENP018288

SEQ ID NO: 18263 - protein, 5 aa, Artificial Sequence
  Description of Artificial Sequence: Synthetic peptide
  XENP018288 vhCDR1
NYWMN

SEQ ID NO: 18264 - protein, 19 aa, Artificial Sequence
  Description of Artificial Sequence: Synthetic peptide
  XENP018288 vhCDR2
EIRLKSNNYATHYAEPVKG

SEQ ID NO: 18265 - protein, 11 aa, Artificial Sequence
  Description of Artificial Sequence: Synthetic peptide
  XENP018288 vhCDR3
YYTNYGGYFDV

SEQ ID NO: 18266 - protein, 214 aa, Artificial Sequence; identical to SEQ ID NO: 16226
  Description of Artificial Sequence: Synthetic polypeptide
  XENP018288 1G6_H1.187_L1_IgG1_PVA_/S267K Light Chain

SEQ ID NO: 18267 - protein, 107 aa, Artificial Sequence; identical to SEQ ID NO: 10923
  Description of Artificial Sequence: Synthetic polypeptide
  VL of XENP018288

SEQ ID NO: 18268 - protein, 11 aa, Artificial Sequence
  Description of Artificial Sequence: Synthetic peptide
  XENP018288 vlCDR1
RASQSVSNDVA

SEQ ID NO: 18269 - protein, 7 aa, Artificial Sequence
  Description of Artificial Sequence: Synthetic peptide
  XENP018288 vlCDR2
YASHRYT

SEQ ID NO: 18270 - protein, 9 aa, Artificial Sequence
  Description of Artificial Sequence: Synthetic peptide
  XENP018288 vlCDR3
QQDYSSPRT

SEQ ID NO: 18271 - protein, 451 aa, Artificial Sequence
  Description of Artificial Sequence: Synthetic polypeptide
  XENP018289 1G6_H1.188_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYQNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 18272 - protein, 122 aa, Artificial Sequence; identical to SEQ ID NO: 12719
  Description of Artificial Sequence: Synthetic polypeptide
  VH of XENP018289

SEQ ID NO: 18273 - protein, 5 aa, Artificial Sequence
  Description of Artificial Sequence: Synthetic peptide
  XENP018289 vhCDR1
NYWMN

SEQ ID NO: 18274 - protein, 19 aa, Artificial Sequence
  Description of Artificial Sequence: Synthetic peptide
  XENP018289 vhCDR2
EIRLKSNNYATHYAEPVKG

SEQ ID NO: 18275 - protein, 11 aa, Artificial Sequence
  Description of Artificial Sequence: Synthetic peptide
  XENP018289 vhCDR3
YYQNYGGYFDV

SEQ ID NO: 18276 - protein, 214 aa, Artificial Sequence; identical to SEQ ID NO: 16226
  Description of Artificial Sequence: Synthetic polypeptide
  XENP018289 1G6_H1.188_L1_IgG1_PVA_/S267K Light Chain

SEQ ID NO: 18277 - protein, 107 aa, Artificial Sequence; identical to SEQ ID NO: 10923
  Description of Artificial Sequence: Synthetic polypeptide
  VL of XENP018289

SEQ ID NO: 18278 - protein, 11 aa, Artificial Sequence
  Description of Artificial Sequence: Synthetic peptide
  XENP018289 vlCDR1
RASQSVSNDVA

SEQ ID NO: 18279 - protein, 7 aa, Artificial Sequence
  Description of Artificial Sequence: Synthetic peptide
  XENP018289 vlCDR2
YASHRYT

SEQ ID NO: 18280 - protein, 9 aa, Artificial Sequence
  Description of Artificial Sequence: Synthetic peptide
  XENP018289 vlCDR3
QQDYSSPRT

SEQ ID NO: 18281 - protein, 451 aa, Artificial Sequence
  Description of Artificial Sequence: Synthetic polypeptide
  XENP018290 1G6_H1.189_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYHNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 18282 - protein, 122 aa, Artificial Sequence; identical to SEQ ID NO: 12728
  Description of Artificial Sequence: Synthetic polypeptide
  VH of XENP018290

SEQ ID NO: 18283 - protein, 5 aa, Artificial Sequence
  Description of Artificial Sequence: Synthetic peptide
  XENP018290 vhCDR1
NYWMN

SEQ ID NO: 18284 - protein, 19 aa, Artificial Sequence
  Description of Artificial Sequence: Synthetic peptide
  XENP018290 vhCDR2
EIRLKSNNYATHYAEPVKG

SEQ ID NO: 18285 - protein, 11 aa, Artificial Sequence
  Description of Artificial Sequence: Synthetic peptide
  XENP018290 vhCDR3
YYHNYGGYFDV

SEQ ID NO: 18286 - protein, 214 aa, Artificial Sequence; identical to SEQ ID NO: 16226
  Description of Artificial Sequence: Synthetic polypeptide
  XENP018290 1G6_H1.189_L1_IgG1_PVA_/S267K Light Chain

SEQ ID NO: 18287 - protein, 107 aa, Artificial Sequence; identical to SEQ ID NO: 10923
  Description of Artificial Sequence: Synthetic polypeptide
  VL of XENP018290

SEQ ID NO: 18288 - protein, 11 aa, Artificial Sequence
  Description of Artificial Sequence: Synthetic peptide
  XENP018290 vlCDR1
RASQSVSNDVA

SEQ ID NO: 18289 - protein, 7 aa, Artificial Sequence
  Description of Artificial Sequence: Synthetic peptide
  XENP018290 vlCDR2
YASHRYT

SEQ ID NO: 18290 - protein, 9 aa, Artificial Sequence
  Description of Artificial Sequence: Synthetic peptide
  XENP018290 vlCDR3
QQDYSSPRT

SEQ ID NO: 18291 - protein, 451 aa, Artificial Sequence
  Description of Artificial Sequence: Synthetic polypeptide
  XENP018291 1G6_H1.190_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYDNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 18292 - protein, 122 aa, Artificial Sequence; identical to SEQ ID NO: 12737
  Description of Artificial Sequence: Synthetic polypeptide
  VH of XENP018291

SEQ ID NO: 18293 - protein, 5 aa, Artificial Sequence
  Description of Artificial Sequence: Synthetic peptide
  XENP018291 vhCDR1
NYWMN

SEQ ID NO: 18294 - protein, 19 aa, Artificial Sequence
  Description of Artificial Sequence: Synthetic peptide
  XENP018291 vhCDR2
EIRLKSNNYATHYAEPVKG

SEQ ID NO: 18295 - protein, 11 aa, Artificial Sequence
  Description of Artificial Sequence: Synthetic peptide
  XENP018291 vhCDR3
YYDNYGGYFDV

SEQ ID NO: 18296 - protein, 214 aa, Artificial Sequence; identical to SEQ ID NO: 16226
  Description of Artificial Sequence: Synthetic polypeptide
  XENP018291 1G6_H1.190_L1_IgG1_PVA_/S267K Light Chain

SEQ ID NO: 18297 - protein, 107 aa, Artificial Sequence; identical to SEQ ID NO: 10923
  Description of Artificial Sequence: Synthetic polypeptide
  VL of XENP018291

SEQ ID NO: 18298 - protein, 11 aa, Artificial Sequence
  Description of Artificial Sequence: Synthetic peptide
  XENP018291 vlCDR1
RASQSVSNDVA

SEQ ID NO: 18299 - protein, 7 aa, Artificial Sequence
  Description of Artificial Sequence: Synthetic peptide
  XENP018291 vlCDR2
YASHRYT

SEQ ID NO: 18300 - protein, 9 aa, Artificial Sequence
  Description of Artificial Sequence: Synthetic peptide
  XENP018291 vlCDR3
QQDYSSPRT

SEQ ID NO: 18301 - protein, 451 aa, Artificial Sequence
  Description of Artificial Sequence: Synthetic polypeptide
  XENP018292 1G6_H1.191_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYKNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 18302 - protein, 122 aa, Artificial Sequence; identical to SEQ ID NO: 12746
  Description of Artificial Sequence: Synthetic polypeptide
  VH of XENP018292

SEQ ID NO: 18303 - protein, 5 aa, Artificial Sequence
  Description of Artificial Sequence: Synthetic peptide
  XENP018292 vhCDR1
NYWMN

SEQ ID NO: 18304 - protein, 19 aa, Artificial Sequence
  Description of Artificial Sequence: Synthetic peptide
  XENP018292 vhCDR2
EIRLKSNNYATHYAEPVKG

SEQ ID NO: 18305 - protein, 11 aa, Artificial Sequence
  Description of Artificial Sequence: Synthetic peptide
  XENP018292 vhCDR3
YYKNYGGYFDV

SEQ ID NO: 18306 - protein, 214 aa, Artificial Sequence; identical to SEQ ID NO: 16226
  Description of Artificial Sequence: Synthetic polypeptide
  XENP018292 1G6_H1.191_L1_IgG1_PVA_/S267K Light Chain

SEQ ID NO: 18307 - protein, 107 aa, Artificial Sequence; identical to SEQ ID NO: 10923
  Description of Artificial Sequence: Synthetic polypeptide
  VL of XENP018292

SEQ ID NO: 18308 - protein, 11 aa, Artificial Sequence
  Description of Artificial Sequence: Synthetic peptide
  XENP018292 vlCDR1
RASQSVSNDVA

SEQ ID NO: 18309 - protein, 7 aa, Artificial Sequence
  Description of Artificial Sequence: Synthetic peptide
  XENP018292 vlCDR2
YASHRYT

SEQ ID NO: 18310 - protein, 9 aa, Artificial Sequence
  Description of Artificial Sequence: Synthetic peptide
  XENP018292 vlCDR3
QQDYSSPRT

SEQ ID NO: 18311 - protein, 451 aa, Artificial Sequence
  Description of Artificial Sequence: Synthetic polypeptide
  XENP018293 1G6_H1.192_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYLNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 18312 - protein, 122 aa, Artificial Sequence; identical to SEQ ID NO: 12755
  Description of Artificial Sequence: Synthetic polypeptide
  VH of XENP018293

SEQ ID NO: 18313 - protein, 5 aa, Artificial Sequence
  Description of Artificial Sequence: Synthetic peptide
  XENP018293 vhCDR1
NYWMN

SEQ ID NO: 18314 - protein, 19 aa, Artificial Sequence
  Description of Artificial Sequence: Synthetic peptide
  XENP018293 vhCDR2
EIRLKSNNYATHYAEPVKG

SEQ ID NO: 18315 - protein, 11 aa, Artificial Sequence
  Description of Artificial Sequence: Synthetic peptide
  XENP018293 vhCDR3
YYLNYGGYFDV

SEQ ID NO: 18316 - protein, 214 aa, Artificial Sequence; identical to SEQ ID NO: 16226
  Description of Artificial Sequence: Synthetic polypeptide
  XENP018293 1G6_H1.192_L1_IgG1_PVA_/S267K Light Chain

SEQ ID NO: 18317 - protein, 107 aa, Artificial Sequence; identical to SEQ ID NO: 10923
  Description of Artificial Sequence: Synthetic polypeptide
  VL of XENP018293

SEQ ID NO: 18318 - protein, 11 aa, Artificial Sequence
  Description of Artificial Sequence: Synthetic peptide
  XENP018293 vlCDR1
RASQSVSNDVA

SEQ ID NO: 18319 - protein, 7 aa, Artificial Sequence
  Description of Artificial Sequence: Synthetic peptide
  XENP018293 vlCDR2
YASHRYT

SEQ ID NO: 18320 - protein, 9 aa, Artificial Sequence
  Description of Artificial Sequence: Synthetic peptide
  XENP018293 vlCDR3
QQDYSSPRT

SEQ ID NO: 18321 - protein, 451 aa, Artificial Sequence
  Description of Artificial Sequence: Synthetic polypeptide
  XENP018294 1G6_H1.193_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYFNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 18322 - protein, 122 aa, Artificial Sequence; identical to SEQ ID NO: 12764
  Description of Artificial Sequence: Synthetic polypeptide
  VH of XENP018294

SEQ ID NO: 18323 - protein, 5 aa, Artificial Sequence
  Description of Artificial Sequence: Synthetic peptide
  XENP018294 vhCDR1
NYWMN

SEQ ID NO: 18324 - protein, 19 aa, Artificial Sequence
  Description of Artificial Sequence: Synthetic peptide
  XENP018294 vhCDR2
EIRLKSNNYATHYAEPVKG

SEQ ID NO: 18325 - protein, 11 aa, Artificial Sequence
  Description of Artificial Sequence: Synthetic peptide
  XENP018294 vhCDR3
YYFNYGGYFDV

SEQ ID NO: 18326 - protein, 214 aa, Artificial Sequence; identical to SEQ ID NO: 16226
  Description of Artificial Sequence: Synthetic polypeptide
  XENP018294 1G6_H1.193_L1_IgG1_PVA_/S267K Light Chain

SEQ ID NO: 18327 - protein, 107 aa, Artificial Sequence; identical to SEQ ID NO: 10923
  Description of Artificial Sequence: Synthetic polypeptide
  VL of XENP018294

SEQ ID NO: 18328 - protein, 11 aa, Artificial Sequence
  Description of Artificial Sequence: Synthetic peptide
  XENP018294 vlCDR1
RASQSVSNDVA

SEQ ID NO: 18329 - protein, 7 aa, Artificial Sequence
  Description of Artificial Sequence: Synthetic peptide
  XENP018294 vlCDR2
YASHRYT

SEQ ID NO: 18330 - protein, 9 aa, Artificial Sequence
  Description of Artificial Sequence: Synthetic peptide
  XENP018294 vlCDR3
QQDYSSPRT

SEQ ID NO: 18331 - protein, 451 aa, Artificial Sequence
  Description of Artificial Sequence: Synthetic polypeptide
  XENP018295 1G6_H1.194_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGDYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 18332 - protein, 122 aa, Artificial Sequence; identical to SEQ ID NO: 12773
  Description of Artificial Sequence: Synthetic polypeptide
  VH of XENP018295

SEQ ID NO: 18333 - protein, 5 aa, Artificial Sequence
  Description of Artificial Sequence: Synthetic peptide
  XENP018295 vhCDR1
NYWMN

SEQ ID NO: 18334 - protein, 19 aa, Artificial Sequence
  Description of Artificial Sequence: Synthetic peptide
  XENP018295 vhCDR2
EIRLKSNNYATHYAEPVKG

SEQ ID NO: 18335 - protein, 11 aa, Artificial Sequence
  Description of Artificial Sequence: Synthetic peptide
  XENP018295 vhCDR3
YYGDYGGYFDV

SEQ ID NO: 18336 - protein, 214 aa, Artificial Sequence; identical to SEQ ID NO: 16226
  Description of Artificial Sequence: Synthetic polypeptide
  XENP018295 1G6_H1.194_L1_IgG1_PVA_/S267K Light Chain

SEQ ID NO: 18337 - protein, 107 aa, Artificial Sequence; identical to SEQ ID NO: 10923
  Description of Artificial Sequence: Synthetic polypeptide
  VL of XENP018295

SEQ ID NO: 18338 - protein, 11 aa, Artificial Sequence
  Description of Artificial Sequence: Synthetic peptide
  XENP018295 vlCDR1
RASQSVSNDVA

SEQ ID NO: 18339 - protein, 7 aa, Artificial Sequence
  Description of Artificial Sequence: Synthetic peptide
  XENP018295 vlCDR2
YASHRYT

SEQ ID NO: 18340 - protein, 9 aa, Artificial Sequence
  Description of Artificial Sequence: Synthetic peptide
  XENP018295 vlCDR3
QQDYSSPRT

SEQ ID NO: 18341 - protein, 451 aa, Artificial Sequence
  Description of Artificial Sequence: Synthetic polypeptide
  XENP018296 1G6_H1.195_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGHYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 18342 - protein, 122 aa, Artificial Sequence; identical to SEQ ID NO: 12782
  Description of Artificial Sequence: Synthetic polypeptide
  VH of XENP018296

SEQ ID NO: 18343 - protein, 5 aa, Artificial Sequence
  Description of Artificial Sequence: Synthetic peptide
  XENP018296 vhCDR1
NYWMN

SEQ ID NO: 18344 - protein, 19 aa, Artificial Sequence
  Description of Artificial Sequence: Synthetic peptide
  XENP018296 vhCDR2
EIRLKSNNYATHYAEPVKG

SEQ ID NO: 18345 - protein, 11 aa, Artificial Sequence
  Description of Artificial Sequence: Synthetic peptide
  XENP018296 vhCDR3
YYGHYGGYFDV

SEQ ID NO: 18346 - protein, 214 aa, Artificial Sequence; identical to SEQ ID NO: 16226
  Description of Artificial Sequence: Synthetic polypeptide
  XENP018296 1G6_H1.195_L1_IgG1_PVA_/S267K Light Chain

SEQ ID NO: 18347 - protein, 107 aa, Artificial Sequence; identical to SEQ ID NO: 10923
  Description of Artificial Sequence: Synthetic polypeptide
  VL of XENP018296

SEQ ID NO: 18348 - protein, 11 aa, Artificial Sequence
  Description of Artificial Sequence: Synthetic peptide
  XENP018296 vlCDR1
RASQSVSNDVA

SEQ ID NO: 18349 - protein, 7 aa, Artificial Sequence
  Description of Artificial Sequence: Synthetic peptide
  XENP018296 vlCDR2
YASHRYT

SEQ ID NO: 18350 - protein, 9 aa, Artificial Sequence
  Description of Artificial Sequence: Synthetic peptide
  XENP018296 vlCDR3
QQDYSSPRT

SEQ ID NO: 18351 - protein, 451 aa, Artificial Sequence
  Description of Artificial Sequence: Synthetic polypeptide
  XENP018301 1G6_H1.196_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGEYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 18352 - protein, 122 aa, Artificial Sequence; identical to SEQ ID NO: 12791
  Description of Artificial Sequence: Synthetic polypeptide
  VH of XENP018301

SEQ ID NO: 18353 - protein, 5 aa, Artificial Sequence
  Description of Artificial Sequence: Synthetic peptide
  XENP018301 vhCDR1
NYWMN

SEQ ID NO: 18354 - protein, 19 aa, Artificial Sequence
  Description of Artificial Sequence: Synthetic peptide
  XENP018301 vhCDR2
EIRLKSNNYATHYAEPVKG

SEQ ID NO: 18355 - protein, 11 aa, Artificial Sequence
  Description of Artificial Sequence: Synthetic peptide
  XENP018301 vhCDR3
YYGEYGGYFDV

SEQ ID NO: 18356 - protein, 214 aa, Artificial Sequence; identical to SEQ ID NO: 16226
  Description of Artificial Sequence: Synthetic polypeptide
  XENP018301 1G6_H1.196_L1_IgG1_PVA_/S267K Light Chain

SEQ ID NO: 18357 - protein, 107 aa, Artificial Sequence; identical to SEQ ID NO: 10923
  Description of Artificial Sequence: Synthetic polypeptide
  VL of XENP018301

SEQ ID NO: 18358 - protein, 11 aa, Artificial Sequence
  Description of Artificial Sequence: Synthetic peptide
  XENP018301 vlCDR1
RASQSVSNDVA

SEQ ID NO: 18359 - protein, 7 aa, Artificial Sequence
  Description of Artificial Sequence: Synthetic peptide
  XENP018301 vlCDR2
YASHRYT

SEQ ID NO: 18360 - protein, 9 aa, Artificial Sequence
  Description of Artificial Sequence: Synthetic peptide
  XENP018301 vlCDR3
QQDYSSPRT

SEQ ID NO: 18361 - protein, 451 aa, Artificial Sequence
  Description of Artificial Sequence: Synthetic polypeptide
  XENP018302 1G6_H1.197_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGSYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 18362 - protein, 122 aa, Artificial Sequence; identical to SEQ ID NO: 12800
  Description of Artificial Sequence: Synthetic polypeptide
  VH of XENP018302

SEQ ID NO: 18363 - protein, 5 aa, Artificial Sequence
  Description of Artificial Sequence: Synthetic peptide
  XENP018302 vhCDR1
NYWMN

SEQ ID NO: 18364 - protein, 19 aa, Artificial Sequence
  Description of Artificial Sequence: Synthetic peptide
  XENP018302 vhCDR2
EIRLKSNNYATHYAEPVKG

SEQ ID NO: 18365 - protein, 11 aa, Artificial Sequence
  Description of Artificial Sequence: Synthetic peptide
  XENP018302 vhCDR3
YYGSYGGYFDV

SEQ ID NO: 18366 - protein, 214 aa, Artificial Sequence; identical to SEQ ID NO: 16226
  Description of Artificial Sequence: Synthetic polypeptide
  XENP018302 1G6_H1.197_L1_IgG1_PVA_/S267K Light Chain

SEQ ID NO: 18367 - protein, 107 aa, Artificial Sequence; identical to SEQ ID NO: 10923
  Description of Artificial Sequence: Synthetic polypeptide
  VL of XENP018302

SEQ ID NO: 18368 - protein, 11 aa, Artificial Sequence
  Description of Artificial Sequence: Synthetic peptide
  XENP018302 vlCDR1
RASQSVSNDVA

SEQ ID NO: 18369 - protein, 7 aa, Artificial Sequence
  Description of Artificial Sequence: Synthetic peptide
  XENP018302 vlCDR2
YASHRYT

SEQ ID NO: 18370 - protein, 9 aa, Artificial Sequence
  Description of Artificial Sequence: Synthetic peptide
  XENP018302 vlCDR3
QQDYSSPRT

SEQ ID NO: 18371 - protein, 451 aa, Artificial Sequence
  Description of Artificial Sequence: Synthetic polypeptide
  XENP018303 1G6_H1.198_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGRYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 18372 - protein, 122 aa, Artificial Sequence; identical to SEQ ID NO: 12809
  Description of Artificial Sequence: Synthetic polypeptide
  VH of XENP018303

SEQ ID NO: 18373 - protein, 5 aa, Artificial Sequence
  Description of Artificial Sequence: Synthetic peptide
  XENP018303 vhCDR1
NYWMN

SEQ ID NO: 18374 - protein, 19 aa, Artificial Sequence
  Description of Artificial Sequence: Synthetic peptide
  XENP018303 vhCDR2
EIRLKSNNYATHYAEPVKG

SEQ ID NO: 18375 - protein, 11 aa, Artificial Sequence
  Description of Artificial Sequence: Synthetic peptide
  XENP018303 vhCDR3
YYGRYGGYFDV

SEQ ID NO: 18376 - protein, 214 aa, Artificial Sequence; identical to SEQ ID NO: 16226
  Description of Artificial Sequence: Synthetic polypeptide
  XENP018303 1G6_H1.198_L1_IgG1_PVA_/S267K Light Chain

SEQ ID NO: 18377 - protein, 107 aa, Artificial Sequence; identical to SEQ ID NO: 10923
  Description of Artificial Sequence: Synthetic polypeptide
  VL of XENP018303

SEQ ID NO: 18378 - protein, 11 aa, Artificial Sequence
  Description of Artificial Sequence: Synthetic peptide
  XENP018303 vlCDR1
RASQSVSNDVA

SEQ ID NO: 18379 - protein, 7 aa, Artificial Sequence
  Description of Artificial Sequence: Synthetic peptide
  XENP018303 vlCDR2
YASHRYT

SEQ ID NO: 18380 - protein, 9 aa, Artificial Sequence
  Description of Artificial Sequence: Synthetic peptide
  XENP018303 vlCDR3
QQDYSSPRT

SEQ ID NO: 18381 - protein, 451 aa, Artificial Sequence
  Description of Artificial Sequence: Synthetic polypeptide
  XENP018304 1G6_H1.199_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGLYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 18382 - protein, 122 aa, Artificial Sequence; identical to SEQ ID NO: 12818
  Description of Artificial Sequence: Synthetic polypeptide
  VH of XENP018304

SEQ ID NO: 18383 - protein, 5 aa, Artificial Sequence
  Description of Artificial Sequence: Synthetic peptide
  XENP018304 vhCDR1
NYWMN

SEQ ID NO: 18384 - protein, 19 aa, Artificial Sequence
  Description of Artificial Sequence: Synthetic peptide
  XENP018304 vhCDR2
EIRLKSNNYATHYAEPVKG

SEQ ID NO: 18385 - protein, 11 aa, Artificial Sequence
  Description of Artificial Sequence: Synthetic peptide
  XENP018304 vhCDR3
YYGLYGGYFDV

SEQ ID NO: 18386 - protein, 214 aa, Artificial Sequence; identical to SEQ ID NO: 16226
  Description of Artificial Sequence: Synthetic polypeptide
  XENP018304 1G6_H1.199_L1_IgG1_PVA_/S267K Light Chain

SEQ ID NO: 18387 - protein, 107 aa, Artificial Sequence; identical to SEQ ID NO: 10923
  Description of Artificial Sequence: Synthetic polypeptide
  VL of XENP018304

SEQ ID NO: 18388 - protein, 11 aa, Artificial Sequence
  Description of Artificial Sequence: Synthetic peptide
  XENP018304 vlCDR1
RASQSVSNDVA

SEQ ID NO: 18389 - protein, 7 aa, Artificial Sequence
  Description of Artificial Sequence: Synthetic peptide
  XENP018304 vlCDR2
YASHRYT

SEQ ID NO: 18390 - protein, 9 aa, Artificial Sequence
  Description of Artificial Sequence: Synthetic peptide
  XENP018304 vlCDR3
QQDYSSPRT

SEQ ID NO: 18391 - protein, 451 aa, Artificial Sequence
  Description of Artificial Sequence: Synthetic polypeptide
  XENP018305 1G6_H1.200_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGTYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 18392 - protein, 122 aa, Artificial Sequence; identical to SEQ ID NO: 12827
  Description of Artificial Sequence: Synthetic polypeptide
  VH of XENP018305

SEQ ID NO: 18393 - protein, 5 aa, Artificial Sequence
  Description of Artificial Sequence: Synthetic peptide
  XENP018305 vhCDR1
NYWMN

SEQ ID NO: 18394 - protein, 19 aa, Artificial Sequence
  Description of Artificial Sequence: Synthetic peptide
  XENP018305 vhCDR2
EIRLKSNNYATHYAEPVKG

SEQ ID NO: 18395 - protein, 11 aa, Artificial Sequence
  Description of Artificial Sequence: Synthetic peptide
  XENP018305 vhCDR3
YYGTYGGYFDV

SEQ ID NO: 18396 - protein, 214 aa, Artificial Sequence; identical to SEQ ID NO: 16226
  Description of Artificial Sequence: Synthetic polypeptide
  XENP018305 1G6_H1.200_L1_IgG1_PVA_/S267K Light Chain

SEQ ID NO: 18397 - protein, 107 aa, Artificial Sequence; identical to SEQ ID NO: 10923
  Description of Artificial Sequence: Synthetic polypeptide
  VL of XENP018305

SEQ ID NO: 18398 - protein, 11 aa, Artificial Sequence
  Description of Artificial Sequence: Synthetic peptide
  XENP018305 vlCDR1
RASQSVSNDVA

SEQ ID NO: 18399 - protein, 7 aa, Artificial Sequence
  Description of Artificial Sequence: Synthetic peptide
  XENP018305 vlCDR2
YASHRYT

SEQ ID NO: 18400 - protein, 9 aa, Artificial Sequence
  Description of Artificial Sequence: Synthetic peptide
  XENP018305 vlCDR3
QQDYSSPRT

SEQ ID NO: 18401 - protein, 451 aa, Artificial Sequence
  Description of Artificial Sequence: Synthetic polypeptide
  XENP018306 1G6_H1.201_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGGYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 18402 - protein, 122 aa, Artificial Sequence; identical to SEQ ID NO: 12836
  Description of Artificial Sequence: Synthetic polypeptide
  VH of XENP018306

SEQ ID NO: 18403 - protein, 5 aa, Artificial Sequence
  Description of Artificial Sequence: Synthetic peptide
  XENP018306 vhCDR1
NYWMN

SEQ ID NO: 18404 - protein, 19 aa, Artificial Sequence
  Description of Artificial Sequence: Synthetic peptide
  XENP018306 vhCDR2
EIRLKSNNYATHYAEPVKG

SEQ ID NO: 18405 - protein, 11 aa, Artificial Sequence
  Description of Artificial Sequence: Synthetic peptide
  XENP018306 vhCDR3
YYGGYGGYFDV

SEQ ID NO: 18406 - protein, 214 aa, Artificial Sequence; identical to SEQ ID NO: 16226
  Description of Artificial Sequence: Synthetic polypeptide
  XENP018306 1G6_H1.201_L1_IgG1_PVA_/S267K Light Chain

SEQ ID NO: 18407 - protein, 107 aa, Artificial Sequence; identical to SEQ ID NO: 10923
  Description of Artificial Sequence: Synthetic polypeptide
  VL of XENP018306

SEQ ID NO: 18408 - protein, 11 aa, Artificial Sequence
  Description of Artificial Sequence: Synthetic peptide
  XENP018306 vlCDR1
RASQSVSNDVA

SEQ ID NO: 18409 - protein, 7 aa, Artificial Sequence
  Description of Artificial Sequence: Synthetic peptide
  XENP018306 vlCDR2
YASHRYT

SEQ ID NO: 18410 - protein, 9 aa, Artificial Sequence
  Description of Artificial Sequence: Synthetic peptide
  XENP018306 vlCDR3
QQDYSSPRT

SEQ ID NO: 18411 - protein, 451 aa, Artificial Sequence
  Description of Artificial Sequence: Synthetic polypeptide
  XENP018307 1G6_H1.202_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGFYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 18412 - protein, 122 aa, Artificial Sequence; identical to SEQ ID NO: 12845
  Description of Artificial Sequence: Synthetic polypeptide
  VH of XENP018307

SEQ ID NO: 18413 - protein, 5 aa, Artificial Sequence
  Description of Artificial Sequence: Synthetic peptide
  XENP018307 vhCDR1
NYWMN

SEQ ID NO: 18414 - protein, 19 aa, Artificial Sequence
  Description of Artificial Sequence: Synthetic peptide
  XENP018307 vhCDR2
EIRLKSNNYATHYAEPVKG

SEQ ID NO: 18415 - protein, 11 aa, Artificial Sequence
  Description of Artificial Sequence: Synthetic peptide
  XENP018307 vhCDR3
YYGFYGGYFDV

SEQ ID NO: 18416 - protein, 214 aa, Artificial Sequence; identical to SEQ ID NO: 16226
  Description of Artificial Sequence: Synthetic polypeptide
  XENP018307 1G6_H1.202_L1_IgG1_PVA_/S267K Light Chain

SEQ ID NO: 18417 - protein, 107 aa, Artificial Sequence; identical to SEQ ID NO: 10923
  Description of Artificial Sequence: Synthetic polypeptide
  VL of XENP018307

SEQ ID NO: 18418 - protein, 11 aa, Artificial Sequence
  Description of Artificial Sequence: Synthetic peptide
  XENP018307 vlCDR1
RASQSVSNDVA

SEQ ID NO: 18419 - protein, 7 aa, Artificial Sequence
  Description of Artificial Sequence: Synthetic peptide
  XENP018307 vlCDR2
YASHRYT

SEQ ID NO: 18420 - protein, 9 aa, Artificial Sequence
  Description of Artificial Sequence: Synthetic peptide
  XENP018307 vlCDR3
QQDYSSPRT

SEQ ID NO: 18421 - protein, 451 aa, Artificial Sequence
  Description of Artificial Sequence: Synthetic polypeptide
  XENP018308 1G6_H1.203_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNFGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 18422 - protein, 122 aa, Artificial Sequence; identical to SEQ ID NO: 12854
  Description of Artificial Sequence: Synthetic polypeptide
  VH of XENP018308

SEQ ID NO: 18423 - protein, 5 aa, Artificial Sequence
  Description of Artificial Sequence: Synthetic peptide
  XENP018308 vhCDR1
NYWMN

SEQ ID NO: 18424 - protein, 19 aa, Artificial Sequence
  Description of Artificial Sequence: Synthetic peptide
  XENP018308 vhCDR2
EIRLKSNNYATHYAEPVKG

SEQ ID NO: 18425 - protein, 11 aa, Artificial Sequence
  Description of Artificial Sequence: Synthetic peptide
  XENP018308 vhCDR3
YYGNFGGYFDV

SEQ ID NO: 18426 - protein, 214 aa, Artificial Sequence; identical to SEQ ID NO: 16226
  Description of Artificial Sequence: Synthetic polypeptide
  XENP018308 1G6_H1.203_L1_IgG1_PVA_/S267K Light Chain

SEQ ID NO: 18427 - protein, 107 aa, Artificial Sequence; identical to SEQ ID NO: 10923
  Description of Artificial Sequence: Synthetic polypeptide
  VL of XENP018308

SEQ ID NO: 18428 - protein, 11 aa, Artificial Sequence
  Description of Artificial Sequence: Synthetic peptide
  XENP018308 vlCDR1
RASQSVSNDVA

SEQ ID NO: 18429 - protein, 7 aa, Artificial Sequence
  Description of Artificial Sequence: Synthetic peptide
  XENP018308 vlCDR2
YASHRYT

SEQ ID NO: 18430 - protein, 9 aa, Artificial Sequence
  Description of Artificial Sequence: Synthetic peptide
  XENP018308 vlCDR3
QQDYSSPRT

SEQ ID NO: 18431 - protein, 451 aa, Artificial Sequence
  Description of Artificial Sequence: Synthetic polypeptide
  XENP018309 1G6_H1.204_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNHGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 18432 - protein, 122 aa, Artificial Sequence; identical to SEQ ID NO: 12863
  Description of Artificial Sequence: Synthetic polypeptide
  VH of XENP018309

SEQ ID NO: 18433 - protein, 5 aa, Artificial Sequence
  Description of Artificial Sequence: Synthetic peptide
  XENP018309 vhCDR1
NYWMN

SEQ ID NO: 18434 - protein, 19 aa, Artificial Sequence
  Description of Artificial Sequence: Synthetic peptide
  XENP018309 vhCDR2
EIRLKSNNYATHYAEPVKG

SEQ ID NO: 18435 - protein, 11 aa, Artificial Sequence
  Description of Artificial Sequence: Synthetic peptide
  XENP018309 vhCDR3
YYGNHGGYFDV

SEQ ID NO: 18436 - protein, 214 aa, Artificial Sequence; identical to SEQ ID NO: 16226
  Description of Artificial Sequence: Synthetic polypeptide
  XENP018309 1G6_H1.204_L1_IgG1_PVA_/S267K Light Chain

SEQ ID NO: 18437 - protein, 107 aa, Artificial Sequence; identical to SEQ ID NO: 10923
  Description of Artificial Sequence: Synthetic polypeptide
  VL of XENP018309

SEQ ID NO: 18438 - protein, 11 aa, Artificial Sequence
  Description of Artificial Sequence: Synthetic peptide
  XENP018309 vlCDR1
RASQSVSNDVA

SEQ ID NO: 18439 - protein, 7 aa, Artificial Sequence
  Description of Artificial Sequence: Synthetic peptide
  XENP018309 vlCDR2
YASHRYT

SEQ ID NO: 18440 - protein, 9 aa, Artificial Sequence
  Description of Artificial Sequence: Synthetic peptide
  XENP018309 vlCDR3
QQDYSSPRT

SEQ ID NO: 18441 - protein, 451 aa, Artificial Sequence
  Description of Artificial Sequence: Synthetic polypeptide
  XENP018310 1G6_H1.205_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNLGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 18442 - protein, 122 aa, Artificial Sequence; identical to SEQ ID NO: 12872
  Description of Artificial Sequence: Synthetic polypeptide
  VH of XENP018310

SEQ ID NO: 18443 - protein, 5 aa, Artificial Sequence
  Description of Artificial Sequence: Synthetic peptide
  XENP018310 vhCDR1
NYWMN

SEQ ID NO: 18444 - protein, 19 aa, Artificial Sequence
  Description of Artificial Sequence: Synthetic peptide
  XENP018310 vhCDR2
EIRLKSNNYATHYAEPVKG

SEQ ID NO: 18445 - protein, 11 aa, Artificial Sequence
  Description of Artificial Sequence: Synthetic peptide
  XENP018310 vhCDR3
YYGNLGGYFDV

SEQ ID NO: 18446 - protein, 214 aa, Artificial Sequence; identical to SEQ ID NO: 16226
  Description of Artificial Sequence: Synthetic polypeptide
  XENP018310 1G6_H1.205_L1_IgG1_PVA_/S267K Light Chain

SEQ ID NO: 18447 - protein, 107 aa, Artificial Sequence; identical to SEQ ID NO: 10923
  Description of Artificial Sequence: Synthetic polypeptide
  VL of XENP018310

SEQ ID NO: 18448 - protein, 11 aa, Artificial Sequence
  Description of Artificial Sequence: Synthetic peptide
  XENP018310 vlCDR1
RASQSVSNDVA

SEQ ID NO: 18449 - protein, 7 aa, Artificial Sequence
  Description of Artificial Sequence: Synthetic peptide
  XENP018310 vlCDR2
YASHRYT

SEQ ID NO: 18450 - protein, 9 aa, Artificial Sequence
  Description of Artificial Sequence: Synthetic peptide
  XENP018310 vlCDR3
QQDYSSPRT

SEQ ID NO: 18451 - protein, 451 aa, Artificial Sequence
  Description of Artificial Sequence: Synthetic polypeptide
  XENP018311 1G6_H1.206_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNWGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 18452 - protein, 122 aa, Artificial Sequence; identical to SEQ ID NO: 12881
  Description of Artificial Sequence: Synthetic polypeptide
  VH of XENP018311

SEQ ID NO: 18453 - protein, 5 aa, Artificial Sequence
  Description of Artificial Sequence: Synthetic peptide
  XENP018311 vhCDR1
NYWMN

SEQ ID NO: 18454 - protein, 19 aa, Artificial Sequence
  Description of Artificial Sequence: Synthetic peptide
  XENP018311 vhCDR2
EIRLKSNNYATHYAEPVKG

SEQ ID NO: 18455 - protein, 11 aa, Artificial Sequence
  Description of Artificial Sequence: Synthetic peptide
  XENP018311 vhCDR3
YYGNWGGYFDV

SEQ ID NO: 18456 - protein, 214 aa, Artificial Sequence; identical to SEQ ID NO: 16226
  Description of Artificial Sequence: Synthetic polypeptide
  XENP018311 1G6_H1.206_L1_IgG1_PVA_/S267K Light Chain

SEQ ID NO: 18457 - protein, 107 aa, Artificial Sequence; identical to SEQ ID NO: 10923
  Description of Artificial Sequence: Synthetic polypeptide
  VL of XENP018311

SEQ ID NO: 18458 - protein, 11 aa, Artificial Sequence
  Description of Artificial Sequence: Synthetic peptide
  XENP018311 vlCDR1
RASQSVSNDVA

SEQ ID NO: 18459 - protein, 7 aa, Artificial Sequence
  Description of Artificial Sequence: Synthetic peptide
  XENP018311 vlCDR2
YASHRYT

SEQ ID NO: 18460 - protein, 9 aa, Artificial Sequence
  Description of Artificial Sequence: Synthetic peptide
  XENP018311 vlCDR3
QQDYSSPRT

SEQ ID NO: 18461 - protein, 451 aa, Artificial Sequence
  Description of Artificial Sequence: Synthetic polypeptide
  XENP018312 1G6_H1.207_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNVGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 18462 - protein, 122 aa, Artificial Sequence; identical to SEQ ID NO: 12890
  Description of Artificial Sequence: Synthetic polypeptide
  VH of XENP018312

SEQ ID NO: 18463 - protein, 5 aa, Artificial Sequence
  Description of Artificial Sequence: Synthetic peptide
  XENP018312 vhCDR1
NYWMN

SEQ ID NO: 18464 - protein, 19 aa, Artificial Sequence
  Description of Artificial Sequence: Synthetic peptide
  XENP018312 vhCDR2
EIRLKSNNYATHYAEPVKG

SEQ ID NO: 18465 - protein, 11 aa, Artificial Sequence
  Description of Artificial Sequence: Synthetic peptide
  XENP018312 vhCDR3
YYGNVGGYFDV

SEQ ID NO: 18466 - protein, 214 aa, Artificial Sequence; identical to SEQ ID NO: 16226
  Description of Artificial Sequence: Synthetic polypeptide
  XENP018312 1G6_H1.207_L1_IgG1_PVA_/S267K Light Chain

SEQ ID NO: 18467 - protein, 107 aa, Artificial Sequence; identical to SEQ ID NO: 10923
  Description of Artificial Sequence: Synthetic polypeptide
  VL of XENP018312

SEQ ID NO: 18468 - protein, 11 aa, Artificial Sequence
  Description of Artificial Sequence: Synthetic peptide
  XENP018312 vlCDR1
RASQSVSNDVA

SEQ ID NO: 18469 - protein, 7 aa, Artificial Sequence
  Description of Artificial Sequence: Synthetic peptide
  XENP018312 vlCDR2
YASHRYT

SEQ ID NO: 18470 - protein, 9 aa, Artificial Sequence
  Description of Artificial Sequence: Synthetic peptide
  XENP018312 vlCDR3
QQDYSSPRT

SEQ ID NO: 18471 - protein, 451 aa, Artificial Sequence
  Description of Artificial Sequence: Synthetic polypeptide
  XENP018313 1G6_H1.208_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNAGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 18472 - protein, 122 aa, Artificial Sequence; identical to SEQ ID NO: 12899
  Description of Artificial Sequence: Synthetic polypeptide
  VH of XENP018313

SEQ ID NO: 18473 - protein, 5 aa, Artificial Sequence
  Description of Artificial Sequence: Synthetic peptide
  XENP018313 vhCDR1
NYWMN

SEQ ID NO: 18474 - protein, 19 aa, Artificial Sequence
  Description of Artificial Sequence: Synthetic peptide
  XENP018313 vhCDR2
EIRLKSNNYATHYAEPVKG

SEQ ID NO: 18475 - protein, 11 aa, Artificial Sequence
  Description of Artificial Sequence: Synthetic peptide
  XENP018313 vhCDR3
YYGNAGGYFDV

SEQ ID NO: 18476 - protein, 214 aa, Artificial Sequence; identical to SEQ ID NO: 16226
  Description of Artificial Sequence: Synthetic polypeptide
  XENP018313 1G6_H1.208_L1_IgG1_PVA_/S267K Light Chain

SEQ ID NO: 18477 - protein, 107 aa, Artificial Sequence; identical to SEQ ID NO: 10923
  Description of Artificial Sequence: Synthetic polypeptide
  VL of XENP018313

SEQ ID NO: 18478 - protein, 11 aa, Artificial Sequence
  Description of Artificial Sequence: Synthetic peptide
  XENP018313 vlCDR1
RASQSVSNDVA

SEQ ID NO: 18479 - protein, 7 aa, Artificial Sequence
  Description of Artificial Sequence: Synthetic peptide
  XENP018313 vlCDR2
YASHRYT

SEQ ID NO: 18480 - protein, 9 aa, Artificial Sequence
  Description of Artificial Sequence: Synthetic peptide
  XENP018313 vlCDR3
QQDYSSPRT

SEQ ID NO: 18481 - protein, 451 aa, Artificial Sequence
  Description of Artificial Sequence: Synthetic polypeptide
  XENP018314 1G6_H1.209_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNQGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 18482 - protein, 122 aa, Artificial Sequence; identical to SEQ ID NO: 12908
  Description of Artificial Sequence: Synthetic polypeptide
  VH of XENP018314

SEQ ID NO: 18483 - protein, 5 aa, Artificial Sequence
  Description of Artificial Sequence: Synthetic peptide
  XENP018314 vhCDR1
NYWMN

SEQ ID NO: 18484 - protein, 19 aa, Artificial Sequence
  Description of Artificial Sequence: Synthetic peptide
  XENP018314 vhCDR2
EIRLKSNNYATHYAEPVKG

SEQ ID NO: 18485 - protein, 11 aa, Artificial Sequence
  Description of Artificial Sequence: Synthetic peptide
  XENP018314 vhCDR3
YYGNQGGYFDV

SEQ ID NO: 18486 - protein, 214 aa, Artificial Sequence; identical to SEQ ID NO: 16226
  Description of Artificial Sequence: Synthetic polypeptide
  XENP018314 1G6_H1.209_L1_IgG1_PVA_/S267K Light Chain

SEQ ID NO: 18487 - protein, 107 aa, Artificial Sequence; identical to SEQ ID NO: 10923
  Description of Artificial Sequence: Synthetic polypeptide
  VL of XENP018314

SEQ ID NO: 18488 - protein, 11 aa, Artificial Sequence
  Description of Artificial Sequence: Synthetic peptide
  XENP018314 vlCDR1
RASQSVSNDVA

SEQ ID NO: 18489 - protein, 7 aa, Artificial Sequence
  Description of Artificial Sequence: Synthetic peptide
  XENP018314 vlCDR2
YASHRYT

SEQ ID NO: 18490 - protein, 9 aa, Artificial Sequence
  Description of Artificial Sequence: Synthetic peptide
  XENP018314 vlCDR3
QQDYSSPRT

SEQ ID NO: 18491 - protein, 451 aa, Artificial Sequence
  Description of Artificial Sequence: Synthetic polypeptide
  XENP018315 1G6_H1.210_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNEGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 18492 - protein, 122 aa, Artificial Sequence; identical to SEQ ID NO: 12917
  Description of Artificial Sequence: Synthetic polypeptide
  VH of XENP018315

SEQ ID NO: 18493 - protein, 5 aa, Artificial Sequence
  Description of Artificial Sequence: Synthetic peptide
  XENP018315 vhCDR1
NYWMN

SEQ ID NO: 18494 - protein, 19 aa, Artificial Sequence
  Description of Artificial Sequence: Synthetic peptide
  XENP018315 vhCDR2
EIRLKSNNYATHYAEPVKG

SEQ ID NO: 18495 - protein, 11 aa, Artificial Sequence
  Description of Artificial Sequence: Synthetic peptide
  XENP018315 vhCDR3
YYGNEGGYFDV

SEQ ID NO: 18496 - protein, 214 aa, Artificial Sequence; identical to SEQ ID NO: 16226
  Description of Artificial Sequence: Synthetic polypeptide
  XENP018315 1G6_H1.210_L1_IgG1_PVA_/S267K Light Chain

SEQ ID NO: 18497 - protein, 107 aa, Artificial Sequence; identical to SEQ ID NO: 10923
  Description of Artificial Sequence: Synthetic polypeptide
  VL of XENP018315

SEQ ID NO: 18498 - protein, 11 aa, Artificial Sequence
  Description of Artificial Sequence: Synthetic peptide
  XENP018315 vlCDR1
RASQSVSNDVA

SEQ ID NO: 18499 - protein, 7 aa, Artificial Sequence
  Description of Artificial Sequence: Synthetic peptide
  XENP018315 vlCDR2
YASHRYT

SEQ ID NO: 18500 - protein, 9 aa, Artificial Sequence
  Description of Artificial Sequence: Synthetic peptide
  XENP018315 vlCDR3
QQDYSSPRT

SEQ ID NO: 18501 - protein, 451 aa, Artificial Sequence
  Description of Artificial Sequence: Synthetic polypeptide
  XENP018316 1G6_H1.211_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNKGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 18502 - protein, 122 aa, Artificial Sequence; identical to SEQ ID NO: 12926
  Description of Artificial Sequence: Synthetic polypeptide
  VH of XENP018316

SEQ ID NO: 18503 - protein, 5 aa, Artificial Sequence
  Description of Artificial Sequence: Synthetic peptide
  XENP018316 vhCDR1
NYWMN

SEQ ID NO: 18504 - protein, 19 aa, Artificial Sequence
  Description of Artificial Sequence: Synthetic peptide
  XENP018316 vhCDR2
EIRLKSNNYATHYAEPVKG

SEQ ID NO: 18505 - protein, 11 aa, Artificial Sequence
  Description of Artificial Sequence: Synthetic peptide
  XENP018316 vhCDR3
YYGNKGGYFDV

SEQ ID NO: 18506 - protein, 214 aa, Artificial Sequence; identical to SEQ ID NO: 16226
  Description of Artificial Sequence: Synthetic polypeptide
  XENP018316 1G6_H1.211_L1_IgG1_PVA_/S267K Light Chain

SEQ ID NO: 18507 - protein, 107 aa, Artificial Sequence; identical to SEQ ID NO: 10923
  Description of Artificial Sequence: Synthetic polypeptide
  VL of XENP018316

SEQ ID NO: 18508 - protein, 11 aa, Artificial Sequence
  Description of Artificial Sequence: Synthetic peptide
  XENP018316 vlCDR1
RASQSVSNDVA

SEQ ID NO: 18509 - protein, 7 aa, Artificial Sequence
  Description of Artificial Sequence: Synthetic peptide
  XENP018316 vlCDR2
YASHRYT

SEQ ID NO: 18510 - protein, 9 aa, Artificial Sequence
  Description of Artificial Sequence: Synthetic peptide
  XENP018316 vlCDR3
QQDYSSPRT

SEQ ID NO: 18511 - protein, 451 aa, Artificial Sequence
  Description of Artificial Sequence: Synthetic polypeptide
  XENP018317 1G6_H1.212_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYAGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 18512 - protein, 122 aa, Artificial Sequence; identical to SEQ ID NO: 12935
  Description of Artificial Sequence: Synthetic polypeptide
  VH of XENP018317

SEQ ID NO: 18513 - protein, 5 aa, Artificial Sequence
  Description of Artificial Sequence: Synthetic peptide
  XENP018317 vhCDR1
NYWMN

SEQ ID NO: 18514 - protein, 19 aa, Artificial Sequence
  Description of Artificial Sequence: Synthetic peptide
  XENP018317 vhCDR2
EIRLKSNNYATHYAEPVKG

SEQ ID NO: 18515 - protein, 11 aa, Artificial Sequence
  Description of Artificial Sequence: Synthetic peptide
  XENP018317 vhCDR3
YYGNYAGYFDV

SEQ ID NO: 18516 - protein, 214 aa, Artificial Sequence; identical to SEQ ID NO: 16226
  Description of Artificial Sequence: Synthetic polypeptide
  XENP018317 1G6_H1.212_L1_IgG1_PVA_/S267K Light Chain

SEQ ID NO: 18517 - protein, 107 aa, Artificial Sequence; identical to SEQ ID NO: 10923
  Description of Artificial Sequence: Synthetic polypeptide
  VL of XENP018317

SEQ ID NO: 18518 - protein, 11 aa, Artificial Sequence
  Description of Artificial Sequence: Synthetic peptide
  XENP018317 vlCDR1
RASQSVSNDVA

SEQ ID NO: 18519 - protein, 7 aa, Artificial Sequence
  Description of Artificial Sequence: Synthetic peptide
  XENP018317 vlCDR2
YASHRYT

SEQ ID NO: 18520 - protein, 9 aa, Artificial Sequence
  Description of Artificial Sequence: Synthetic peptide
  XENP018317 vlCDR3
QQDYSSPRT

SEQ ID NO: 18521 - protein, 451 aa, Artificial Sequence
  Description of Artificial Sequence: Synthetic polypeptide
  XENP018318 1G6_H1.213_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYQGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 18522 - protein, 122 aa, Artificial Sequence; identical to SEQ ID NO: 12944
  Description of Artificial Sequence: Synthetic polypeptide
  VH of XENP018318

SEQ ID NO: 18523 - protein, 5 aa, Artificial Sequence
  Description of Artificial Sequence: Synthetic peptide
  XENP018318 vhCDR1
NYWMN

SEQ ID NO: 18524 - protein, 19 aa, Artificial Sequence
  Description of Artificial Sequence: Synthetic peptide
  XENP018318 vhCDR2
EIRLKSNNYATHYAEPVKG

SEQ ID NO: 18525 - protein, 11 aa, Artificial Sequence
  Description of Artificial Sequence: Synthetic peptide
  XENP018318 vhCDR3
YYGNYQGYFDV

SEQ ID NO: 18526 - protein, 214 aa, Artificial Sequence; identical to SEQ ID NO: 16226
  Description of Artificial Sequence: Synthetic polypeptide
  XENP018318 1G6_H1.213_L1_IgG1_PVA_/S267K Light Chain

SEQ ID NO: 18527 - protein, 107 aa, Artificial Sequence; identical to SEQ ID NO: 10923
  Description of Artificial Sequence: Synthetic polypeptide
  VL of XENP018318

SEQ ID NO: 18528 - protein, 11 aa, Artificial Sequence
  Description of Artificial Sequence: Synthetic peptide
  XENP018318 vlCDR1
RASQSVSNDVA

SEQ ID NO: 18529 - protein, 7 aa, Artificial Sequence
  Description of Artificial Sequence: Synthetic peptide
  XENP018318 vlCDR2
YASHRYT

SEQ ID NO: 18530 - protein, 9 aa, Artificial Sequence
  Description of Artificial Sequence: Synthetic peptide
  XENP018318 vlCDR3
QQDYSSPRT

SEQ ID NO: 18531 - protein, 451 aa, Artificial Sequence
  Description of Artificial Sequence: Synthetic polypeptide
  XENP018319 1G6_H1.214_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYHGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 18532 - protein, 122 aa, Artificial Sequence; identical to SEQ ID NO: 12953
  Description of Artificial Sequence: Synthetic polypeptide
  VH of XENP018319

SEQ ID NO: 18533 - protein, 5 aa, Artificial Sequence
  Description of Artificial Sequence: Synthetic peptide
  XENP018319 vhCDR1
NYWMN

SEQ ID NO: 18534 - protein, 19 aa, Artificial Sequence
  Description of Artificial Sequence: Synthetic peptide
  XENP018319 vhCDR2
EIRLKSNNYATHYAEPVKG

SEQ ID NO: 18535 - protein, 11 aa, Artificial Sequence
  Description of Artificial Sequence: Synthetic peptide
  XENP018319 vhCDR3
YYGNYHGYFDV

SEQ ID NO: 18536 - protein, 214 aa, Artificial Sequence; identical to SEQ ID NO: 16226
  Description of Artificial Sequence: Synthetic polypeptide
  XENP018319 1G6_H1.214_L1_IgG1_PVA_/S267K Light Chain

SEQ ID NO: 18537 - protein, 107 aa, Artificial Sequence; identical to SEQ ID NO: 10923
  Description of Artificial Sequence: Synthetic polypeptide
  VL of XENP018319

SEQ ID NO: 18538 - protein, 11 aa, Artificial Sequence
  Description of Artificial Sequence: Synthetic peptide
  XENP018319 vlCDR1
RASQSVSNDVA

SEQ ID NO: 18539 - protein, 7 aa, Artificial Sequence
  Description of Artificial Sequence: Synthetic peptide
  XENP018319 vlCDR2
YASHRYT

SEQ ID NO: 18540 - protein, 9 aa, Artificial Sequence
  Description of Artificial Sequence: Synthetic peptide
  XENP018319 vlCDR3
QQDYSSPRT

SEQ ID NO: 18541 - protein, 451 aa, Artificial Sequence
  Description of Artificial Sequence: Synthetic polypeptide
  XENP018320 1G6_H1.215_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYDGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 18542 - protein, 122 aa, Artificial Sequence; identical to SEQ ID NO: 12962
  Description of Artificial Sequence: Synthetic polypeptide
  VH of XENP018320

SEQ ID NO: 18543 - protein, 5 aa, Artificial Sequence
  Description of Artificial Sequence: Synthetic peptide
  XENP018320 vhCDR1
NYWMN

SEQ ID NO: 18544 - protein, 19 aa, Artificial Sequence
  Description of Artificial Sequence: Synthetic peptide
  XENP018320 vhCDR2
EIRLKSNNYATHYAEPVKG

SEQ ID NO: 18545 - protein, 11 aa, Artificial Sequence
  Description of Artificial Sequence: Synthetic peptide
  XENP018320 vhCDR3
YYGNYDGYFDV

SEQ ID NO: 18546 - protein, 214 aa, Artificial Sequence; identical to SEQ ID NO: 16226
  Description of Artificial Sequence: Synthetic polypeptide
  XENP018320 1G6_H1.215_L1_IgG1_PVA_/S267K Light Chain

SEQ ID NO: 18547 - protein, 107 aa, Artificial Sequence; identical to SEQ ID NO: 10923
  Description of Artificial Sequence: Synthetic polypeptide
  VL of XENP018320

SEQ ID NO: 18548 - protein, 11 aa, Artificial Sequence
  Description of Artificial Sequence: Synthetic peptide
  XENP018320 vlCDR1
RASQSVSNDVA

SEQ ID NO: 18549 - protein, 7 aa, Artificial Sequence
  Description of Artificial Sequence: Synthetic peptide
  XENP018320 vlCDR2
YASHRYT

SEQ ID NO: 18550 - protein, 9 aa, Artificial Sequence
  Description of Artificial Sequence: Synthetic peptide
  XENP018320 vlCDR3
QQDYSSPRT

SEQ ID NO: 18551 - protein, 451 aa, Artificial Sequence
  Description of Artificial Sequence: Synthetic polypeptide
  XENP018321 1G6_H1.216_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYKGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 18552 - protein, 122 aa, Artificial Sequence; identical to SEQ ID NO: 12971
  Description of Artificial Sequence: Synthetic polypeptide
  VH of XENP018321

SEQ ID NO: 18553 - protein, 5 aa, Artificial Sequence
  Description of Artificial Sequence: Synthetic peptide
  XENP018321 vhCDR1
NYWMN

SEQ ID NO: 18554 - protein, 19 aa, Artificial Sequence
  Description of Artificial Sequence: Synthetic peptide
  XENP018321 vhCDR2
EIRLKSNNYATHYAEPVKG

SEQ ID NO: 18555 - protein, 11 aa, Artificial Sequence
  Description of Artificial Sequence: Synthetic peptide
  XENP018321 vhCDR3
YYGNYKGYFDV

SEQ ID NO: 18556 - protein, 214 aa, Artificial Sequence; identical to SEQ ID NO: 16226
  Description of Artificial Sequence: Synthetic polypeptide
  XENP018321 1G6_H1.216_L1_IgG1_PVA_/S267K Light Chain

SEQ ID NO: 18557 - protein, 107 aa, Artificial Sequence; identical to SEQ ID NO: 10923
  Description of Artificial Sequence: Synthetic polypeptide
  VL of XENP018321

SEQ ID NO: 18558 - protein, 11 aa, Artificial Sequence
  Description of Artificial Sequence: Synthetic peptide
  XENP018321 vlCDR1
RASQSVSNDVA

SEQ ID NO: 18559 - protein, 7 aa, Artificial Sequence
  Description of Artificial Sequence: Synthetic peptide
  XENP018321 vlCDR2
YASHRYT

SEQ ID NO: 18560 - protein, 9 aa, Artificial Sequence
  Description of Artificial Sequence: Synthetic peptide
  XENP018321 vlCDR3
QQDYSSPRT

SEQ ID NO: 18561 - protein, 451 aa, Artificial Sequence
  Description of Artificial Sequence: Synthetic polypeptide
  XENP018322 1G6_H1.217_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYLGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 18562 - protein, 122 aa, Artificial Sequence; identical to SEQ ID NO: 12980
  Description of Artificial Sequence: Synthetic polypeptide
  VH of XENP018322

SEQ ID NO: 18563 - protein, 5 aa, Artificial Sequence
  Description of Artificial Sequence: Synthetic peptide
  XENP018322 vhCDR1
NYWMN

SEQ ID NO: 18564 - protein, 19 aa, Artificial Sequence
  Description of Artificial Sequence: Synthetic peptide
  XENP018322 vhCDR2
EIRLKSNNYATHYAEPVKG

SEQ ID NO: 18565 - protein, 11 aa, Artificial Sequence
  Description of Artificial Sequence: Synthetic peptide
  XENP018322 vhCDR3
YYGNYLGYFDV

SEQ ID NO: 18566 - protein, 214 aa, Artificial Sequence; identical to SEQ ID NO: 16226
  Description of Artificial Sequence: Synthetic polypeptide
  XENP018322 1G6_H1.217_L1_IgG1_PVA_/S267K Light Chain

SEQ ID NO: 18567 - protein, 107 aa, Artificial Sequence; identical to SEQ ID NO: 10923
  Description of Artificial Sequence: Synthetic polypeptide
  VL of XENP018322

SEQ ID NO: 18568 - protein, 11 aa, Artificial Sequence
  Description of Artificial Sequence: Synthetic peptide
  XENP018322 vlCDR1
RASQSVSNDVA

SEQ ID NO: 18569 - protein, 7 aa, Artificial Sequence
  Description of Artificial Sequence: Synthetic peptide
  XENP018322 vlCDR2
YASHRYT

SEQ ID NO: 18570 - protein, 9 aa, Artificial Sequence
  Description of Artificial Sequence: Synthetic peptide
  XENP018322 vlCDR3
QQDYSSPRT

SEQ ID NO: 18571 - protein, 451 aa, Artificial Sequence
  Description of Artificial Sequence: Synthetic polypeptide
  XENP018323 1G6_H1.218_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYFGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 18572 - protein, 122 aa, Artificial Sequence; identical to SEQ ID NO: 12989
  Description of Artificial Sequence: Synthetic polypeptide
  VH of XENP018323

SEQ ID NO: 18573 - protein, 5 aa, Artificial Sequence
  Description of Artificial Sequence: Synthetic peptide
  XENP018323 vhCDR1
NYWMN

SEQ ID NO: 18574 - protein, 19 aa, Artificial Sequence
  Description of Artificial Sequence: Synthetic peptide
  XENP018323 vhCDR2
EIRLKSNNYATHYAEPVKG

SEQ ID NO: 18575 - protein, 11 aa, Artificial Sequence
  Description of Artificial Sequence: Synthetic peptide
  XENP018323 vhCDR3
YYGNYFGYFDV

SEQ ID NO: 18576 - protein, 214 aa, Artificial Sequence; identical to SEQ ID NO: 16226
  Description of Artificial Sequence: Synthetic polypeptide
  XENP018323 1G6_H1.218_L1_IgG1_PVA_/S267K Light Chain

SEQ ID NO: 18577 - protein, 107 aa, Artificial Sequence; identical to SEQ ID NO: 10923
  Description of Artificial Sequence: Synthetic polypeptide
  VL of XENP018323

SEQ ID NO: 18578 - protein, 11 aa, Artificial Sequence
  Description of Artificial Sequence: Synthetic peptide
  XENP018323 vlCDR1
RASQSVSNDVA

SEQ ID NO: 18579 - protein, 7 aa, Artificial Sequence
  Description of Artificial Sequence: Synthetic peptide
  XENP018323 vlCDR2
YASHRYT

SEQ ID NO: 18580 - protein, 9 aa, Artificial Sequence
  Description of Artificial Sequence: Synthetic peptide
  XENP018323 vlCDR3
QQDYSSPRT

SEQ ID NO: 18581 - protein, 451 aa, Artificial Sequence
  Description of Artificial Sequence: Synthetic polypeptide
  XENP018324 1G6_H1.219_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGAYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 18582 - protein, 122 aa, Artificial Sequence; identical to SEQ ID NO: 12998
  Description of Artificial Sequence: Synthetic polypeptide
  VH of XENP018324

SEQ ID NO: 18583 - protein, 5 aa, Artificial Sequence
  Description of Artificial Sequence: Synthetic peptide
  XENP018324 vhCDR1
NYWMN

SEQ ID NO: 18584 - protein, 19 aa, Artificial Sequence
  Description of Artificial Sequence: Synthetic peptide
  XENP018324 vhCDR2
EIRLKSNNYATHYAEPVKG

SEQ ID NO: 18585 - protein, 11 aa, Artificial Sequence
  Description of Artificial Sequence: Synthetic peptide
  XENP018324 vhCDR3
YYGNYGAYFDV

SEQ ID NO: 18586 - protein, 214 aa, Artificial Sequence; identical to SEQ ID NO: 16226
  Description of Artificial Sequence: Synthetic polypeptide
  XENP018324 1G6_H1.219_L1_IgG1_PVA_/S267K Light Chain

SEQ ID NO: 18587 - protein, 107 aa, Artificial Sequence; identical to SEQ ID NO: 10923
  Description of Artificial Sequence: Synthetic polypeptide
  VL of XENP018324

SEQ ID NO: 18588 - protein, 11 aa, Artificial Sequence
  Description of Artificial Sequence: Synthetic peptide
  XENP018324 vlCDR1
RASQSVSNDVA

SEQ ID NO: 18589 - protein, 7 aa, Artificial Sequence
  Description of Artificial Sequence: Synthetic peptide
  XENP018324 vlCDR2
YASHRYT

SEQ ID NO: 18590 - protein, 9 aa, Artificial Sequence
  Description of Artificial Sequence: Synthetic peptide
  XENP018324 vlCDR3
QQDYSSPRT

SEQ ID NO: 18591 - protein, 451 aa, Artificial Sequence
  Description of Artificial Sequence: Synthetic polypeptide
  XENP018325 1G6_H1.220_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGSYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 18592 - protein, 122 aa, Artificial Sequence; identical to SEQ ID NO: 13007
  Description of Artificial Sequence: Synthetic polypeptide
  VH of XENP018325

SEQ ID NO: 18593 - protein, 5 aa, Artificial Sequence
  Description of Artificial Sequence: Synthetic peptide
  XENP018325 vhCDR1
NYWMN

SEQ ID NO: 18594 - protein, 19 aa, Artificial Sequence
  Description of Artificial Sequence: Synthetic peptide
  XENP018325 vhCDR2
EIRLKSNNYATHYAEPVKG

SEQ ID NO: 18595 - protein, 11 aa, Artificial Sequence
  Description of Artificial Sequence: Synthetic peptide
  XENP018325 vhCDR3
YYGNYGSYFDV

SEQ ID NO: 18596 - protein, 214 aa, Artificial Sequence; identical to SEQ ID NO: 16226
  Description of Artificial Sequence: Synthetic polypeptide
  XENP018325 1G6_H1.220_L1_IgG1_PVA_/S267K Light Chain

SEQ ID NO: 18597 - protein, 107 aa, Artificial Sequence; identical to SEQ ID NO: 10923
  Description of Artificial Sequence: Synthetic polypeptide
  VL of XENP018325

SEQ ID NO: 18598 - protein, 11 aa, Artificial Sequence
  Description of Artificial Sequence: Synthetic peptide
  XENP018325 vlCDR1
RASQSVSNDVA

SEQ ID NO: 18599 - protein, 7 aa, Artificial Sequence
  Description of Artificial Sequence: Synthetic peptide
  XENP018325 vlCDR2
YASHRYT

SEQ ID NO: 18600 - protein, 9 aa, Artificial Sequence
  Description of Artificial Sequence: Synthetic peptide
  XENP018325 vlCDR3
QQDYSSPRT

SEQ ID NO: 18601 - protein, 451 aa, Artificial Sequence
  Description of Artificial Sequence: Synthetic polypeptide
  XENP018326 1G6_H1.221_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGTYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 18602 - protein, 122 aa, Artificial Sequence; identical to SEQ ID NO: 13016
  Description of Artificial Sequence: Synthetic polypeptide
  VH of XENP018326

SEQ ID NO: 18603 - protein, 5 aa, Artificial Sequence
  Description of Artificial Sequence: Synthetic peptide
  XENP018326 vhCDR1
NYWMN

SEQ ID NO: 18604 - protein, 19 aa, Artificial Sequence
  Description of Artificial Sequence: Synthetic peptide
  XENP018326 vhCDR2
EIRLKSNNYATHYAEPVKG

SEQ ID NO: 18605 - protein, 11 aa, Artificial Sequence
  Description of Artificial Sequence: Synthetic peptide
  XENP018326 vhCDR3
YYGNYGTYFDV

SEQ ID NO: 18606 - protein, 214 aa, Artificial Sequence; identical to SEQ ID NO: 16226
  Description of Artificial Sequence: Synthetic polypeptide
  XENP018326 1G6_H1.221_L1_IgG1_PVA_/S267K Light Chain

SEQ ID NO: 18607 - protein, 107 aa, Artificial Sequence; identical to SEQ ID NO: 10923
  Description of Artificial Sequence: Synthetic polypeptide
  VL of XENP018326

SEQ ID NO: 18608 - protein, 11 aa, Artificial Sequence
  Description of Artificial Sequence: Synthetic peptide
  XENP018326 vlCDR1
RASQSVSNDVA

SEQ ID NO: 18609 - protein, 7 aa, Artificial Sequence
  Description of Artificial Sequence: Synthetic peptide
  XENP018326 vlCDR2
YASHRYT

SEQ ID NO: 18610 - protein, 9 aa, Artificial Sequence
  Description of Artificial Sequence: Synthetic peptide
  XENP018326 vlCDR3
QQDYSSPRT

SEQ ID NO: 18611 - protein, 451 aa, Artificial Sequence
  Description of Artificial Sequence: Synthetic polypeptide
  XENP018327 1G6_H1.222_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGNYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 18612 - protein, 122 aa, Artificial Sequence; identical to SEQ ID NO: 13025
  Description of Artificial Sequence: Synthetic polypeptide
  VH of XENP018327

SEQ ID NO: 18613 - protein, 5 aa, Artificial Sequence
  Description of Artificial Sequence: Synthetic peptide
  XENP018327 vhCDR1
NYWMN

SEQ ID NO: 18614 - protein, 19 aa, Artificial Sequence
  Description of Artificial Sequence: Synthetic peptide
  XENP018327 vhCDR2
EIRLKSNNYATHYAEPVKG

SEQ ID NO: 18615 - protein, 11 aa, Artificial Sequence
  Description of Artificial Sequence: Synthetic peptide
  XENP018327 vhCDR3
YYGNYGNYFDV

SEQ ID NO: 18616 - protein, 214 aa, Artificial Sequence; identical to SEQ ID NO: 16226
  Description of Artificial Sequence: Synthetic polypeptide
  XENP018327 1G6_H1.222_L1_IgG1_PVA_/S267K Light Chain

SEQ ID NO: 18617 - protein, 107 aa, Artificial Sequence; identical to SEQ ID NO: 10923
  Description of Artificial Sequence: Synthetic polypeptide
  VL of XENP018327

SEQ ID NO: 18618 - protein, 11 aa, Artificial Sequence
  Description of Artificial Sequence: Synthetic peptide
  XENP018327 vlCDR1
RASQSVSNDVA

SEQ ID NO: 18619 - protein, 7 aa, Artificial Sequence
  Description of Artificial Sequence: Synthetic peptide
  XENP018327 vlCDR2
YASHRYT

SEQ ID NO: 18620 - protein, 9 aa, Artificial Sequence
  Description of Artificial Sequence: Synthetic peptide
  XENP018327 vlCDR3
QQDYSSPRT

SEQ ID NO: 18621 - protein, 451 aa, Artificial Sequence
  Description of Artificial Sequence: Synthetic polypeptide
  XENP018328 1G6_H1.223_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGHYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 18622 - protein, 122 aa, Artificial Sequence; identical to SEQ ID NO: 13034
  Description of Artificial Sequence: Synthetic polypeptide
  VH of XENP018328

SEQ ID NO: 18623 - protein, 5 aa, Artificial Sequence
  Description of Artificial Sequence: Synthetic peptide
  XENP018328 vhCDR1
NYWMN

SEQ ID NO: 18624 - protein, 19 aa, Artificial Sequence
  Description of Artificial Sequence: Synthetic peptide
  XENP018328 vhCDR2
EIRLKSNNYATHYAEPVKG

SEQ ID NO: 18625 - protein, 11 aa, Artificial Sequence
  Description of Artificial Sequence: Synthetic peptide
  XENP018328 vhCDR3
YYGNYGHYFDV

SEQ ID NO: 18626 - protein, 214 aa, Artificial Sequence; identical to SEQ ID NO: 16226
  Description of Artificial Sequence: Synthetic polypeptide
  XENP018328 1G6_H1.223_L1_IgG1_PVA_/S267K Light Chain

SEQ ID NO: 18627 - protein, 107 aa, Artificial Sequence; identical to SEQ ID NO: 10923
  Description of Artificial Sequence: Synthetic polypeptide
  VL of XENP018328

SEQ ID NO: 18628 - protein, 11 aa, Artificial Sequence
  Description of Artificial Sequence: Synthetic peptide
  XENP018328 vlCDR1
RASQSVSNDVA

SEQ ID NO: 18629 - protein, 7 aa, Artificial Sequence
  Description of Artificial Sequence: Synthetic peptide
  XENP018328 vlCDR2
YASHRYT

SEQ ID NO: 18630 - protein, 9 aa, Artificial Sequence
  Description of Artificial Sequence: Synthetic peptide
  XENP018328 vlCDR3
QQDYSSPRT

SEQ ID NO: 18631 - protein, 451 aa, Artificial Sequence
  Description of Artificial Sequence: Synthetic polypeptide
  XENP018329 1G6_H1.224_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGDYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 18632 - protein, 122 aa, Artificial Sequence; identical to SEQ ID NO: 13043
  Description of Artificial Sequence: Synthetic polypeptide
  VH of XENP018329

SEQ ID NO: 18633 - protein, 5 aa, Artificial Sequence
  Description of Artificial Sequence: Synthetic peptide
  XENP018329 vhCDR1
NYWMN

SEQ ID NO: 18634 - protein, 19 aa, Artificial Sequence
  Description of Artificial Sequence: Synthetic peptide
  XENP018329 vhCDR2
EIRLKSNNYATHYAEPVKG

SEQ ID NO: 18635 - protein, 11 aa, Artificial Sequence
  Description of Artificial Sequence: Synthetic peptide
  XENP018329 vhCDR3
YYGNYGDYFDV

SEQ ID NO: 18636 - protein, 214 aa, Artificial Sequence; identical to SEQ ID NO: 16226
  Description of Artificial Sequence: Synthetic polypeptide
  XENP018329 1G6_H1.224_L1_IgG1_PVA_/S267K Light Chain

SEQ ID NO: 18637 - protein, 107 aa, Artificial Sequence; identical to SEQ ID NO: 10923
  Description of Artificial Sequence: Synthetic polypeptide
  VL of XENP018329

SEQ ID NO: 18638 - protein, 11 aa, Artificial Sequence
  Description of Artificial Sequence: Synthetic peptide
  XENP018329 vlCDR1
RASQSVSNDVA

SEQ ID NO: 18639 - protein, 7 aa, Artificial Sequence
  Description of Artificial Sequence: Synthetic peptide
  XENP018329 vlCDR2
YASHRYT

SEQ ID NO: 18640 - protein, 9 aa, Artificial Sequence
  Description of Artificial Sequence: Synthetic peptide
  XENP018329 vlCDR3
QQDYSSPRT

SEQ ID NO: 18641 - protein, 451 aa, Artificial Sequence
  Description of Artificial Sequence: Synthetic polypeptide
  XENP018330 1G6_H1.225_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGKYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 18642 - protein, 122 aa, Artificial Sequence; identical to SEQ ID NO: 13052
  Description of Artificial Sequence: Synthetic polypeptide
  VH of XENP018330

SEQ ID NO: 18643 - protein, 5 aa, Artificial Sequence
  Description of Artificial Sequence: Synthetic peptide
  XENP018330 vhCDR1
NYWMN

SEQ ID NO: 18644 - protein, 19 aa, Artificial Sequence
  Description of Artificial Sequence: Synthetic peptide
  XENP018330 vhCDR2
EIRLKSNNYATHYAEPVKG

SEQ ID NO: 18645 - protein, 11 aa, Artificial Sequence
  Description of Artificial Sequence: Synthetic peptide
  XENP018330 vhCDR3
YYGNYGKYFDV

SEQ ID NO: 18646 - protein, 214 aa, Artificial Sequence; identical to SEQ ID NO: 16226
  Description of Artificial Sequence: Synthetic polypeptide
  XENP018330 1G6_H1.225_L1_IgG1_PVA_/S267K Light Chain

SEQ ID NO: 18647 - protein, 107 aa, Artificial Sequence; identical to SEQ ID NO: 10923
  Description of Artificial Sequence: Synthetic polypeptide
  VL of XENP018330

SEQ ID NO: 18648 - protein, 11 aa, Artificial Sequence
  Description of Artificial Sequence: Synthetic peptide
  XENP018330 vlCDR1
RASQSVSNDVA

SEQ ID NO: 18649 - protein, 7 aa, Artificial Sequence
  Description of Artificial Sequence: Synthetic peptide
  XENP018330 vlCDR2
YASHRYT

SEQ ID NO: 18650 - protein, 9 aa, Artificial Sequence
  Description of Artificial Sequence: Synthetic peptide
  XENP018330 vlCDR3
QQDYSSPRT

SEQ ID NO: 18651 - protein, 451 aa, Artificial Sequence
  Description of Artificial Sequence: Synthetic polypeptide
  XENP018331 1G6_H1.226_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGLYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 18652 - protein, 122 aa, Artificial Sequence; identical to SEQ ID NO: 13061
  Description of Artificial Sequence: Synthetic polypeptide
  VH of XENP018331

SEQ ID NO: 18653 - protein, 5 aa, Artificial Sequence
  Description of Artificial Sequence: Synthetic peptide
  XENP018331 vhCDR1
NYWMN

SEQ ID NO: 18654 - protein, 19 aa, Artificial Sequence
  Description of Artificial Sequence: Synthetic peptide
  XENP018331 vhCDR2
EIRLKSNNYATHYAEPVKG

SEQ ID NO: 18655 - protein, 11 aa, Artificial Sequence
  Description of Artificial Sequence: Synthetic peptide
  XENP018331 vhCDR3
YYGNYGLYFDV

SEQ ID NO: 18656 - protein, 214 aa, Artificial Sequence; identical to SEQ ID NO: 16226
  Description of Artificial Sequence: Synthetic polypeptide
  XENP018331 1G6_H1.226_L1_IgG1_PVA_/S267K Light Chain

SEQ ID NO: 18657 - protein, 107 aa, Artificial Sequence; identical to SEQ ID NO: 10923
  Description of Artificial Sequence: Synthetic polypeptide
  VL of XENP018331

SEQ ID NO: 18658 - protein, 11 aa, Artificial Sequence
  Description of Artificial Sequence: Synthetic peptide
  XENP018331 vlCDR1
RASQSVSNDVA

SEQ ID NO: 18659 - protein, 7 aa, Artificial Sequence
  Description of Artificial Sequence: Synthetic peptide
  XENP018331 vlCDR2
YASHRYT

SEQ ID NO: 18660 - protein, 9 aa, Artificial Sequence
  Description of Artificial Sequence: Synthetic peptide
  XENP018331 vlCDR3
QQDYSSPRT

SEQ ID NO: 18661 - protein, 451 aa, Artificial Sequence
  Description of Artificial Sequence: Synthetic polypeptide
  XENP018332 1G6_H1.227_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGFYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 18662 - protein, 122 aa, Artificial Sequence; identical to SEQ ID NO: 13070
  Description of Artificial Sequence: Synthetic polypeptide
  VH of XENP018332

SEQ ID NO: 18663 - protein, 5 aa, Artificial Sequence
  Description of Artificial Sequence: Synthetic peptide
  XENP018332 vhCDR1
NYWMN

SEQ ID NO: 18664 - protein, 19 aa, Artificial Sequence
  Description of Artificial Sequence: Synthetic peptide
  XENP018332 vhCDR2
EIRLKSNNYATHYAEPVKG

SEQ ID NO: 18665 - protein, 11 aa, Artificial Sequence
  Description of Artificial Sequence: Synthetic peptide
  XENP018332 vhCDR3
YYGNYGFYFDV

SEQ ID NO: 18666 - protein, 214 aa, Artificial Sequence; identical to SEQ ID NO: 16226
  Description of Artificial Sequence: Synthetic polypeptide
  XENP018332 1G6_H1.227_L1_IgG1_PVA_/S267K Light Chain

SEQ ID NO: 18667 - protein, 107 aa, Artificial Sequence; identical to SEQ ID NO: 10923
  Description of Artificial Sequence: Synthetic polypeptide
  VL of XENP018332

SEQ ID NO: 18668 - protein, 11 aa, Artificial Sequence
  Description of Artificial Sequence: Synthetic peptide
  XENP018332 vlCDR1
RASQSVSNDVA

SEQ ID NO: 18669 - protein, 7 aa, Artificial Sequence
  Description of Artificial Sequence: Synthetic peptide
  XENP018332 vlCDR2
YASHRYT

SEQ ID NO: 18670 - protein, 9 aa, Artificial Sequence
  Description of Artificial Sequence: Synthetic peptide
  XENP018332 vlCDR3
QQDYSSPRT

SEQ ID NO: 18671 - protein, 451 aa, Artificial Sequence
  Description of Artificial Sequence: Synthetic polypeptide
  XENP018333 1G6_H1.228_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGFFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 18672 - protein, 122 aa, Artificial Sequence; identical to SEQ ID NO: 13079
  Description of Artificial Sequence: Synthetic polypeptide
  VH of XENP018333

SEQ ID NO: 18673 - protein, 5 aa, Artificial Sequence
  Description of Artificial Sequence: Synthetic peptide
  XENP018333 vhCDR1
NYWMN

SEQ ID NO: 18674 - protein, 19 aa, Artificial Sequence
  Description of Artificial Sequence: Synthetic peptide
  XENP018333 vhCDR2
EIRLKSNNYATHYAEPVKG

SEQ ID NO: 18675 - protein, 11 aa, Artificial Sequence
  Description of Artificial Sequence: Synthetic peptide
  XENP018333 vhCDR3
YYGNYGGFFDV

SEQ ID NO: 18676 - protein, 214 aa, Artificial Sequence; identical to SEQ ID NO: 16226
  Description of Artificial Sequence: Synthetic polypeptide
  XENP018333 1G6_H1.228_L1_IgG1_PVA_/S267K Light Chain

SEQ ID NO: 18677 - protein, 107 aa, Artificial Sequence; identical to SEQ ID NO: 10923
  Description of Artificial Sequence: Synthetic polypeptide
  VL of XENP018333

SEQ ID NO: 18678 - protein, 11 aa, Artificial Sequence
  Description of Artificial Sequence: Synthetic peptide
  XENP018333 vlCDR1
RASQSVSNDVA

SEQ ID NO: 18679 - protein, 7 aa, Artificial Sequence
  Description of Artificial Sequence: Synthetic peptide
  XENP018333 vlCDR2
YASHRYT

SEQ ID NO: 18680 - protein, 9 aa, Artificial Sequence
  Description of Artificial Sequence: Synthetic peptide
  XENP018333 vlCDR3
QQDYSSPRT

SEQ ID NO: 18681 - protein, 451 aa, Artificial Sequence
  Description of Artificial Sequence: Synthetic polypeptide
  XENP018334 1G6_H1.229_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGHFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 18682 - protein, 122 aa, Artificial Sequence; identical to SEQ ID NO: 13088
  Description of Artificial Sequence: Synthetic polypeptide
  VH of XENP018334

SEQ ID NO: 18683 - protein, 5 aa, Artificial Sequence
  Description of Artificial Sequence: Synthetic peptide
  XENP018334 vhCDR1
NYWMN

SEQ ID NO: 18684 - protein, 19 aa, Artificial Sequence
  Description of Artificial Sequence: Synthetic peptide
  XENP018334 vhCDR2
EIRLKSNNYATHYAEPVKG

SEQ ID NO: 18685 - protein, 11 aa, Artificial Sequence
  Description of Artificial Sequence: Synthetic peptide
  XENP018334 vhCDR3
YYGNYGGHFDV

SEQ ID NO: 18686 - protein, 214 aa, Artificial Sequence; identical to SEQ ID NO: 16226
  Description of Artificial Sequence: Synthetic polypeptide
  XENP018334 1G6_H1.229_L1_IgG1_PVA_/S267K Light Chain

SEQ ID NO: 18687 - protein, 107 aa, Artificial Sequence; identical to SEQ ID NO: 10923
  Description of Artificial Sequence: Synthetic polypeptide
  VL of XENP018334

SEQ ID NO: 18688 - protein, 11 aa, Artificial Sequence
  Description of Artificial Sequence: Synthetic peptide
  XENP018334 vlCDR1
RASQSVSNDVA

SEQ ID NO: 18689 - protein, 7 aa, Artificial Sequence
  Description of Artificial Sequence: Synthetic peptide
  XENP018334 vlCDR2
YASHRYT

SEQ ID NO: 18690 - protein, 9 aa, Artificial Sequence
  Description of Artificial Sequence: Synthetic peptide
  XENP018334 vlCDR3
QQDYSSPRT

SEQ ID NO: 18691 - protein, 451 aa, Artificial Sequence
  Description of Artificial Sequence: Synthetic polypeptide
  XENP018335 1G6_H1.230_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGLFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 18692 - protein, 122 aa, Artificial Sequence; identical to SEQ ID NO: 13097
  Description of Artificial Sequence: Synthetic polypeptide
  VH of XENP018335

SEQ ID NO: 18693 - protein, 5 aa, Artificial Sequence
  Description of Artificial Sequence: Synthetic peptide
  XENP018335 vhCDR1
NYWMN

SEQ ID NO: 18694 - protein, 19 aa, Artificial Sequence
  Description of Artificial Sequence: Synthetic peptide
  XENP018335 vhCDR2
EIRLKSNNYATHYAEPVKG

SEQ ID NO: 18695 - protein, 11 aa, Artificial Sequence
  Description of Artificial Sequence: Synthetic peptide
  XENP018335 vhCDR3
YYGNYGGLFDV

SEQ ID NO: 18696 - protein, 214 aa, Artificial Sequence; identical to SEQ ID NO: 16226
  Description of Artificial Sequence: Synthetic polypeptide
  XENP018335 1G6_H1.230_L1_IgG1_PVA_/S267K Light Chain

SEQ ID NO: 18697 - protein, 107 aa, Artificial Sequence; identical to SEQ ID NO: 10923
  Description of Artificial Sequence: Synthetic polypeptide
  VL of XENP018335

SEQ ID NO: 18698 - protein, 11 aa, Artificial Sequence
  Description of Artificial Sequence: Synthetic peptide
  XENP018335 vlCDR1
RASQSVSNDVA

SEQ ID NO: 18699 - protein, 7 aa, Artificial Sequence
  Description of Artificial Sequence: Synthetic peptide
  XENP018335 vlCDR2
YASHRYT

SEQ ID NO: 18700 - protein, 9 aa, Artificial Sequence
  Description of Artificial Sequence: Synthetic peptide
  XENP018335 vlCDR3
QQDYSSPRT

SEQ ID NO: 18701 - protein, 451 aa, Artificial Sequence
  Description of Artificial Sequence: Synthetic polypeptide
  XENP018336 1G6_H1.231_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGWFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 18702 - protein, 122 aa, Artificial Sequence; identical to SEQ ID NO: 13106
  Description of Artificial Sequence: Synthetic polypeptide
  VH of XENP018336

SEQ ID NO: 18703 - protein, 5 aa, Artificial Sequence
  Description of Artificial Sequence: Synthetic peptide
  XENP018336 vhCDR1
NYWMN

SEQ ID NO: 18704 - protein, 19 aa, Artificial Sequence
  Description of Artificial Sequence: Synthetic peptide
  XENP018336 vhCDR2
EIRLKSNNYATHYAEPVKG

SEQ ID NO: 18705 - protein, 11 aa, Artificial Sequence
  Description of Artificial Sequence: Synthetic peptide
  XENP018336 vhCDR3
YYGNYGGWFDV

SEQ ID NO: 18706 - protein, 214 aa, Artificial Sequence; identical to SEQ ID NO: 16226
  Description of Artificial Sequence: Synthetic polypeptide
  XENP018336 1G6_H1.231_L1_IgG1_PVA_/S267K Light Chain

SEQ ID NO: 18707 - protein, 107 aa, Artificial Sequence; identical to SEQ ID NO: 10923
  Description of Artificial Sequence: Synthetic polypeptide
  VL of XENP018336

SEQ ID NO: 18708 - protein, 11 aa, Artificial Sequence
  Description of Artificial Sequence: Synthetic peptide
  XENP018336 vlCDR1
RASQSVSNDVA

SEQ ID NO: 18709 - protein, 7 aa, Artificial Sequence
  Description of Artificial Sequence: Synthetic peptide
  XENP018336 vlCDR2
YASHRYT

SEQ ID NO: 18710 - protein, 9 aa, Artificial Sequence
  Description of Artificial Sequence: Synthetic peptide
  XENP018336 vlCDR3
QQDYSSPRT

SEQ ID NO: 18711 - protein, 451 aa, Artificial Sequence
  Description of Artificial Sequence: Synthetic polypeptide
  XENP018337 1G6_H1.232_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGVFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 18712 - protein, 122 aa, Artificial Sequence; identical to SEQ ID NO: 13115
  Description of Artificial Sequence: Synthetic polypeptide
  VH of XENP018337

SEQ ID NO: 18713 - protein, 5 aa, Artificial Sequence
  Description of Artificial Sequence: Synthetic peptide
  XENP018337 vhCDR1
NYWMN

SEQ ID NO: 18714 - protein, 19 aa, Artificial Sequence
  Description of Artificial Sequence: Synthetic peptide
  XENP018337 vhCDR2
EIRLKSNNYATHYAEPVKG

SEQ ID NO: 18715 - protein, 11 aa, Artificial Sequence
  Description of Artificial Sequence: Synthetic peptide
  XENP018337 vhCDR3
YYGNYGGVFDV

SEQ ID NO: 18716 - protein, 214 aa, Artificial Sequence; identical to SEQ ID NO: 16226
  Description of Artificial Sequence: Synthetic polypeptide
  XENP018337 1G6_H1.232_L1_IgG1_PVA_/S267K Light Chain

SEQ ID NO: 18717 - protein, 107 aa, Artificial Sequence; identical to SEQ ID NO: 10923
  Description of Artificial Sequence: Synthetic polypeptide
  VL of XENP018337

SEQ ID NO: 18718 - protein, 11 aa, Artificial Sequence
  Description of Artificial Sequence: Synthetic peptide
  XENP018337 vlCDR1
RASQSVSNDVA

SEQ ID NO: 18719 - protein, 7 aa, Artificial Sequence
  Description of Artificial Sequence: Synthetic peptide
  XENP018337 vlCDR2
YASHRYT

SEQ ID NO: 18720 - protein, 9 aa, Artificial Sequence
  Description of Artificial Sequence: Synthetic peptide
  XENP018337 vlCDR3
QQDYSSPRT

SEQ ID NO: 18721 - protein, 451 aa, Artificial Sequence
  Description of Artificial Sequence: Synthetic polypeptide
  XENP018338 1G6_H1.233_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGAFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 18722 - protein, 122 aa, Artificial Sequence; identical to SEQ ID NO: 13124
  Description of Artificial Sequence: Synthetic polypeptide
  VH of XENP018338

SEQ ID NO: 18723 - protein, 5 aa, Artificial Sequence
  Description of Artificial Sequence: Synthetic peptide
  XENP018338 vhCDR1
NYWMN

SEQ ID NO: 18724 - protein, 19 aa, Artificial Sequence
  Description of Artificial Sequence: Synthetic peptide
  XENP018338 vhCDR2
EIRLKSNNYATHYAEPVKG

SEQ ID NO: 18725 - protein, 11 aa, Artificial Sequence
  Description of Artificial Sequence: Synthetic peptide
  XENP018338 vhCDR3
YYGNYGGAFDV

SEQ ID NO: 18726 - protein, 214 aa, Artificial Sequence; identical to SEQ ID NO: 16226
  Description of Artificial Sequence: Synthetic polypeptide
  XENP018338 1G6_H1.233_L1_IgG1_PVA_/S267K Light Chain

SEQ ID NO: 18727 - protein, 107 aa, Artificial Sequence; identical to SEQ ID NO: 10923
  Description of Artificial Sequence: Synthetic polypeptide
  VL of XENP018338

SEQ ID NO: 18728 - protein, 11 aa, Artificial Sequence
  Description of Artificial Sequence: Synthetic peptide
  XENP018338 vlCDR1
RASQSVSNDVA

SEQ ID NO: 18729 - protein, 7 aa, Artificial Sequence
  Description of Artificial Sequence: Synthetic peptide
  XENP018338 vlCDR2
YASHRYT

SEQ ID NO: 18730 - protein, 9 aa, Artificial Sequence
  Description of Artificial Sequence: Synthetic peptide
  XENP018338 vlCDR3
QQDYSSPRT

SEQ ID NO: 18731 - protein, 451 aa, Artificial Sequence
  Description of Artificial Sequence: Synthetic polypeptide
  XENP018339 1G6_H1.234_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGQFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 18732 - protein, 122 aa, Artificial Sequence; identical to SEQ ID NO: 13133
  Description of Artificial Sequence: Synthetic polypeptide
  VH of XENP018339

SEQ ID NO: 18733 - protein, 5 aa, Artificial Sequence
  Description of Artificial Sequence: Synthetic peptide
  XENP018339 vhCDR1
NYWMN

SEQ ID NO: 18734 - protein, 19 aa, Artificial Sequence
  Description of Artificial Sequence: Synthetic peptide
  XENP018339 vhCDR2
EIRLKSNNYATHYAEPVKG

SEQ ID NO: 18735 - protein, 11 aa, Artificial Sequence
  Description of Artificial Sequence: Synthetic peptide
  XENP018339 vhCDR3
YYGNYGGQFDV

SEQ ID NO: 18736 - protein, 214 aa, Artificial Sequence; identical to SEQ ID NO: 16226
  Description of Artificial Sequence: Synthetic polypeptide
  XENP018339 1G6_H1.234_L1_IgG1_PVA_/S267K Light Chain

SEQ ID NO: 18737 - protein, 107 aa, Artificial Sequence; identical to SEQ ID NO: 10923
  Description of Artificial Sequence: Synthetic polypeptide
  VL of XENP018339

SEQ ID NO: 18738 - protein, 11 aa, Artificial Sequence
  Description of Artificial Sequence: Synthetic peptide
  XENP018339 vlCDR1
RASQSVSNDVA

SEQ ID NO: 18739 - protein, 7 aa, Artificial Sequence
  Description of Artificial Sequence: Synthetic peptide
  XENP018339 vlCDR2
YASHRYT

SEQ ID NO: 18740 - protein, 9 aa, Artificial Sequence
  Description of Artificial Sequence: Synthetic peptide
  XENP018339 vlCDR3
QQDYSSPRT

SEQ ID NO: 18741 - protein, 451 aa, Artificial Sequence
  Description of Artificial Sequence: Synthetic polypeptide
  XENP018340 1G6_H1.235_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGDFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 18742 - protein, 122 aa, Artificial Sequence; identical to SEQ ID NO: 13142
  Description of Artificial Sequence: Synthetic polypeptide
  VH of XENP018340

SEQ ID NO: 18743 - protein, 5 aa, Artificial Sequence
  Description of Artificial Sequence: Synthetic peptide
  XENP018340 vhCDR1
NYWMN

SEQ ID NO: 18744 - protein, 19 aa, Artificial Sequence
  Description of Artificial Sequence: Synthetic peptide
  XENP018340 vhCDR2
EIRLKSNNYATHYAEPVKG

SEQ ID NO: 18745 - protein, 11 aa, Artificial Sequence
  Description of Artificial Sequence: Synthetic peptide
  XENP018340 vhCDR3
YYGNYGGDFDV

SEQ ID NO: 18746 - protein, 214 aa, Artificial Sequence; identical to SEQ ID NO: 16226
  Description of Artificial Sequence: Synthetic polypeptide
  XENP018340 1G6_H1.235_L1_IgG1_PVA_/S267K Light Chain

SEQ ID NO: 18747 - protein, 107 aa, Artificial Sequence; identical to SEQ ID NO: 10923
  Description of Artificial Sequence: Synthetic polypeptide
  VL of XENP018340

SEQ ID NO: 18748 - protein, 11 aa, Artificial Sequence
  Description of Artificial Sequence: Synthetic peptide
  XENP018340 vlCDR1
RASQSVSNDVA

SEQ ID NO: 18749 - protein, 7 aa, Artificial Sequence
  Description of Artificial Sequence: Synthetic peptide
  XENP018340 vlCDR2
YASHRYT

SEQ ID NO: 18750 - protein, 9 aa, Artificial Sequence
  Description of Artificial Sequence: Synthetic peptide
  XENP018340 vlCDR3
QQDYSSPRT

SEQ ID NO: 18751 - protein, 451 aa, Artificial Sequence
  Description of Artificial Sequence: Synthetic polypeptide
  XENP018341 1G6_H1.236_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGKFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 18752 - protein, 122 aa, Artificial Sequence; identical to SEQ ID NO: 13151
  Description of Artificial Sequence: Synthetic polypeptide
  VH of XENP018341

SEQ ID NO: 18753 - protein, 5 aa, Artificial Sequence
  Description of Artificial Sequence: Synthetic peptide
  XENP018341 vhCDR1
NYWMN

SEQ ID NO: 18754 - protein, 19 aa, Artificial Sequence
  Description of Artificial Sequence: Synthetic peptide
  XENP018341 vhCDR2
EIRLKSNNYATHYAEPVKG

SEQ ID NO: 18755 - protein, 11 aa, Artificial Sequence
  Description of Artificial Sequence: Synthetic peptide
  XENP018341 vhCDR3
YYGNYGGKFDV

SEQ ID NO: 18756 - protein, 214 aa, Artificial Sequence; identical to SEQ ID NO: 16226
  Description of Artificial Sequence: Synthetic polypeptide
  XENP018341 1G6_H1.236_L1_IgG1_PVA_/S267K Light Chain

SEQ ID NO: 18757 - protein, 107 aa, Artificial Sequence; identical to SEQ ID NO: 10923
  Description of Artificial Sequence: Synthetic polypeptide
  VL of XENP018341

SEQ ID NO: 18758 - protein, 11 aa, Artificial Sequence
  Description of Artificial Sequence: Synthetic peptide
  XENP018341 vlCDR1
RASQSVSNDVA

SEQ ID NO: 18759 - protein, 7 aa, Artificial Sequence
  Description of Artificial Sequence: Synthetic peptide
  XENP018341 vlCDR2
YASHRYT

SEQ ID NO: 18760 - protein, 9 aa, Artificial Sequence
  Description of Artificial Sequence: Synthetic peptide
  XENP018341 vlCDR3
QQDYSSPRT

SEQ ID NO: 18761 - protein, 451 aa, Artificial Sequence
  Description of Artificial Sequence: Synthetic polypeptide
  XENP018342 1G6_H1.237_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDYWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 18762 - protein, 122 aa, Artificial Sequence; identical to SEQ ID NO: 13160
  Description of Artificial Sequence: Synthetic polypeptide
  VH of XENP018342

SEQ ID NO: 18763 - protein, 5 aa, Artificial Sequence
  Description of Artificial Sequence: Synthetic peptide
  XENP018342 vhCDR1
NYWMN

SEQ ID NO: 18764 - protein, 19 aa, Artificial Sequence
  Description of Artificial Sequence: Synthetic peptide
  XENP018342 vhCDR2
EIRLKSNNYATHYAEPVKG

SEQ ID NO: 18765 - protein, 11 aa, Artificial Sequence
  Description of Artificial Sequence: Synthetic peptide
  XENP018342 vhCDR3
YYGNYGGYFDY

SEQ ID NO: 18766 - protein, 214 aa, Artificial Sequence; identical to SEQ ID NO: 16226
  Description of Artificial Sequence: Synthetic polypeptide
  XENP018342 1G6_H1.237_L1_IgG1_PVA_/S267K Light Chain

SEQ ID NO: 18767 - protein, 107 aa, Artificial Sequence; identical to SEQ ID NO: 10923
  Description of Artificial Sequence: Synthetic polypeptide
  VL of XENP018342

SEQ ID NO: 18768 - protein, 11 aa, Artificial Sequence
  Description of Artificial Sequence: Synthetic peptide
  XENP018342 vlCDR1
RASQSVSNDVA

SEQ ID NO: 18769 - protein, 7 aa, Artificial Sequence
  Description of Artificial Sequence: Synthetic peptide
  XENP018342 vlCDR2
YASHRYT

SEQ ID NO: 18770 - protein, 9 aa, Artificial Sequence
  Description of Artificial Sequence: Synthetic peptide
  XENP018342 vlCDR3
QQDYSSPRT

SEQ ID NO: 18771 - protein, 451 aa, Artificial Sequence
  Description of Artificial Sequence: Synthetic polypeptide
  XENP018343 1G6_H1.238_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 18772 - protein, 122 aa, Artificial Sequence; identical to SEQ ID NO: 13169
  Description of Artificial Sequence: Synthetic polypeptide
  VH of XENP018343

SEQ ID NO: 18773 - protein, 5 aa, Artificial Sequence
  Description of Artificial Sequence: Synthetic peptide
  XENP018343 vhCDR1
NYWMN

SEQ ID NO: 18774 - protein, 19 aa, Artificial Sequence
  Description of Artificial Sequence: Synthetic peptide
  XENP018343 vhCDR2
EIRLKSNNYATHYAEPVKG

SEQ ID NO: 18775 - protein, 11 aa, Artificial Sequence
  Description of Artificial Sequence: Synthetic peptide
  XENP018343 vhCDR3
YYGNYGGYFDV

SEQ ID NO: 18776 - protein, 214 aa, Artificial Sequence; identical to SEQ ID NO: 16226
  Description of Artificial Sequence: Synthetic polypeptide
  XENP018343 1G6_H1.238_L1_IgG1_PVA_/S267K Light Chain

SEQ ID NO: 18777 - protein, 107 aa, Artificial Sequence; identical to SEQ ID NO: 10923
  Description of Artificial Sequence: Synthetic polypeptide
  VL of XENP018343

SEQ ID NO: 18778 - protein, 11 aa, Artificial Sequence
  Description of Artificial Sequence: Synthetic peptide
  XENP018343 vlCDR1
RASQSVSNDVA

SEQ ID NO: 18779 - protein, 7 aa, Artificial Sequence
  Description of Artificial Sequence: Synthetic peptide
  XENP018343 vlCDR2
YASHRYT

SEQ ID NO: 18780 - protein, 9 aa, Artificial Sequence
  Description of Artificial Sequence: Synthetic peptide
  XENP018343 vlCDR3
QQDYSSPRT

SEQ ID NO: 18781 - protein, 451 aa, Artificial Sequence; identical to SEQ ID NO: 16221
  Description of Artificial Sequence: Synthetic polypeptide
  XENP018344 1G6_H1_L1.1_IgG1_PVA_/S267K Heavy Chain

SEQ ID NO: 18782 - protein, 122 aa, Artificial Sequence; identical to SEQ ID NO: 10922
  Description of Artificial Sequence: Synthetic polypeptide
  VH of XENP018344

SEQ ID NO: 18783 - protein, 5 aa, Artificial Sequence
  Description of Artificial Sequence: Synthetic peptide
  XENP018344 vhCDR1
NYWMN

SEQ ID NO: 18784 - protein, 19 aa, Artificial Sequence
  Description of Artificial Sequence: Synthetic peptide
  XENP018344 vhCDR2
EIRLKSNNYATHYAEPVKG

SEQ ID NO: 18785 - protein, 11 aa, Artificial Sequence
  Description of Artificial Sequence: Synthetic peptide
  XENP018344 vhCDR3
YYGNYGGYFDV

SEQ ID NO: 18786 - protein, 214 aa, Artificial Sequence
  Description of Artificial Sequence: Synthetic polypeptide
  XENP018344 1G6_H1_L1.1_IgG1_PVA_/S267K Light Chain
EIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 18787 - protein, 107 aa, Artificial Sequence; identical to SEQ ID NO: 13179
  Description of Artificial Sequence: Synthetic polypeptide
  VL of XENP018344

SEQ ID NO: 18788 - protein, 11 aa, Artificial Sequence
  Description of Artificial Sequence: Synthetic peptide
  XENP018344 vlCDR1
RASQSVSNDVA

SEQ ID NO: 18789 - protein, 7 aa, Artificial Sequence
  Description of Artificial Sequence: Synthetic peptide
  XENP018344 vlCDR2
YASHRYT

SEQ ID NO: 18790 - protein, 9 aa, Artificial Sequence
  Description of Artificial Sequence: Synthetic peptide
  XENP018344 vlCDR3
QQDYSSPRT

SEQ ID NO: 18791 - protein, 451 aa, Artificial Sequence; identical to SEQ ID NO: 16221
  Description of Artificial Sequence: Synthetic polypeptide
  XENP018345 1G6_H1_L1.2_IgG1_PVA_/S267K Heavy Chain

SEQ ID NO: 18792 - protein, 122 aa, Artificial Sequence; identical to SEQ ID NO: 10922
  Description of Artificial Sequence: Synthetic polypeptide
  VH of XENP018345

SEQ ID NO: 18793 - protein, 5 aa, Artificial Sequence
  Description of Artificial Sequence: Synthetic peptide
  XENP018345 vhCDR1
NYWMN

SEQ ID NO: 18794 - protein, 19 aa, Artificial Sequence
  Description of Artificial Sequence: Synthetic peptide
  XENP018345 vhCDR2
EIRLKSNNYATHYAEPVKG

SEQ ID NO: 18795 - protein, 11 aa, Artificial Sequence
  Description of Artificial Sequence: Synthetic peptide
  XENP018345 vhCDR3
YYGNYGGYFDV

SEQ ID NO: 18796 - protein, 214 aa, Artificial Sequence
  Description of Artificial Sequence: Synthetic polypeptide
  XENP018345 1G6_H1_L1.2_IgG1_PVA_/S267K Light Chain
DIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 18797 - protein, 107 aa, Artificial Sequence; identical to SEQ ID NO: 13188
  Description of Artificial Sequence: Synthetic polypeptide
  VL of XENP018345

SEQ ID NO: 18798 - protein, 11 aa, Artificial Sequence
  Description of Artificial Sequence: Synthetic peptide
  XENP018345 vlCDR1
RASQSVSNDVA

SEQ ID NO: 18799 - protein, 7 aa, Artificial Sequence
  Description of Artificial Sequence: Synthetic peptide
  XENP018345 vlCDR2
YASHRYT

SEQ ID NO: 18800 - protein, 9 aa, Artificial Sequence
  Description of Artificial Sequence: Synthetic peptide
  XENP018345 vlCDR3
QQDYSSPRT

SEQ ID NO: 18801 - protein, 451 aa, Artificial Sequence; identical to SEQ ID NO: 16221
  Description of Artificial Sequence: Synthetic polypeptide
  XENP018346 1G6_H1_L1.3_IgG1_PVA_/S267K Heavy Chain

SEQ ID NO: 18802 - protein, 122 aa, Artificial Sequence; identical to SEQ ID NO: 10922
  Description of Artificial Sequence: Synthetic polypeptide
  VH of XENP018346

SEQ ID NO: 18803 - protein, 5 aa, Artificial Sequence
  Description of Artificial Sequence: Synthetic peptide
  XENP018346 vhCDR1
NYWMN

SEQ ID NO: 18804 - protein, 19 aa, Artificial Sequence
  Description of Artificial Sequence: Synthetic peptide
  XENP018346 vhCDR2
EIRLKSNNYATHYAEPVKG

SEQ ID NO: 18805 - protein, 11 aa, Artificial Sequence
  Description of Artificial Sequence: Synthetic peptide
  XENP018346 vhCDR3
YYGNYGGYFDV

SEQ ID NO: 18806 - protein, 214 aa, Artificial Sequence
  Description of Artificial Sequence: Synthetic polypeptide
  XENP018346 1G6_H1_L1.3_IgG1_PVA_/S267K Light Chain
SVVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 18807 - protein, 107 aa, Artificial Sequence; identical to SEQ ID NO: 13197
  Description of Artificial Sequence: Synthetic polypeptide
  VL of XENP018346

SEQ ID NO: 18808 - protein, 11 aa, Artificial Sequence
  Description of Artificial Sequence: Synthetic peptide
  XENP018346 vlCDR1
RASQSVSNDVA

SEQ ID NO: 18809 - protein, 7 aa, Artificial Sequence
  Description of Artificial Sequence: Synthetic peptide
  XENP018346 vlCDR2
YASHRYT

SEQ ID NO: 18810 - protein, 9 aa, Artificial Sequence
  Description of Artificial Sequence: Synthetic peptide
  XENP018346 vlCDR3
QQDYSSPRT

SEQ ID NO: 18811 - protein, 451 aa, Artificial Sequence; identical to SEQ ID NO: 16221
  Description of Artificial Sequence: Synthetic polypeptide
  XENP018347 1G6_H1_L1.4_IgG1_PVA_/S267K Heavy Chain

SEQ ID NO: 18812 - protein, 122 aa, Artificial Sequence; identical to SEQ ID NO: 10922
  Description of Artificial Sequence: Synthetic polypeptide
  VH of XENP018347

SEQ ID NO: 18813 - protein, 5 aa, Artificial Sequence
  Description of Artificial Sequence: Synthetic peptide
  XENP018347 vhCDR1
NYWMN

SEQ ID NO: 18814 - protein, 19 aa, Artificial Sequence
  Description of Artificial Sequence: Synthetic peptide
  XENP018347 vhCDR2
EIRLKSNNYATHYAEPVKG

SEQ ID NO: 18815 - protein, 11 aa, Artificial Sequence
  Description of Artificial Sequence: Synthetic peptide
  XENP018347 vhCDR3
YYGNYGGYFDV

SEQ ID NO: 18816 - protein, 214 aa, Artificial Sequence
  Description of Artificial Sequence: Synthetic polypeptide
  XENP018347 1G6_H1_L1.4_IgG1_PVA_/S267K Light Chain
SIVLTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 18817 - protein, 107 aa, Artificial Sequence; identical to SEQ ID NO: 13206
  Description of Artificial Sequence: Synthetic polypeptide
  VL of XENP018347

SEQ ID NO: 18818 - protein, 11 aa, Artificial Sequence
  Description of Artificial Sequence: Synthetic peptide
  XENP018347 vlCDR1
RASQSVSNDVA

SEQ ID NO: 18819 - protein, 7 aa, Artificial Sequence
  Description of Artificial Sequence: Synthetic peptide
  XENP018347 vlCDR2
YASHRYT

SEQ ID NO: 18820 - protein, 9 aa, Artificial Sequence
  Description of Artificial Sequence: Synthetic peptide
  XENP018347 vlCDR3
QQDYSSPRT

SEQ ID NO: 18821 - protein, 451 aa, Artificial Sequence; identical to SEQ ID NO: 16221
  Description of Artificial Sequence: Synthetic polypeptide
  XENP018348 1G6_H1_L1.5_IgG1_PVA_/S267K Heavy Chain

SEQ ID NO: 18822 - protein, 122 aa, Artificial Sequence; identical to SEQ ID NO: 10922
  Description of Artificial Sequence: Synthetic polypeptide
  VH of XENP018348

SEQ ID NO: 18823 - protein, 5 aa, Artificial Sequence
  Description of Artificial Sequence: Synthetic peptide
  XENP018348 vhCDR1
NYWMN

SEQ ID NO: 18824 - protein, 19 aa, Artificial Sequence
  Description of Artificial Sequence: Synthetic peptide
  XENP018348 vhCDR2
EIRLKSNNYATHYAEPVKG

SEQ ID NO: 18825 - protein, 11 aa, Artificial Sequence
  Description of Artificial Sequence: Synthetic peptide
  XENP018348 vhCDR3
YYGNYGGYFDV

SEQ ID NO: 18826 - protein, 214 aa, Artificial Sequence
  Description of Artificial Sequence: Synthetic polypeptide
  XENP018348 1G6_H1_L1.5_IgG1_PVA_/S267K Light Chain
SIVMTQTPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 18827 - protein, 107 aa, Artificial Sequence; identical to SEQ ID NO: 13215
  Description of Artificial Sequence: Synthetic polypeptide
  VL of XENP018348

SEQ ID NO: 18828 - protein, 11 aa, Artificial Sequence
  Description of Artificial Sequence: Synthetic peptide
  XENP018348 vlCDR1
RASQSVSNDVA

SEQ ID NO: 18829 - protein, 7 aa, Artificial Sequence
  Description of Artificial Sequence: Synthetic peptide
  XENP018348 vlCDR2
YASHRYT

SEQ ID NO: 18830 - protein, 9 aa, Artificial Sequence
  Description of Artificial Sequence: Synthetic peptide
  XENP018348 vlCDR3
QQDYSSPRT

SEQ ID NO: 18831 - protein, 451 aa, Artificial Sequence; identical to SEQ ID NO: 16221
  Description of Artificial Sequence: Synthetic polypeptide
  XENP018349 1G6_H1_L1.6_IgG1_PVA_/S267K Heavy Chain

SEQ ID NO: 18832 - protein, 122 aa, Artificial Sequence; identical to SEQ ID NO: 10922
  Description of Artificial Sequence: Synthetic polypeptide
  VH of XENP018349

SEQ ID NO: 18833 - protein, 5 aa, Artificial Sequence
  Description of Artificial Sequence: Synthetic peptide
  XENP018349 vhCDR1
NYWMN

SEQ ID NO: 18834 - protein, 19 aa, Artificial Sequence
  Description of Artificial Sequence: Synthetic peptide
  XENP018349 vhCDR2
EIRLKSNNYATHYAEPVKG

SEQ ID NO: 18835 - protein, 11 aa, Artificial Sequence
  Description of Artificial Sequence: Synthetic peptide
  XENP018349 vhCDR3
YYGNYGGYFDV

SEQ ID NO: 18836 - protein, 214 aa, Artificial Sequence
  Description of Artificial Sequence: Synthetic polypeptide
  XENP018349 1G6_H1_L1.6_IgG1_PVA_/S267K Light Chain
SIVMTQSPKTLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 18837 - protein, 107 aa, Artificial Sequence; identical to SEQ ID NO: 13224
  Description of Artificial Sequence: Synthetic polypeptide
  VL of XENP018349

SEQ ID NO: 18838 - protein, 11 aa, Artificial Sequence
  Description of Artificial Sequence: Synthetic peptide
  XENP018349 vlCDR1
RASQSVSNDVA

SEQ ID NO: 18839 - protein, 7 aa, Artificial Sequence
  Description of Artificial Sequence: Synthetic peptide
  XENP018349 vlCDR2
YASHRYT

SEQ ID NO: 18840 - protein, 9 aa, Artificial Sequence
  Description of Artificial Sequence: Synthetic peptide
  XENP018349 vlCDR3
QQDYSSPRT

SEQ ID NO: 18841 - protein, 451 aa, Artificial Sequence; identical to SEQ ID NO: 16221
  Description of Artificial Sequence: Synthetic polypeptide
  XENP018350 1G6_H1_L1.7_IgG1_PVA_/S267K Heavy Chain

SEQ ID NO: 18842 - protein, 122 aa, Artificial Sequence; identical to SEQ ID NO: 10922
  Description of Artificial Sequence: Synthetic polypeptide
  VH of XENP018350

SEQ ID NO: 18843 - protein, 5 aa, Artificial Sequence
  Description of Artificial Sequence: Synthetic peptide
  XENP018350 vhCDR1
NYWMN

SEQ ID NO: 18844 - protein, 19 aa, Artificial Sequence
  Description of Artificial Sequence: Synthetic peptide
  XENP018350 vhCDR2
EIRLKSNNYATHYAEPVKG

SEQ ID NO: 18845 - protein, 11 aa, Artificial Sequence
  Description of Artificial Sequence: Synthetic peptide
  XENP018350 vhCDR3
YYGNYGGYFDV

SEQ ID NO: 18846 - protein, 214 aa, Artificial Sequence
  Description of Artificial Sequence: Synthetic polypeptide
  XENP018350 1G6_H1_L1.7_IgG1_PVA_/S267K Light Chain
SIVMTQSPASLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 18847 - protein, 107 aa, Artificial Sequence; identical to SEQ ID NO: 13233
  Description of Artificial Sequence: Synthetic polypeptide
  VL of XENP018350

SEQ ID NO: 18848 - protein, 11 aa, Artificial Sequence
  Description of Artificial Sequence: Synthetic peptide
  XENP018350 vlCDR1
RASQSVSNDVA

SEQ ID NO: 18849 - protein, 7 aa, Artificial Sequence
  Description of Artificial Sequence: Synthetic peptide
  XENP018350 vlCDR2
YASHRYT

SEQ ID NO: 18850 - protein, 9 aa, Artificial Sequence
  Description of Artificial Sequence: Synthetic peptide
  XENP018350 vlCDR3
QQDYSSPRT

SEQ ID NO: 18851 - protein, 451 aa, Artificial Sequence; identical to SEQ ID NO: 16221
  Description of Artificial Sequence: Synthetic polypeptide
  XENP018351 1G6_H1_L1.8_IgG1_PVA_/S267K Heavy Chain

SEQ ID NO: 18852 - protein, 122 aa, Artificial Sequence; identical to SEQ ID NO: 10922
  Description of Artificial Sequence: Synthetic polypeptide
  VH of XENP018351

SEQ ID NO: 18853 - protein, 5 aa, Artificial Sequence
  Description of Artificial Sequence: Synthetic peptide
  XENP018351 vhCDR1
NYWMN

SEQ ID NO: 18854 - protein, 19 aa, Artificial Sequence
  Description of Artificial Sequence: Synthetic peptide
  XENP018351 vhCDR2
EIRLKSNNYATHYAEPVKG

SEQ ID NO: 18855 - protein, 11 aa, Artificial Sequence
  Description of Artificial Sequence: Synthetic peptide
  XENP018351 vhCDR3
YYGNYGGYFDV

SEQ ID NO: 18856 - protein, 214 aa, Artificial Sequence
  Description of Artificial Sequence: Synthetic polypeptide
  XENP018351 1G6_H1_L1.8_IgG1_PVA_/S267K Light Chain
SIVMTQSPAFLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 18857 - protein, 107 aa, Artificial Sequence; identical to SEQ ID NO: 13242
  Description of Artificial Sequence: Synthetic polypeptide
  VL of XENP018351

SEQ ID NO: 18858 - protein, 11 aa, Artificial Sequence
  Description of Artificial Sequence: Synthetic peptide
  XENP018351 vlCDR1
RASQSVSNDVA

SEQ ID NO: 18859 - protein, 7 aa, Artificial Sequence
  Description of Artificial Sequence: Synthetic peptide
  XENP018351 vlCDR2
YASHRYT

SEQ ID NO: 18860 - protein, 9 aa, Artificial Sequence
  Description of Artificial Sequence: Synthetic peptide
  XENP018351 vlCDR3
QQDYSSPRT

SEQ ID NO: 18861 - protein, 451 aa, Artificial Sequence; identical to SEQ ID NO: 16221
  Description of Artificial Sequence: Synthetic polypeptide
  XENP018352 1G6_H1_L1.9_IgG1_PVA_/S267K Heavy Chain

SEQ ID NO: 18862 - protein, 122 aa, Artificial Sequence; identical to SEQ ID NO: 10922
  Description of Artificial Sequence: Synthetic polypeptide
  VH of XENP018352

SEQ ID NO: 18863 - protein, 5 aa, Artificial Sequence
  Description of Artificial Sequence: Synthetic peptide
  XENP018352 vhCDR1
NYWMN

SEQ ID NO: 18864 - protein, 19 aa, Artificial Sequence
  Description of Artificial Sequence: Synthetic peptide
  XENP018352 vhCDR2
EIRLKSNNYATHYAEPVKG

SEQ ID NO: 18865 - protein, 11 aa, Artificial Sequence
  Description of Artificial Sequence: Synthetic peptide
  XENP018352 vhCDR3
YYGNYGGYFDV

SEQ ID NO: 18866 - protein, 214 aa, Artificial Sequence
  Description of Artificial Sequence: Synthetic polypeptide
  XENP018352 1G6_H1_L1.9_IgG1_PVA_/S267K Light Chain
SIVMTQSPATLLVSPGERATLSCRASQSVSNDVAWYQQKPGQSPRLLINYASHRYTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 18867 - protein, 107 aa, Artificial Sequence; identical to SEQ ID NO: 13251
  Description of Artificial Sequence: Synthetic polypeptide
  VL of XENP018352

SEQ ID NO: 18868 - protein, 11 aa, Artificial Sequence
  Description of Artificial Sequence: Synthetic peptide
  XENP018352 vlCDR1
RASQSVSNDVA

SEQ ID NO: 18869 - protein, 7 aa, Artificial Sequence
  Description of Artificial Sequence: Synthetic peptide
  XENP018352 vlCDR2
YASHRYT

SEQ ID NO: 18870 - protein, 9 aa, Artificial Sequence
  Description of Artificial Sequence: Synthetic peptide
  XENP018352 vlCDR3
QQDYSSPRT

SEQ ID NO: 18871 - protein, 451 aa, Artificial Sequence; identical to SEQ ID NO: 16221
  Description of Artificial Sequence: Synthetic polypeptide
  XENP018353 1G6_H1_L1.10_IgG1_PVA_/S267K Heavy Chain

SEQ ID NO: 18872 - protein, 122 aa, Artificial Sequence; identical to SEQ ID NO: 10922
  Description of Artificial Sequence: Synthetic polypeptide
  VH of XENP018353

SEQ ID NO: 18873 - protein, 5 aa, Artificial Sequence
  Description of Artificial Sequence: Synthetic peptide
  XENP018353 vhCDR1
NYWMN

SEQ ID NO: 18874 - protein, 19 aa, Artificial Sequence
  Description of Artificial Sequence: Synthetic peptide
  XENP018353 vhCDR2
EIRLKSNNYATHYAEPVKG

SEQ ID NO: 18875 - protein, 11 aa, Artificial Sequence
  Description of Artificial Sequence: Synthetic peptide
  XENP018353 vhCDR3
YYGNYGGYFDV

SEQ ID NO: 18876 - protein, 214 aa, Artificial Sequence
  Description of Artificial Sequence: Synthetic polypeptide
  XENP018353 1G6_H1_L1.10_IgG1_PVA_/S267K Light Chain
SIVMTQSPATLSVSAGERATLSCRASQSVSNDVAWYQQKPGQSPRLLINYASHRYTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 18877 - protein, 107 aa, Artificial Sequence; identical to SEQ ID NO: 13260
  Description of Artificial Sequence: Synthetic polypeptide
  VL of XENP018353

SEQ ID NO: 18878 - protein, 11 aa, Artificial Sequence
  Description of Artificial Sequence: Synthetic peptide
  XENP018353 vlCDR1
RASQSVSNDVA

SEQ ID NO: 18879 - protein, 7 aa, Artificial Sequence
  Description of Artificial Sequence: Synthetic peptide
  XENP018353 vlCDR2
YASHRYT

SEQ ID NO: 18880 - protein, 9 aa, Artificial Sequence
  Description of Artificial Sequence: Synthetic peptide
  XENP018353 vlCDR3
QQDYSSPRT

SEQ ID NO: 18881 - protein, 451 aa, Artificial Sequence; identical to SEQ ID NO: 16221
  Description of Artificial Sequence: Synthetic polypeptide
  XENP018354 1G6_H1_L1.11_IgG1_PVA_/S267K Heavy Chain

SEQ ID NO: 18882 - protein, 122 aa, Artificial Sequence; identical to SEQ ID NO: 10922
  Description of Artificial Sequence: Synthetic polypeptide
  VH of XENP018354

SEQ ID NO: 18883 - protein, 5 aa, Artificial Sequence
  Description of Artificial Sequence: Synthetic peptide
  XENP018354 vhCDR1
NYWMN

SEQ ID NO: 18884 - protein, 19 aa, Artificial Sequence
  Description of Artificial Sequence: Synthetic peptide
  XENP018354 vhCDR2
EIRLKSNNYATHYAEPVKG

SEQ ID NO: 18885 - protein, 11 aa, Artificial Sequence
  Description of Artificial Sequence: Synthetic peptide
  XENP018354 vhCDR3
YYGNYGGYFDV

SEQ ID NO: 18886 - protein, 214 aa, Artificial Sequence
  Description of Artificial Sequence: Synthetic polypeptide
  XENP018354 1G6_H1_L1.11_IgG1_PVA_/S267K Light Chain
SIVMTQSPATLSVSPGDRATLSCRASQSVSNDVAWYQQKPGQSPRLLINYASHRYTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 18887 - protein, 107 aa, Artificial Sequence; identical to SEQ ID NO: 13269
  Description of Artificial Sequence: Synthetic polypeptide
  VL of XENP018354

SEQ ID NO: 18888 - protein, 11 aa, Artificial Sequence
  Description of Artificial Sequence: Synthetic peptide
  XENP018354 vlCDR1
RASQSVSNDVA

SEQ ID NO: 18889 - protein, 7 aa, Artificial Sequence
  Description of Artificial Sequence: Synthetic peptide
  XENP018354 vlCDR2
YASHRYT

SEQ ID NO: 18890 - protein, 9 aa, Artificial Sequence
  Description of Artificial Sequence: Synthetic peptide
  XENP018354 vlCDR3
QQDYSSPRT

SEQ ID NO: 18891 - protein, 451 aa, Artificial Sequence; identical to SEQ ID NO: 16221
  Description of Artificial Sequence: Synthetic polypeptide
  XENP018355 1G6_H1_L1.12_IgG1_PVA_/S267K Heavy Chain

SEQ ID NO: 18892 - protein, 122 aa, Artificial Sequence; identical to SEQ ID NO: 10922
  Description of Artificial Sequence: Synthetic polypeptide
  VH of XENP018355

SEQ ID NO: 18893 - protein, 5 aa, Artificial Sequence
  Description of Artificial Sequence: Synthetic peptide
  XENP018355 vhCDR1
NYWMN

SEQ ID NO: 18894 - protein, 19 aa, Artificial Sequence
  Description of Artificial Sequence: Synthetic peptide
  XENP018355 vhCDR2
EIRLKSNNYATHYAEPVKG

SEQ ID NO: 18895 - protein, 11 aa, Artificial Sequence
  Description of Artificial Sequence: Synthetic peptide
  XENP018355 vhCDR3
YYGNYGGYFDV

SEQ ID NO: 18896 - protein, 214 aa, Artificial Sequence
  Description of Artificial Sequence: Synthetic polypeptide
  XENP018355 1G6_H1_L1.12_IgG1_PVA_/S267K Light Chain
SIVMTQSPATLSVSPGERVTLSCRASQSVSNDVAWYQQKPGQSPRLLINYASHRYTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 18897 - protein, 107 aa, Artificial Sequence; identical to SEQ ID NO: 13278
  Description of Artificial Sequence: Synthetic polypeptide
  VL of XENP018355

SEQ ID NO: 18898 - protein, 11 aa, Artificial Sequence
  Description of Artificial Sequence: Synthetic peptide
  XENP018355 vlCDR1
RASQSVSNDVA

SEQ ID NO: 18899 - protein, 7 aa, Artificial Sequence
  Description of Artificial Sequence: Synthetic peptide
  XENP018355 vlCDR2
YASHRYT

SEQ ID NO: 18900 - protein, 9 aa, Artificial Sequence
  Description of Artificial Sequence: Synthetic peptide
  XENP018355 vlCDR3
QQDYSSPRT

SEQ ID NO: 18901 - protein, 451 aa, Artificial Sequence; identical to SEQ ID NO: 16221
  Description of Artificial Sequence: Synthetic polypeptide
  XENP018356 1G6_H1_L1.13_IgG1_PVA_/S267K Heavy Chain

SEQ ID NO: 18902 - protein, 122 aa, Artificial Sequence; identical to SEQ ID NO: 10922
  Description of Artificial Sequence: Synthetic polypeptide
  VH of XENP018356

SEQ ID NO: 18903 - protein, 5 aa, Artificial Sequence
  Description of Artificial Sequence: Synthetic peptide
  XENP018356 vhCDR1
NYWMN

SEQ ID NO: 18904 - protein, 19 aa, Artificial Sequence
  Description of Artificial Sequence: Synthetic peptide
  XENP018356 vhCDR2
EIRLKSNNYATHYAEPVKG

SEQ ID NO: 18905 - protein, 11 aa, Artificial Sequence
  Description of Artificial Sequence: Synthetic peptide
  XENP018356 vhCDR3
YYGNYGGYFDV

SEQ ID NO: 18906 - protein, 214 aa, Artificial Sequence
  Description of Artificial Sequence: Synthetic polypeptide
  XENP018356 1G6_H1_L1.13_IgG1_PVA_/S267K Light Chain
SIVMTQSPATLSVSPGERATISCRASQSVSNDVAWYQQKPGQSPRLLINYASHRYTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 18907 - protein, 107 aa, Artificial Sequence; identical to SEQ ID NO: 13287
  Description of Artificial Sequence: Synthetic polypeptide
  VL of XENP018356

SEQ ID NO: 18908 - protein, 11 aa, Artificial Sequence
  Description of Artificial Sequence: Synthetic peptide
  XENP018356 vlCDR1
RASQSVSNDVA

SEQ ID NO: 18909 - protein, 7 aa, Artificial Sequence
  Description of Artificial Sequence: Synthetic peptide
  XENP018356 vlCDR2
YASHRYT

SEQ ID NO: 18910 - protein, 9 aa, Artificial Sequence
  Description of Artificial Sequence: Synthetic peptide
  XENP018356 vlCDR3
QQDYSSPRT

SEQ ID NO: 18911 - protein, 451 aa, Artificial Sequence; identical to SEQ ID NO: 16221
  Description of Artificial Sequence: Synthetic polypeptide
  XENP018357 1G6_H1_L1.14_IgG1_PVA_/S267K Heavy Chain

SEQ ID NO: 18912 - protein, 122 aa, Artificial Sequence; identical to SEQ ID NO: 10922
  Description of Artificial Sequence: Synthetic polypeptide
  VH of XENP018357

SEQ ID NO: 18913 - protein, 5 aa, Artificial Sequence
  Description of Artificial Sequence: Synthetic peptide
  XENP018357 vhCDR1
NYWMN

SEQ ID NO: 18914 - protein, 19 aa, Artificial Sequence
  Description of Artificial Sequence: Synthetic peptide
  XENP018357 vhCDR2
EIRLKSNNYATHYAEPVKG

SEQ ID NO: 18915 - protein, 11 aa, Artificial Sequence
  Description of Artificial Sequence: Synthetic peptide
  XENP018357 vhCDR3
YYGNYGGYFDV

SEQ ID NO: 18916 - protein, 214 aa, Artificial Sequence
  Description of Artificial Sequence: Synthetic polypeptide
  XENP018357 1G6_H1_L1.14_IgG1_PVA_/S267K Light Chain
SIVMTQSPATLSVSPGERATLTCRASQSVSNDVAWYQQKPGQSPRLLINYASHRYTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 18917 - protein, 107 aa, Artificial Sequence; identical to SEQ ID NO: 13296
  Description of Artificial Sequence: Synthetic polypeptide
  VL of XENP018357

SEQ ID NO: 18918 - protein, 11 aa, Artificial Sequence
  Description of Artificial Sequence: Synthetic peptide
  XENP018357 vlCDR1
RASQSVSNDVA

SEQ ID NO: 18919 - protein, 7 aa, Artificial Sequence
  Description of Artificial Sequence: Synthetic peptide
  XENP018357 vlCDR2
YASHRYT

SEQ ID NO: 18920 - protein, 9 aa, Artificial Sequence
  Description of Artificial Sequence: Synthetic peptide
  XENP018357 vlCDR3
QQDYSSPRT

SEQ ID NO: 18921 - protein, 451 aa, Artificial Sequence; identical to SEQ ID NO: 16221
  Description of Artificial Sequence: Synthetic polypeptide
  XENP018358 1G6_H1_L1.15_IgG1_PVA_/S267K Heavy Chain

SEQ ID NO: 18922 - protein, 122 aa, Artificial Sequence; identical to SEQ ID NO: 10922
  Description of Artificial Sequence: Synthetic polypeptide
  VH of XENP018358

SEQ ID NO: 18923 - protein, 5 aa, Artificial Sequence
  Description of Artificial Sequence: Synthetic peptide
  XENP018358 vhCDR1
NYWMN

SEQ ID NO: 18924 - protein, 19 aa, Artificial Sequence
  Description of Artificial Sequence: Synthetic peptide
  XENP018358 vhCDR2
EIRLKSNNYATHYAEPVKG

SEQ ID NO: 18925 - protein, 11 aa, Artificial Sequence
  Description of Artificial Sequence: Synthetic peptide
  XENP018358 vhCDR3
YYGNYGGYFDV

SEQ ID NO: 18926 - protein, 214 aa, Artificial Sequence
  Description of Artificial Sequence: Synthetic polypeptide
  XENP018358 1G6_H1_L1.15_IgG1_PVA_/S267K Light Chain
SIVMTQSPATLSVSPGERATLSCKASQSVSNDVAWYQQKPGQSPRLLINYASHRYTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 18927 - protein, 107 aa, Artificial Sequence; identical to SEQ ID NO: 13305
  Description of Artificial Sequence: Synthetic polypeptide
  VL of XENP018358

SEQ ID NO: 18928 - protein, 11 aa, Artificial Sequence
  Description of Artificial Sequence: Synthetic peptide
  XENP018358 vlCDR1
KASQSVSNDVA

SEQ ID NO: 18929 - protein, 7 aa, Artificial Sequence
  Description of Artificial Sequence: Synthetic peptide
  XENP018358 vlCDR2
YASHRYT

SEQ ID NO: 18930 - protein, 9 aa, Artificial Sequence
  Description of Artificial Sequence: Synthetic peptide
  XENP018358 vlCDR3
QQDYSSPRT

SEQ ID NO: 18931 - protein, 451 aa, Artificial Sequence; identical to SEQ ID NO: 16221
  Description of Artificial Sequence: Synthetic polypeptide
  XENP018359 1G6_H1_L1.16_IgG1_PVA_/S267K Heavy Chain

SEQ ID NO: 18932 - protein, 122 aa, Artificial Sequence; identical to SEQ ID NO: 10922
  Description of Artificial Sequence: Synthetic polypeptide
  VH of XENP018359

SEQ ID NO: 18933 - protein, 5 aa, Artificial Sequence
  Description of Artificial Sequence: Synthetic peptide
  XENP018359 vhCDR1
NYWMN

SEQ ID NO: 18934 - protein, 19 aa, Artificial Sequence
  Description of Artificial Sequence: Synthetic peptide
  XENP018359 vhCDR2
EIRLKSNNYATHYAEPVKG

SEQ ID NO: 18935 - protein, 11 aa, Artificial Sequence
  Description of Artificial Sequence: Synthetic peptide
  XENP018359 vhCDR3
YYGNYGGYFDV

SEQ ID NO: 18936 - protein, 214 aa, Artificial Sequence
  Description of Artificial Sequence: Synthetic polypeptide
  XENP018359 1G6_H1_L1.16_IgG1_PVA_/S267K Light Chain
SIVMTQSPATLSVSPGERATLSCRASQDVSNDVAWYQQKPGQSPRLLINYASHRYTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 18937 - protein, 107 aa, Artificial Sequence; identical to SEQ ID NO: 13314
  Description of Artificial Sequence: Synthetic polypeptide
  VL of XENP018359

SEQ ID NO: 18938 - protein, 11 aa, Artificial Sequence
  Description of Artificial Sequence: Synthetic peptide
  XENP018359 vlCDR1
RASQDVSNDVA

SEQ ID NO: 18939 - protein, 7 aa, Artificial Sequence
  Description of Artificial Sequence: Synthetic peptide
  XENP018359 vlCDR2
YASHRYT

SEQ ID NO: 18940 - protein, 9 aa, Artificial Sequence
  Description of Artificial Sequence: Synthetic peptide
  XENP018359 vlCDR3
QQDYSSPRT

SEQ ID NO: 18941 - protein, 451 aa, Artificial Sequence; identical to SEQ ID NO: 16221
  Description of Artificial Sequence: Synthetic polypeptide
  XENP018360 1G6_H1_L1.17_IgG1_PVA_/S267K Heavy Chain

SEQ ID NO: 18942 - protein, 122 aa, Artificial Sequence; identical to SEQ ID NO: 10922
  Description of Artificial Sequence: Synthetic polypeptide
  VH of XENP018360

SEQ ID NO: 18943 - protein, 5 aa, Artificial Sequence
  Description of Artificial Sequence: Synthetic peptide
  XENP018360 vhCDR1
NYWMN

SEQ ID NO: 18944 - protein, 19 aa, Artificial Sequence
  Description of Artificial Sequence: Synthetic peptide
  XENP018360 vhCDR2
EIRLKSNNYATHYAEPVKG

SEQ ID NO: 18945 - protein, 11 aa, Artificial Sequence
  Description of Artificial Sequence: Synthetic peptide
  XENP018360 vhCDR3
YYGNYGGYFDV

SEQ ID NO: 18946 - protein, 214 aa, Artificial Sequence
  Description of Artificial Sequence: Synthetic polypeptide
  XENP018360 1G6_H1_L1.17_IgG1_PVA_/S267K Light Chain
SIVMTQSPATLSVSPGERATLSCRASQGVSNDVAWYQQKPGQSPRLLINYASHRYTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 18947 - protein, 107 aa, Artificial Sequence; identical to SEQ ID NO: 13323
  Description of Artificial Sequence: Synthetic polypeptide
  VL of XENP018360

SEQ ID NO: 18948 - protein, 11 aa, Artificial Sequence
  Description of Artificial Sequence: Synthetic peptide
  XENP018360 vlCDR1
RASQGVSNDVA

SEQ ID NO: 18949 - protein, 7 aa, Artificial Sequence
  Description of Artificial Sequence: Synthetic peptide
  XENP018360 vlCDR2
YASHRYT

SEQ ID NO: 18950 - protein, 9 aa, Artificial Sequence
  Description of Artificial Sequence: Synthetic peptide
  XENP018360 vlCDR3
QQDYSSPRT

SEQ ID NO: 18951 - protein, 451 aa, Artificial Sequence; identical to SEQ ID NO: 16221
  Description of Artificial Sequence: Synthetic polypeptide
  XENP018361 1G6_H1_L1.18_IgG1_PVA_/S267K Heavy Chain

SEQ ID NO: 18952 - protein, 122 aa, Artificial Sequence; identical to SEQ ID NO: 10922
  Description of Artificial Sequence: Synthetic polypeptide
  VH of XENP018361

SEQ ID NO: 18953 - protein, 5 aa, Artificial Sequence
  Description of Artificial Sequence: Synthetic peptide
  XENP018361 vhCDR1
NYWMN

SEQ ID NO: 18954 - protein, 19 aa, Artificial Sequence
  Description of Artificial Sequence: Synthetic peptide
  XENP018361 vhCDR2
EIRLKSNNYATHYAEPVKG

SEQ ID NO: 18955 - protein, 11 aa, Artificial Sequence
  Description of Artificial Sequence: Synthetic peptide
  XENP018361 vhCDR3
YYGNYGGYFDV

SEQ ID NO: 18956 - protein, 214 aa, Artificial Sequence
  Description of Artificial Sequence: Synthetic polypeptide
  XENP018361 1G6_H1_L1.18_IgG1_PVA_/S267K Light Chain
SIVMTQSPATLSVSPGERATLSCRASQSISNDVAWYQQKPGQSPRLLINYASHRYTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 18957 - protein, 107 aa, Artificial Sequence; identical to SEQ ID NO: 13332
  Description of Artificial Sequence: Synthetic polypeptide
  VL of XENP018361

SEQ ID NO: 18958 - protein, 11 aa, Artificial Sequence
  Description of Artificial Sequence: Synthetic peptide
  XENP018361 vlCDR1
RASQSISNDVA

SEQ ID NO: 18959 - protein, 7 aa, Artificial Sequence
  Description of Artificial Sequence: Synthetic peptide
  XENP018361 vlCDR2
YASHRYT

SEQ ID NO: 18960 - protein, 9 aa, Artificial Sequence
  Description of Artificial Sequence: Synthetic peptide
  XENP018361 vlCDR3
QQDYSSPRT

SEQ ID NO: 18961 - protein, 451 aa, Artificial Sequence; identical to SEQ ID NO: 16221
  Description of Artificial Sequence: Synthetic polypeptide
  XENP018362 1G6_H1_L1.19_IgG1_PVA_/S267K Heavy Chain

SEQ ID NO: 18962 - protein, 122 aa, Artificial Sequence; identical to SEQ ID NO: 10922
  Description of Artificial Sequence: Synthetic polypeptide
  VH of XENP018362

SEQ ID NO: 18963 - protein, 5 aa, Artificial Sequence
  Description of Artificial Sequence: Synthetic peptide
  XENP018362 vhCDR1
NYWMN

SEQ ID NO: 18964 - protein, 19 aa, Artificial Sequence
  Description of Artificial Sequence: Synthetic peptide
  XENP018362 vhCDR2
EIRLKSNNYATHYAEPVKG

SEQ ID NO: 18965 - protein, 11 aa, Artificial Sequence
  Description of Artificial Sequence: Synthetic peptide
  XENP018362 vhCDR3
YYGNYGGYFDV

SEQ ID NO: 18966 - protein, 214 aa, Artificial Sequence
  Description of Artificial Sequence: Synthetic polypeptide
  XENP018362 1G6_H1_L1.19_IgG1_PVA_/S267K Light Chain
SIVMTQSPATLSVSPGERATLSCRASQSLSNDVAWYQQKPGQSPRLLINYASHRYTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 18967 - protein, 107 aa, Artificial Sequence; identical to SEQ ID NO: 13341
  Description of Artificial Sequence: Synthetic polypeptide
  VL of XENP018362

SEQ ID NO: 18968 - protein, 11 aa, Artificial Sequence
  Description of Artificial Sequence: Synthetic peptide
  XENP018362 vlCDR1
RASQSLSNDVA

SEQ ID NO: 18969 - protein, 7 aa, Artificial Sequence
  Description of Artificial Sequence: Synthetic peptide
  XENP018362 vlCDR2
YASHRYT

SEQ ID NO: 18970 - protein, 9 aa, Artificial Sequence
  Description of Artificial Sequence: Synthetic peptide
  XENP018362 vlCDR3
QQDYSSPRT

SEQ ID NO: 18971 - protein, 451 aa, Artificial Sequence; identical to SEQ ID NO: 16221
  Description of Artificial Sequence: Synthetic polypeptide
  XENP018363 1G6_H1_L1.20_IgG1_PVA_/S267K Heavy Chain

SEQ ID NO: 18972 - protein, 122 aa, Artificial Sequence; identical to SEQ ID NO: 10922
  Description of Artificial Sequence: Synthetic polypeptide
  VH of XENP018363

SEQ ID NO: 18973 - protein, 5 aa, Artificial Sequence
  Description of Artificial Sequence: Synthetic peptide
  XENP018363 vhCDR1
NYWMN

SEQ ID NO: 18974 - protein, 19 aa, Artificial Sequence
  Description of Artificial Sequence: Synthetic peptide
  XENP018363 vhCDR2
EIRLKSNNYATHYAEPVKG

SEQ ID NO: 18975 - protein, 11 aa, Artificial Sequence
  Description of Artificial Sequence: Synthetic peptide
  XENP018363 vhCDR3
YYGNYGGYFDV

SEQ ID NO: 18976 - protein, 214 aa, Artificial Sequence
  Description of Artificial Sequence: Synthetic polypeptide
  XENP018363 1G6_H1_L1.20_IgG1_PVA_/S267K Light Chain
SIVMTQSPATLSVSPGERATLSCRASQSVTNDVAWYQQKPGQSPRLLINYASHRYTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 18977 - protein, 107 aa, Artificial Sequence; identical to SEQ ID NO: 13350
  Description of Artificial Sequence: Synthetic polypeptide
  VL of XENP018363

SEQ ID NO: 18978 - protein, 11 aa, Artificial Sequence
  Description of Artificial Sequence: Synthetic peptide
  XENP018363 vlCDR1
RASQSVTNDVA

SEQ ID NO: 18979 - protein, 7 aa, Artificial Sequence
  Description of Artificial Sequence: Synthetic peptide
  XENP018363 vlCDR2
YASHRYT

SEQ ID NO: 18980 - protein, 9 aa, Artificial Sequence
  Description of Artificial Sequence: Synthetic peptide
  XENP018363 vlCDR3
QQDYSSPRT

SEQ ID NO: 18981 - protein, 451 aa, Artificial Sequence; identical to SEQ ID NO: 16221
  Description of Artificial Sequence: Synthetic polypeptide
  XENP018364 1G6_H1_L1.21_IgG1_PVA_/S267K Heavy Chain

SEQ ID NO: 18982 - protein, 122 aa, Artificial Sequence; identical to SEQ ID NO: 10922
  Description of Artificial Sequence: Synthetic polypeptide
  VH of XENP018364

SEQ ID NO: 18983 - protein, 5 aa, Artificial Sequence
  Description of Artificial Sequence: Synthetic peptide
  XENP018364 vhCDR1
NYWMN

SEQ ID NO: 18984 - protein, 19 aa, Artificial Sequence
  Description of Artificial Sequence: Synthetic peptide
  XENP018364 vhCDR2
EIRLKSNNYATHYAEPVKG

SEQ ID NO: 18985 - protein, 11 aa, Artificial Sequence
  Description of Artificial Sequence: Synthetic peptide
  XENP018364 vhCDR3
YYGNYGGYFDV

SEQ ID NO: 18986 - protein, 214 aa, Artificial Sequence
  Description of Artificial Sequence: Synthetic polypeptide
  XENP018364 1G6_H1_L1.21_IgG1_PVA_/S267K Light Chain
SIVMTQSPATLSVSPGERATLSCRASQSVANDVAWYQQKPGQSPRLLINYASHRYTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 18987 - protein, 107 aa, Artificial Sequence; identical to SEQ ID NO: 13359
  Description of Artificial Sequence: Synthetic polypeptide
  VL of XENP018364

SEQ ID NO: 18988 - protein, 11 aa, Artificial Sequence
  Description of Artificial Sequence: Synthetic peptide
  XENP018364 vlCDR1
RASQSVANDVA

SEQ ID NO: 18989 - protein, 7 aa, Artificial Sequence
  Description of Artificial Sequence: Synthetic peptide
  XENP018364 vlCDR2
YASHRYT

SEQ ID NO: 18990 - protein, 9 aa, Artificial Sequence
  Description of Artificial Sequence: Synthetic peptide
  XENP018364 vlCDR3
QQDYSSPRT

SEQ ID NO: 18991 - protein, 451 aa, Artificial Sequence; identical to SEQ ID NO: 16221
  Description of Artificial Sequence: Synthetic polypeptide
  XENP018365 1G6_H1_L1.22_IgG1_PVA_/S267K Heavy Chain

SEQ ID NO: 18992 - protein, 122 aa, Artificial Sequence; identical to SEQ ID NO: 10922
  Description of Artificial Sequence: Synthetic polypeptide
  VH of XENP018365

SEQ ID NO: 18993 - protein, 5 aa, Artificial Sequence
  Description of Artificial Sequence: Synthetic peptide
  XENP018365 vhCDR1
NYWMN

SEQ ID NO: 18994 - protein, 19 aa, Artificial Sequence
  Description of Artificial Sequence: Synthetic peptide
  XENP018365 vhCDR2
EIRLKSNNYATHYAEPVKG

SEQ ID NO: 18995 - protein, 11 aa, Artificial Sequence
  Description of Artificial Sequence: Synthetic peptide
  XENP018365 vhCDR3
YYGNYGGYFDV

SEQ ID NO: 18996 - protein, 214 aa, Artificial Sequence
  Description of Artificial Sequence: Synthetic polypeptide
  XENP018365 1G6_H1_L1.22_IgG1_PVA_/S267K Light Chain
SIVMTQSPATLSVSPGERATLSCRASQSVQNDVAWYQQKPGQSPRLLINYASHRYTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 18997 - protein, 107 aa, Artificial Sequence; identical to SEQ ID NO: 13368
  Description of Artificial Sequence: Synthetic polypeptide
  VL of XENP018365

SEQ ID NO: 18998 - protein, 11 aa, Artificial Sequence
  Description of Artificial Sequence: Synthetic peptide
  XENP018365 vlCDR1
RASQSVQNDVA

SEQ ID NO: 18999 - protein, 7 aa, Artificial Sequence
  Description of Artificial Sequence: Synthetic peptide
  XENP018365 vlCDR2
YASHRYT

SEQ ID NO: 19000 - protein, 9 aa, Artificial Sequence
  Description of Artificial Sequence: Synthetic peptide
  XENP018365 vlCDR3
QQDYSSPRT

SEQ ID NO: 19001 - protein, 451 aa, Artificial Sequence; identical to SEQ ID NO: 16221
  Description of Artificial Sequence: Synthetic polypeptide
  XENP018366 1G6_H1_L1.23_IgG1_PVA_/S267K Heavy Chain

SEQ ID NO: 19002 - protein, 122 aa, Artificial Sequence; identical to SEQ ID NO: 10922
  Description of Artificial Sequence: Synthetic polypeptide
  VH of XENP018366

SEQ ID NO: 19003 - protein, 5 aa, Artificial Sequence
  Description of Artificial Sequence: Synthetic peptide
  XENP018366 vhCDR1
NYWMN

SEQ ID NO: 19004 - protein, 19 aa, Artificial Sequence
  Description of Artificial Sequence: Synthetic peptide
  XENP018366 vhCDR2
EIRLKSNNYATHYAEPVKG

SEQ ID NO: 19005 - protein, 11 aa, Artificial Sequence
  Description of Artificial Sequence: Synthetic peptide
  XENP018366 vhCDR3
YYGNYGGYFDV

SEQ ID NO: 19006 - protein, 214 aa, Artificial Sequence
  Description of Artificial Sequence: Synthetic polypeptide
  XENP018366 1G6_H1_L1.23_IgG1_PVA_/S267K Light Chain
SIVMTQSPATLSVSPGERATLSCRASQSVGNDVAWYQQKPGQSPRLLINYASHRYTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 19007 - protein, 107 aa, Artificial Sequence; identical to SEQ ID NO: 13377
  Description of Artificial Sequence: Synthetic polypeptide
  VL of XENP018366

SEQ ID NO: 19008 - protein, 11 aa, Artificial Sequence
  Description of Artificial Sequence: Synthetic peptide
  XENP018366 vlCDR1
RASQSVGNDVA

SEQ ID NO: 19009 - protein, 7 aa, Artificial Sequence
  Description of Artificial Sequence: Synthetic peptide
  XENP018366 vlCDR2
YASHRYT

SEQ ID NO: 19010 - protein, 9 aa, Artificial Sequence
  Description of Artificial Sequence: Synthetic peptide
  XENP018366 vlCDR3
QQDYSSPRT

SEQ ID NO: 19011 - protein, 451 aa, Artificial Sequence; identical to SEQ ID NO: 16221
  Description of Artificial Sequence: Synthetic polypeptide
  XENP018367 1G6_H1_L1.24_IgG1_PVA_/S267K Heavy Chain

SEQ ID NO: 19012 - protein, 122 aa, Artificial Sequence; identical to SEQ ID NO: 10922
  Description of Artificial Sequence: Synthetic polypeptide
  VH of XENP018367

SEQ ID NO: 19013 - protein, 5 aa, Artificial Sequence
  Description of Artificial Sequence: Synthetic peptide
  XENP018367 vhCDR1
NYWMN

SEQ ID NO: 19014 - protein, 19 aa, Artificial Sequence
  Description of Artificial Sequence: Synthetic peptide
  XENP018367 vhCDR2
EIRLKSNNYATHYAEPVKG

SEQ ID NO: 19015 - protein, 11 aa, Artificial Sequence
  Description of Artificial Sequence: Synthetic peptide
  XENP018367 vhCDR3
YYGNYGGYFDV

SEQ ID NO: 19016 - protein, 214 aa, Artificial Sequence
  Description of Artificial Sequence: Synthetic polypeptide
  XENP018367 1G6_H1_L1.24_IgG1_PVA_/S267K Light Chain
SIVMTQSPATLSVSPGERATLSCRASQSVVNDVAWYQQKPGQSPRLLINYASHRYTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 19017 - protein, 107 aa, Artificial Sequence; identical to SEQ ID NO: 13386
  Description of Artificial Sequence: Synthetic polypeptide
  VL of XENP018367

SEQ ID NO: 19018 - protein, 11 aa, Artificial Sequence
  Description of Artificial Sequence: Synthetic peptide
  XENP018367 vlCDR1
RASQSVVNDVA

SEQ ID NO: 19019 - protein, 7 aa, Artificial Sequence
  Description of Artificial Sequence: Synthetic peptide
  XENP018367 vlCDR2
YASHRYT

SEQ ID NO: 19020 - protein, 9 aa, Artificial Sequence
  Description of Artificial Sequence: Synthetic peptide
  XENP018367 vlCDR3
QQDYSSPRT

SEQ ID NO: 19021 - protein, 451 aa, Artificial Sequence; identical to SEQ ID NO: 16221
  Description of Artificial Sequence: Synthetic polypeptide
  XENP018368 1G6_H1_L1.25_IgG1_PVA_/S267K Heavy Chain

SEQ ID NO: 19022 - protein, 122 aa, Artificial Sequence; identical to SEQ ID NO: 10922
  Description of Artificial Sequence: Synthetic polypeptide
  VH of XENP018368

SEQ ID NO: 19023 - protein, 5 aa, Artificial Sequence
  Description of Artificial Sequence: Synthetic peptide
  XENP018368 vhCDR1
NYWMN

SEQ ID NO: 19024 - protein, 19 aa, Artificial Sequence
  Description of Artificial Sequence: Synthetic peptide
  XENP018368 vhCDR2
EIRLKSNNYATHYAEPVKG

SEQ ID NO: 19025 - protein, 11 aa, Artificial Sequence
  Description of Artificial Sequence: Synthetic peptide
  XENP018368 vhCDR3
YYGNYGGYFDV

SEQ ID NO: 19026 - protein, 214 aa, Artificial Sequence
  Description of Artificial Sequence: Synthetic polypeptide
  XENP018368 1G6_H1_L1.25_IgG1_PVA_/S267K Light Chain
SIVMTQSPATLSVSPGERATLSCRASQSVHNDVAWYQQKPGQSPRLLINYASHRYTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 19027 - protein, 107 aa, Artificial Sequence; identical to SEQ ID NO: 13395
  Description of Artificial Sequence: Synthetic polypeptide
  VL of XENP018368

SEQ ID NO: 19028 - protein, 11 aa, Artificial Sequence
  Description of Artificial Sequence: Synthetic peptide
  XENP018368 vlCDR1
RASQSVHNDVA

SEQ ID NO: 19029 - protein, 7 aa, Artificial Sequence
  Description of Artificial Sequence: Synthetic peptide
  XENP018368 vlCDR2
YASHRYT

SEQ ID NO: 19030 - protein, 9 aa, Artificial Sequence
  Description of Artificial Sequence: Synthetic peptide
  XENP018368 vlCDR3
QQDYSSPRT

SEQ ID NO: 19031 - protein, 451 aa, Artificial Sequence; identical to SEQ ID NO: 16221
  Description of Artificial Sequence: Synthetic polypeptide
  XENP018369 1G6_H1_L1.26_IgG1_PVA_/S267K Heavy Chain

SEQ ID NO: 19032 - protein, 122 aa, Artificial Sequence; identical to SEQ ID NO: 10922
  Description of Artificial Sequence: Synthetic polypeptide
  VH of XENP018369

SEQ ID NO: 19033 - protein, 5 aa, Artificial Sequence
  Description of Artificial Sequence: Synthetic peptide
  XENP018369 vhCDR1
NYWMN

SEQ ID NO: 19034 - protein, 19 aa, Artificial Sequence
  Description of Artificial Sequence: Synthetic peptide
  XENP018369 vhCDR2
EIRLKSNNYATHYAEPVKG

SEQ ID NO: 19035 - protein, 11 aa, Artificial Sequence
  Description of Artificial Sequence: Synthetic peptide
  XENP018369 vhCDR3
YYGNYGGYFDV

SEQ ID NO: 19036 - protein, 214 aa, Artificial Sequence
  Description of Artificial Sequence: Synthetic polypeptide
  XENP018369 1G6_H1_L1.26_IgG1_PVA_/S267K Light Chain
SIVMTQSPATLSVSPGERATLSCRASQSVDNDVAWYQQKPGQSPRLLINYASHRYTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 19037 - protein, 107 aa, Artificial Sequence; identical to SEQ ID NO: 13404
  Description of Artificial Sequence: Synthetic polypeptide
  VL of XENP018369

SEQ ID NO: 19038 - protein, 11 aa, Artificial Sequence
  Description of Artificial Sequence: Synthetic peptide
  XENP018369 vlCDR1
RASQSVDNDVA

SEQ ID NO: 19039 - protein, 7 aa, Artificial Sequence
  Description of Artificial Sequence: Synthetic peptide
  XENP018369 vlCDR2
YASHRYT

SEQ ID NO: 19040 - protein, 9 aa, Artificial Sequence
  Description of Artificial Sequence: Synthetic peptide
  XENP018369 vlCDR3
QQDYSSPRT

SEQ ID NO: 19041 - protein, 451 aa, Artificial Sequence; identical to SEQ ID NO: 16221
  Description of Artificial Sequence: Synthetic polypeptide
  XENP018370 1G6_H1_L1.27_IgG1_PVA_/S267K Heavy Chain

SEQ ID NO: 19042 - protein, 122 aa, Artificial Sequence; identical to SEQ ID NO: 10922
  Description of Artificial Sequence: Synthetic polypeptide
  VH of XENP018370

SEQ ID NO: 19043 - protein, 5 aa, Artificial Sequence
  Description of Artificial Sequence: Synthetic peptide
  XENP018370 vhCDR1
NYWMN

SEQ ID NO: 19044 - protein, 19 aa, Artificial Sequence
  Description of Artificial Sequence: Synthetic peptide
  XENP018370 vhCDR2
EIRLKSNNYATHYAEPVKG

SEQ ID NO: 19045 - protein, 11 aa, Artificial Sequence
  Description of Artificial Sequence: Synthetic peptide
  XENP018370 vhCDR3
YYGNYGGYFDV

SEQ ID NO: 19046 - protein, 214 aa, Artificial Sequence
  Description of Artificial Sequence: Synthetic polypeptide
  XENP018370 1G6_H1_L1.27_IgG1_PVA_/S267K Light Chain
SIVMTQSPATLSVSPGERATLSCRASQSVKNDVAWYQQKPGQSPRLLINYASHRYTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 19047 - protein, 107 aa, Artificial Sequence; identical to SEQ ID NO: 13413
  Description of Artificial Sequence: Synthetic polypeptide
  VL of XENP018370

SEQ ID NO: 19048 - protein, 11 aa, Artificial Sequence
  Description of Artificial Sequence: Synthetic peptide
  XENP018370 vlCDR1
RASQSVKNDVA

SEQ ID NO: 19049 - protein, 7 aa, Artificial Sequence
  Description of Artificial Sequence: Synthetic peptide
  XENP018370 vlCDR2
YASHRYT

SEQ ID NO: 19050 - protein, 9 aa, Artificial Sequence
  Description of Artificial Sequence: Synthetic peptide
  XENP018370 vlCDR3
QQDYSSPRT

SEQ ID NO: 19051 - protein, 451 aa, Artificial Sequence; identical to SEQ ID NO: 16221
  Description of Artificial Sequence: Synthetic polypeptide
  XENP018371 1G6_H1_L1.28_IgG1_PVA_/S267K Heavy Chain

SEQ ID NO: 19052 - protein, 122 aa, Artificial Sequence; identical to SEQ ID NO: 10922
  Description of Artificial Sequence: Synthetic polypeptide
  VH of XENP018371

SEQ ID NO: 19053 - protein, 5 aa, Artificial Sequence
  Description of Artificial Sequence: Synthetic peptide
  XENP018371 vhCDR1
NYWMN

SEQ ID NO: 19054 - protein, 19 aa, Artificial Sequence
  Description of Artificial Sequence: Synthetic peptide
  XENP018371 vhCDR2
EIRLKSNNYATHYAEPVKG

SEQ ID NO: 19055 - protein, 11 aa, Artificial Sequence
  Description of Artificial Sequence: Synthetic peptide
  XENP018371 vhCDR3
YYGNYGGYFDV

SEQ ID NO: 19056 - protein, 214 aa, Artificial Sequence
  Description of Artificial Sequence: Synthetic polypeptide
  XENP018371 1G6_H1_L1.28_IgG1_PVA_/S267K Light Chain
SIVMTQSPATLSVSPGERATLSCRASQSVYNDVAWYQQKPGQSPRLLINYASHRYTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 19057 - protein, 107 aa, Artificial Sequence; identical to SEQ ID NO: 13422
  Description of Artificial Sequence: Synthetic polypeptide
  VL of XENP018371

SEQ ID NO: 19058 - protein, 11 aa, Artificial Sequence
  Description of Artificial Sequence: Synthetic peptide
  XENP018371 vlCDR1
RASQSVYNDVA

SEQ ID NO: 19059 - protein, 7 aa, Artificial Sequence
  Description of Artificial Sequence: Synthetic peptide
  XENP018371 vlCDR2
YASHRYT

SEQ ID NO: 19060 - protein, 9 aa, Artificial Sequence
  Description of Artificial Sequence: Synthetic peptide
  XENP018371 vlCDR3
QQDYSSPRT

SEQ ID NO: 19061 - protein, 451 aa, Artificial Sequence; identical to SEQ ID NO: 16221
  Description of Artificial Sequence: Synthetic polypeptide
  XENP018372 1G6_H1_L1.29_IgG1_PVA_/S267K Heavy Chain

SEQ ID NO: 19062 - protein, 122 aa, Artificial Sequence; identical to SEQ ID NO: 10922
  Description of Artificial Sequence: Synthetic polypeptide
  VH of XENP018372

SEQ ID NO: 19063 - protein, 5 aa, Artificial Sequence
  Description of Artificial Sequence: Synthetic peptide
  XENP018372 vhCDR1
NYWMN

SEQ ID NO: 19064 - protein, 19 aa, Artificial Sequence
  Description of Artificial Sequence: Synthetic peptide
  XENP018372 vhCDR2
EIRLKSNNYATHYAEPVKG

SEQ ID NO: 19065 - protein, 11 aa, Artificial Sequence
  Description of Artificial Sequence: Synthetic peptide
  XENP018372 vhCDR3
YYGNYGGYFDV

SEQ ID NO: 19066 - protein, 214 aa, Artificial Sequence
  Description of Artificial Sequence: Synthetic polypeptide
  XENP018372 1G6_H1_L1.29_IgG1_PVA_/S267K Light Chain
SIVMTQSPATLSVSPGERATLSCRASQSVSDDVAWYQQKPGQSPRLLINYASHRYTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 19067 - protein, 107 aa, Artificial Sequence; identical to SEQ ID NO: 13431
  Description of Artificial Sequence: Synthetic polypeptide
  VL of XENP018372

SEQ ID NO: 19068 - protein, 11 aa, Artificial Sequence
  Description of Artificial Sequence: Synthetic peptide
  XENP018372 vlCDR1
RASQSVSDDVA

SEQ ID NO: 19069 - protein, 7 aa, Artificial Sequence
  Description of Artificial Sequence: Synthetic peptide
  XENP018372 vlCDR2
YASHRYT

SEQ ID NO: 19070 - protein, 9 aa, Artificial Sequence
  Description of Artificial Sequence: Synthetic peptide
  XENP018372 vlCDR3
QQDYSSPRT

SEQ ID NO: 19071 - protein, 451 aa, Artificial Sequence; identical to SEQ ID NO: 16221
  Description of Artificial Sequence: Synthetic polypeptide
  XENP018373 1G6_H1_L1.30_IgG1_PVA_/S267K Heavy Chain

SEQ ID NO: 19072 - protein, 122 aa, Artificial Sequence; identical to SEQ ID NO: 10922
  Description of Artificial Sequence: Synthetic polypeptide
  VH of XENP018373

SEQ ID NO: 19073 - protein, 5 aa, Artificial Sequence
  Description of Artificial Sequence: Synthetic peptide
  XENP018373 vhCDR1
NYWMN

SEQ ID NO: 19074 - protein, 19 aa, Artificial Sequence
  Description of Artificial Sequence: Synthetic peptide
  XENP018373 vhCDR2
EIRLKSNNYATHYAEPVKG

SEQ ID NO: 19075 - protein, 11 aa, Artificial Sequence
  Description of Artificial Sequence: Synthetic peptide
  XENP018373 vhCDR3
YYGNYGGYFDV

SEQ ID NO: 19076 - protein, 214 aa, Artificial Sequence
  Description of Artificial Sequence: Synthetic polypeptide
  XENP018373 1G6_H1_L1.30_IgG1_PVA_/S267K Light Chain
SIVMTQSPATLSVSPGERATLSCRASQSVSHDVAWYQQKPGQSPRLLINYASHRYTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 19077 - protein, 107 aa, Artificial Sequence; identical to SEQ ID NO: 13440
  Description of Artificial Sequence: Synthetic polypeptide
  VL of XENP018373

SEQ ID NO: 19078 - protein, 11 aa, Artificial Sequence
  Description of Artificial Sequence: Synthetic peptide
  XENP018373 vlCDR1
RASQSVSHDVA

SEQ ID NO: 19079 - protein, 7 aa, Artificial Sequence
  Description of Artificial Sequence: Synthetic peptide
  XENP018373 vlCDR2
YASHRYT

SEQ ID NO: 19080 - protein, 9 aa, Artificial Sequence
  Description of Artificial Sequence: Synthetic peptide
  XENP018373 vlCDR3
QQDYSSPRT

SEQ ID NO: 19081 - protein, 451 aa, Artificial Sequence; identical to SEQ ID NO: 16221
  Description of Artificial Sequence: Synthetic polypeptide
  XENP018374 1G6_H1_L1.31_IgG1_PVA_/S267K Heavy Chain

SEQ ID NO: 19082 - protein, 122 aa, Artificial Sequence; identical to SEQ ID NO: 10922
  Description of Artificial Sequence: Synthetic polypeptide
  VH of XENP018374

SEQ ID NO: 19083 - protein, 5 aa, Artificial Sequence
  Description of Artificial Sequence: Synthetic peptide
  XENP018374 vhCDR1
NYWMN

SEQ ID NO: 19084 - protein, 19 aa, Artificial Sequence
  Description of Artificial Sequence: Synthetic peptide
  XENP018374 vhCDR2
EIRLKSNNYATHYAEPVKG

SEQ ID NO: 19085 - protein, 11 aa, Artificial Sequence
  Description of Artificial Sequence: Synthetic peptide
  XENP018374 vhCDR3
YYGNYGGYFDV

SEQ ID NO: 19086 - protein, 214 aa, Artificial Sequence
  Description of Artificial Sequence: Synthetic polypeptide
  XENP018374 1G6_H1_L1.31_IgG1_PVA_/S267K Light Chain
SIVMTQSPATLSVSPGERATLSCRASQSVSEDVAWYQQKPGQSPRLLINYASHRYTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 19087 - protein, 107 aa, Artificial Sequence; identical to SEQ ID NO: 13449
  Description of Artificial Sequence: Synthetic polypeptide
  VL of XENP018374

SEQ ID NO: 19088 - protein, 11 aa, Artificial Sequence
  Description of Artificial Sequence: Synthetic peptide
  XENP018374 vlCDR1
RASQSVSEDVA

SEQ ID NO: 19089 - protein, 7 aa, Artificial Sequence
  Description of Artificial Sequence: Synthetic peptide
  XENP018374 vlCDR2
YASHRYT

SEQ ID NO: 19090 - protein, 9 aa, Artificial Sequence
  Description of Artificial Sequence: Synthetic peptide
  XENP018374 vlCDR3
QQDYSSPRT

SEQ ID NO: 19091 - protein, 451 aa, Artificial Sequence; identical to SEQ ID NO: 16221
  Description of Artificial Sequence: Synthetic polypeptide
  XENP018375 1G6_H1_L1.32_IgG1_PVA_/S267K Heavy Chain

SEQ ID NO: 19092 - protein, 122 aa, Artificial Sequence; identical to SEQ ID NO: 10922
  Description of Artificial Sequence: Synthetic polypeptide
  VH of XENP018375

SEQ ID NO: 19093 - protein, 5 aa, Artificial Sequence
  Description of Artificial Sequence: Synthetic peptide
  XENP018375 vhCDR1
NYWMN

SEQ ID NO: 19094 - protein, 19 aa, Artificial Sequence
  Description of Artificial Sequence: Synthetic peptide
  XENP018375 vhCDR2
EIRLKSNNYATHYAEPVKG

SEQ ID NO: 19095 - protein, 11 aa, Artificial Sequence
  Description of Artificial Sequence: Synthetic peptide
  XENP018375 vhCDR3
YYGNYGGYFDV

SEQ ID NO: 19096 - protein, 214 aa, Artificial Sequence
  Description of Artificial Sequence: Synthetic polypeptide
  XENP018375 1G6_H1_L1.32_IgG1_PVA_/S267K Light Chain
SIVMTQSPATLSVSPGERATLSCRASQSVSSDVAWYQQKPGQSPRLLINYASHRYTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 19097 - protein, 107 aa, Artificial Sequence; identical to SEQ ID NO: 13458
  Description of Artificial Sequence: Synthetic polypeptide
  VL of XENP018375

SEQ ID NO: 19098 - protein, 11 aa, Artificial Sequence
  Description of Artificial Sequence: Synthetic peptide
  XENP018375 vlCDR1
RASQSVSSDVA

SEQ ID NO: 19099 - protein, 7 aa, Artificial Sequence
  Description of Artificial Sequence: Synthetic peptide
  XENP018375 vlCDR2
YASHRYT

SEQ ID NO: 19100 - protein, 9 aa, Artificial Sequence
  Description of Artificial Sequence: Synthetic peptide
  XENP018375 vlCDR3
QQDYSSPRT

SEQ ID NO: 19101 - protein, 451 aa, Artificial Sequence; identical to SEQ ID NO: 16221
  Description of Artificial Sequence: Synthetic polypeptide
  XENP018376 1G6_H1_L1.33_IgG1_PVA_/S267K Heavy Chain

SEQ ID NO: 19102 - protein, 122 aa, Artificial Sequence; identical to SEQ ID NO: 10922
  Description of Artificial Sequence: Synthetic polypeptide
  VH of XENP018376

SEQ ID NO: 19103 - protein, 5 aa, Artificial Sequence
  Description of Artificial Sequence: Synthetic peptide
  XENP018376 vhCDR1
NYWMN

SEQ ID NO: 19104 - protein, 19 aa, Artificial Sequence
  Description of Artificial Sequence: Synthetic peptide
  XENP018376 vhCDR2
EIRLKSNNYATHYAEPVKG

SEQ ID NO: 19105 - protein, 11 aa, Artificial Sequence
  Description of Artificial Sequence: Synthetic peptide
  XENP018376 vhCDR3
YYGNYGGYFDV

SEQ ID NO: 19106 - protein, 214 aa, Artificial Sequence
  Description of Artificial Sequence: Synthetic polypeptide
  XENP018376 1G6_H1_L1.33_IgG1_PVA_/S267K Light Chain
SIVMTQSPATLSVSPGERATLSCRASQSVSRDVAWYQQKPGQSPRLLINYASHRYTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 19107 - protein, 107 aa, Artificial Sequence; identical to SEQ ID NO: 13467
  Description of Artificial Sequence: Synthetic polypeptide
  VL of XENP018376

SEQ ID NO: 19108 - protein, 11 aa, Artificial Sequence
  Description of Artificial Sequence: Synthetic peptide
  XENP018376 vlCDR1
RASQSVSRDVA

SEQ ID NO: 19109 - protein, 7 aa, Artificial Sequence
  Description of Artificial Sequence: Synthetic peptide
  XENP018376 vlCDR2
YASHRYT

SEQ ID NO: 19110 - protein, 9 aa, Artificial Sequence
  Description of Artificial Sequence: Synthetic peptide
  XENP018376 vlCDR3
QQDYSSPRT

SEQ ID NO: 19111 - protein, 451 aa, Artificial Sequence; identical to SEQ ID NO: 16221
  Description of Artificial Sequence: Synthetic polypeptide
  XENP018377 1G6_H1_L1.34_IgG1_PVA_/S267K Heavy Chain

SEQ ID NO: 19112 - protein, 122 aa, Artificial Sequence; identical to SEQ ID NO: 10922
  Description of Artificial Sequence: Synthetic polypeptide
  VH of XENP018377

SEQ ID NO: 19113 - protein, 5 aa, Artificial Sequence
  Description of Artificial Sequence: Synthetic peptide
  XENP018377 vhCDR1
NYWMN

SEQ ID NO: 19114 - protein, 19 aa, Artificial Sequence
  Description of Artificial Sequence: Synthetic peptide
  XENP018377 vhCDR2
EIRLKSNNYATHYAEPVKG

SEQ ID NO: 19115 - protein, 11 aa, Artificial Sequence
  Description of Artificial Sequence: Synthetic peptide
  XENP018377 vhCDR3
YYGNYGGYFDV

SEQ ID NO: 19116 - protein, 214 aa, Artificial Sequence
  Description of Artificial Sequence: Synthetic polypeptide
  XENP018377 1G6_H1_L1.34_IgG1_PVA_/S267K Light Chain
SIVMTQSPATLSVSPGERATLSCRASQSVSLDVAWYQQKPGQSPRLLINYASHRYTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 19117 - protein, 107 aa, Artificial Sequence; identical to SEQ ID NO: 13476
  Description of Artificial Sequence: Synthetic polypeptide
  VL of XENP018377

SEQ ID NO: 19118 - protein, 11 aa, Artificial Sequence
  Description of Artificial Sequence: Synthetic peptide
  XENP018377 vlCDR1
RASQSVSLDVA

SEQ ID NO: 19119 - protein, 7 aa, Artificial Sequence
  Description of Artificial Sequence: Synthetic peptide
  XENP018377 vlCDR2
YASHRYT

SEQ ID NO: 19120 - protein, 9 aa, Artificial Sequence
  Description of Artificial Sequence: Synthetic peptide
  XENP018377 vlCDR3
QQDYSSPRT

SEQ ID NO: 19121 - protein, 451 aa, Artificial Sequence; identical to SEQ ID NO: 16221
  Description of Artificial Sequence: Synthetic polypeptide
  XENP018378 1G6_H1_L1.35_IgG1_PVA_/S267K Heavy Chain

SEQ ID NO: 19122 - protein, 122 aa, Artificial Sequence; identical to SEQ ID NO: 10922
  Description of Artificial Sequence: Synthetic polypeptide
  VH of XENP018378

SEQ ID NO: 19123 - protein, 5 aa, Artificial Sequence
  Description of Artificial Sequence: Synthetic peptide
  XENP018378 vhCDR1
NYWMN

SEQ ID NO: 19124 - protein, 19 aa, Artificial Sequence
  Description of Artificial Sequence: Synthetic peptide
  XENP018378 vhCDR2
EIRLKSNNYATHYAEPVKG

SEQ ID NO: 19125 - protein, 11 aa, Artificial Sequence
  Description of Artificial Sequence: Synthetic peptide
  XENP018378 vhCDR3
YYGNYGGYFDV

SEQ ID NO: 19126 - protein, 214 aa, Artificial Sequence
  Description of Artificial Sequence: Synthetic polypeptide
  XENP018378 1G6_H1_L1.35_IgG1_PVA_/S267K Light Chain
SIVMTQSPATLSVSPGERATLSCRASQSVSTDVAWYQQKPGQSPRLLINYASHRYTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 19127 - protein, 107 aa, Artificial Sequence; identical to SEQ ID NO: 13485
  Description of Artificial Sequence: Synthetic polypeptide
  VL of XENP018378

SEQ ID NO: 19128 - protein, 11 aa, Artificial Sequence
  Description of Artificial Sequence: Synthetic peptide
  XENP018378 vlCDR1
RASQSVSTDVA

SEQ ID NO: 19129 - protein, 7 aa, Artificial Sequence
  Description of Artificial Sequence: Synthetic peptide
  XENP018378 vlCDR2
YASHRYT

SEQ ID NO: 19130 - protein, 9 aa, Artificial Sequence
  Description of Artificial Sequence: Synthetic peptide
  XENP018378 vlCDR3
QQDYSSPRT

SEQ ID NO: 19131 - protein, 451 aa, Artificial Sequence; identical to SEQ ID NO: 16221
  Description of Artificial Sequence: Synthetic polypeptide
  XENP018379 1G6_H1_L1.36_IgG1_PVA_/S267K Heavy Chain

SEQ ID NO: 19132 - protein, 122 aa, Artificial Sequence; identical to SEQ ID NO: 10922
  Description of Artificial Sequence: Synthetic polypeptide
  VH of XENP018379

SEQ ID NO: 19133 - protein, 5 aa, Artificial Sequence
  Description of Artificial Sequence: Synthetic peptide
  XENP018379 vhCDR1
NYWMN

SEQ ID NO: 19134 - protein, 19 aa, Artificial Sequence
  Description of Artificial Sequence: Synthetic peptide
  XENP018379 vhCDR2
EIRLKSNNYATHYAEPVKG

SEQ ID NO: 19135 - protein, 11 aa, Artificial Sequence
  Description of Artificial Sequence: Synthetic peptide
  XENP018379 vhCDR3
YYGNYGGYFDV

SEQ ID NO: 19136 - protein, 214 aa, Artificial Sequence
  Description of Artificial Sequence: Synthetic polypeptide
  XENP018379 1G6_H1_L1.36_IgG1_PVA_/S267K Light Chain
SIVMTQSPATLSVSPGERATLSCRASQSVSGDVAWYQQKPGQSPRLLINYASHRYTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 19137 - protein, 107 aa, Artificial Sequence; identical to SEQ ID NO: 13494
  Description of Artificial Sequence: Synthetic polypeptide
  VL of XENP018379

SEQ ID NO: 19138 - protein, 11 aa, Artificial Sequence
  Description of Artificial Sequence: Synthetic peptide
  XENP018379 vlCDR1
RASQSVSGDVA

SEQ ID NO: 19139 - protein, 7 aa, Artificial Sequence
  Description of Artificial Sequence: Synthetic peptide
  XENP018379 vlCDR2
YASHRYT

SEQ ID NO: 19140 - protein, 9 aa, Artificial Sequence
  Description of Artificial Sequence: Synthetic peptide
  XENP018379 vlCDR3
QQDYSSPRT

SEQ ID NO: 19141 - protein, 451 aa, Artificial Sequence; identical to SEQ ID NO: 16221
  Description of Artificial Sequence: Synthetic polypeptide
  XENP018380 1G6_H1_L1.37_IgG1_PVA_/S267K Heavy Chain

SEQ ID NO: 19142 - protein, 122 aa, Artificial Sequence; identical to SEQ ID NO: 10922
  Description of Artificial Sequence: Synthetic polypeptide
  VH of XENP018380

SEQ ID NO: 19143 - protein, 5 aa, Artificial Sequence
  Description of Artificial Sequence: Synthetic peptide
  XENP018380 vhCDR1
NYWMN

SEQ ID NO: 19144 - protein, 19 aa, Artificial Sequence
  Description of Artificial Sequence: Synthetic peptide
  XENP018380 vhCDR2
EIRLKSNNYATHYAEPVKG

SEQ ID NO: 19145 - protein, 11 aa, Artificial Sequence
  Description of Artificial Sequence: Synthetic peptide
  XENP018380 vhCDR3
YYGNYGGYFDV

SEQ ID NO: 19146 - protein, 214 aa, Artificial Sequence
  Description of Artificial Sequence: Synthetic polypeptide
  XENP018380 1G6_H1_L1.37_IgG1_PVA_/S267K Light Chain
SIVMTQSPATLSVSPGERATLSCRASQSVSYDVAWYQQKPGQSPRLLINYASHRYTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 19147 - protein, 107 aa, Artificial Sequence; identical to SEQ ID NO: 13503
  Description of Artificial Sequence: Synthetic polypeptide
  VL of XENP018380

SEQ ID NO: 19148 - protein, 11 aa, Artificial Sequence
  Description of Artificial Sequence: Synthetic peptide
  XENP018380 vlCDR1
RASQSVSYDVA

SEQ ID NO: 19149 - protein, 7 aa, Artificial Sequence
  Description of Artificial Sequence: Synthetic peptide
  XENP018380 vlCDR2
YASHRYT

SEQ ID NO: 19150 - protein, 9 aa, Artificial Sequence
  Description of Artificial Sequence: Synthetic peptide
  XENP018380 vlCDR3
QQDYSSPRT

SEQ ID NO: 19151 - protein, 451 aa, Artificial Sequence; identical to SEQ ID NO: 16221
  Description of Artificial Sequence: Synthetic polypeptide
  XENP018381 1G6_H1_L1.38_IgG1_PVA_/S267K Heavy Chain

SEQ ID NO: 19152 - protein, 122 aa, Artificial Sequence; identical to SEQ ID NO: 10922
  Description of Artificial Sequence: Synthetic polypeptide
  VH of XENP018381

SEQ ID NO: 19153 - protein, 5 aa, Artificial Sequence
  Description of Artificial Sequence: Synthetic peptide
  XENP018381 vhCDR1
NYWMN

SEQ ID NO: 19154 - protein, 19 aa, Artificial Sequence
  Description of Artificial Sequence: Synthetic peptide
  XENP018381 vhCDR2
EIRLKSNNYATHYAEPVKG

SEQ ID NO: 19155 - protein, 11 aa, Artificial Sequence
  Description of Artificial Sequence: Synthetic peptide
  XENP018381 vhCDR3
YYGNYGGYFDV

SEQ ID NO: 19156 - protein, 214 aa, Artificial Sequence
  Description of Artificial Sequence: Synthetic polypeptide
  XENP018381 1G6_H1_L1.38_IgG1_PVA_/S267K Light Chain
SIVMTQSPATLSVSPGERATLSCRASQSVSNNVAWYQQKPGQSPRLLINYASHRYTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 19157 - protein, 107 aa, Artificial Sequence; identical to SEQ ID NO: 13512
  Description of Artificial Sequence: Synthetic polypeptide
  VL of XENP018381

SEQ ID NO: 19158 - protein, 11 aa, Artificial Sequence
  Description of Artificial Sequence: Synthetic peptide
  XENP018381 vlCDR1
RASQSVSNNVA

SEQ ID NO: 19159 - protein, 7 aa, Artificial Sequence
  Description of Artificial Sequence: Synthetic peptide
  XENP018381 vlCDR2
YASHRYT

SEQ ID NO: 19160 - protein, 9 aa, Artificial Sequence
  Description of Artificial Sequence: Synthetic peptide
  XENP018381 vlCDR3
QQDYSSPRT

SEQ ID NO: 19161 - protein, 451 aa, Artificial Sequence; identical to SEQ ID NO: 16221
  Description of Artificial Sequence: Synthetic polypeptide
  XENP018382 1G6_H1_L1.39_IgG1_PVA_/S267K Heavy Chain

SEQ ID NO: 19162 - protein, 122 aa, Artificial Sequence; identical to SEQ ID NO: 10922
  Description of Artificial Sequence: Synthetic polypeptide
  VH of XENP018382

SEQ ID NO: 19163 - protein, 5 aa, Artificial Sequence
  Description of Artificial Sequence: Synthetic peptide
  XENP018382 vhCDR1
NYWMN

SEQ ID NO: 19164 - protein, 19 aa, Artificial Sequence
  Description of Artificial Sequence: Synthetic peptide
  XENP018382 vhCDR2
EIRLKSNNYATHYAEPVKG

SEQ ID NO: 19165 - protein, 11 aa, Artificial Sequence
  Description of Artificial Sequence: Synthetic peptide
  XENP018382 vhCDR3
YYGNYGGYFDV

SEQ ID NO: 19166 - protein, 214 aa, Artificial Sequence
  Description of Artificial Sequence: Synthetic polypeptide
  XENP018382 1G6_H1_L1.39_IgG1_PVA_/S267K Light Chain
SIVMTQSPATLSVSPGERATLSCRASQSVSNEVAWYQQKPGQSPRLLINYASHRYTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 19167 - protein, 107 aa, Artificial Sequence; identical to SEQ ID NO: 13521
  Description of Artificial Sequence: Synthetic polypeptide
  VL of XENP018382

SEQ ID NO: 19168 - protein, 11 aa, Artificial Sequence
  Description of Artificial Sequence: Synthetic peptide
  XENP018382 vlCDR1
RASQSVSNEVA

SEQ ID NO: 19169 - protein, 7 aa, Artificial Sequence
  Description of Artificial Sequence: Synthetic peptide
  XENP018382 vlCDR2
YASHRYT

SEQ ID NO: 19170 - protein, 9 aa, Artificial Sequence
  Description of Artificial Sequence: Synthetic peptide
  XENP018382 vlCDR3
QQDYSSPRT

SEQ ID NO: 19171 - protein, 451 aa, Artificial Sequence; identical to SEQ ID NO: 16221
  Description of Artificial Sequence: Synthetic polypeptide
  XENP018383 1G6_H1_L1.40_IgG1_PVA_/S267K Heavy Chain

SEQ ID NO: 19172 - protein, 122 aa, Artificial Sequence; identical to SEQ ID NO: 10922
  Description of Artificial Sequence: Synthetic polypeptide
  VH of XENP018383

SEQ ID NO: 19173 - protein, 5 aa, Artificial Sequence
  Description of Artificial Sequence: Synthetic peptide
  XENP018383 vhCDR1
NYWMN

SEQ ID NO: 19174 - protein, 19 aa, Artificial Sequence
  Description of Artificial Sequence: Synthetic peptide
  XENP018383 vhCDR2
EIRLKSNNYATHYAEPVKG

SEQ ID NO: 19175 - protein, 11 aa, Artificial Sequence
  Description of Artificial Sequence: Synthetic peptide
  XENP018383 vhCDR3
YYGNYGGYFDV

SEQ ID NO: 19176 - protein, 214 aa, Artificial Sequence
  Description of Artificial Sequence: Synthetic polypeptide
  XENP018383 1G6_H1_L1.40_IgG1_PVA_/S267K Light Chain
SIVMTQSPATLSVSPGERATLSCRASQSVSNHVAWYQQKPGQSPRLLINYASHRYTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 19177 - protein, 107 aa, Artificial Sequence; identical to SEQ ID NO: 13530
  Description of Artificial Sequence: Synthetic polypeptide
  VL of XENP018383

SEQ ID NO: 19178 - protein, 11 aa, Artificial Sequence
  Description of Artificial Sequence: Synthetic peptide
  XENP018383 vlCDR1
RASQSVSNHVA

SEQ ID NO: 19179 - protein, 7 aa, Artificial Sequence
  Description of Artificial Sequence: Synthetic peptide
  XENP018383 vlCDR2
YASHRYT

SEQ ID NO: 19180 - protein, 9 aa, Artificial Sequence
  Description of Artificial Sequence: Synthetic peptide
  XENP018383 vlCDR3
QQDYSSPRT

SEQ ID NO: 19181 - protein, 451 aa, Artificial Sequence; identical to SEQ ID NO: 16221
  Description of Artificial Sequence: Synthetic polypeptide
  XENP018384 1G6_H1_L1.41_IgG1_PVA_/S267K Heavy Chain

SEQ ID NO: 19182 - protein, 122 aa, Artificial Sequence; identical to SEQ ID NO: 10922
  Description of Artificial Sequence: Synthetic polypeptide
  VH of XENP018384

SEQ ID NO: 19183 - protein, 5 aa, Artificial Sequence
  Description of Artificial Sequence: Synthetic peptide
  XENP018384 vhCDR1
NYWMN

SEQ ID NO: 19184 - protein, 19 aa, Artificial Sequence
  Description of Artificial Sequence: Synthetic peptide
  XENP018384 vhCDR2
EIRLKSNNYATHYAEPVKG

SEQ ID NO: 19185 - protein, 11 aa, Artificial Sequence
  Description of Artificial Sequence: Synthetic peptide
  XENP018384 vhCDR3
YYGNYGGYFDV

SEQ ID NO: 19186 - protein, 214 aa, Artificial Sequence
  Description of Artificial Sequence: Synthetic polypeptide
  XENP018384 1G6_H1_L1.41_IgG1_PVA_/S267K Light Chain
SIVMTQSPATLSVSPGERATLSCRASQSVSNSVAWYQQKPGQSPRLLINYASHRYTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 19187 - protein, 107 aa, Artificial Sequence; identical to SEQ ID NO: 13539
  Description of Artificial Sequence: Synthetic polypeptide
  VL of XENP018384

SEQ ID NO: 19188 - protein, 11 aa, Artificial Sequence
  Description of Artificial Sequence: Synthetic peptide
  XENP018384 vlCDR1
RASQSVSNSVA

SEQ ID NO: 19189 - protein, 7 aa, Artificial Sequence
  Description of Artificial Sequence: Synthetic peptide
  XENP018384 vlCDR2
YASHRYT

SEQ ID NO: 19190 - protein, 9 aa, Artificial Sequence
  Description of Artificial Sequence: Synthetic peptide
  XENP018384 vlCDR3
QQDYSSPRT

SEQ ID NO: 19191 - protein, 451 aa, Artificial Sequence; identical to SEQ ID NO: 16221
  Description of Artificial Sequence: Synthetic polypeptide
  XENP018385 1G6_H1_L1.42_IgG1_PVA_/S267K Heavy Chain

SEQ ID NO: 19192 - protein, 122 aa, Artificial Sequence; identical to SEQ ID NO: 10922
  Description of Artificial Sequence: Synthetic polypeptide
  VH of XENP018385

SEQ ID NO: 19193 - protein, 5 aa, Artificial Sequence
  Description of Artificial Sequence: Synthetic peptide
  XENP018385 vhCDR1
NYWMN

SEQ ID NO: 19194 - protein, 19 aa, Artificial Sequence
  Description of Artificial Sequence: Synthetic peptide
  XENP018385 vhCDR2
EIRLKSNNYATHYAEPVKG

SEQ ID NO: 19195 - protein, 11 aa, Artificial Sequence
  Description of Artificial Sequence: Synthetic peptide
  XENP018385 vhCDR3
YYGNYGGYFDV

SEQ ID NO: 19196 - protein, 214 aa, Artificial Sequence
  Description of Artificial Sequence: Synthetic polypeptide
  XENP018385 1G6_H1_L1.42_IgG1_PVA_/S267K Light Chain
SIVMTQSPATLSVSPGERATLSCRASQSVSNRVAWYQQKPGQSPRLLINYASHRYTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 19197 - protein, 107 aa, Artificial Sequence; identical to SEQ ID NO: 13548
  Description of Artificial Sequence: Synthetic polypeptide
  VL of XENP018385

SEQ ID NO: 19198 - protein, 11 aa, Artificial Sequence
  Description of Artificial Sequence: Synthetic peptide
  XENP018385 vlCDR1
RASQSVSNRVA

SEQ ID NO: 19199 - protein, 7 aa, Artificial Sequence
  Description of Artificial Sequence: Synthetic peptide
  XENP018385 vlCDR2
YASHRYT

SEQ ID NO: 19200 - protein, 9 aa, Artificial Sequence
  Description of Artificial Sequence: Synthetic peptide
  XENP018385 vlCDR3
QQDYSSPRT

SEQ ID NO: 19201 - protein, 451 aa, Artificial Sequence; identical to SEQ ID NO: 16221
  Description of Artificial Sequence: Synthetic polypeptide
  XENP018386 1G6_H1_L1.43_IgG1_PVA_/S267K Heavy Chain

SEQ ID NO: 19202 - protein, 122 aa, Artificial Sequence; identical to SEQ ID NO: 10922
  Description of Artificial Sequence: Synthetic polypeptide
  VH of XENP018386

SEQ ID NO: 19203 - protein, 5 aa, Artificial Sequence
  Description of Artificial Sequence: Synthetic peptide
  XENP018386 vhCDR1
NYWMN

SEQ ID NO: 19204 - protein, 19 aa, Artificial Sequence
  Description of Artificial Sequence: Synthetic peptide
  XENP018386 vhCDR2
EIRLKSNNYATHYAEPVKG

SEQ ID NO: 19205 - protein, 11 aa, Artificial Sequence
  Description of Artificial Sequence: Synthetic peptide
  XENP018386 vhCDR3
YYGNYGGYFDV

SEQ ID NO: 19206 - protein, 214 aa, Artificial Sequence
  Description of Artificial Sequence: Synthetic polypeptide
  XENP018386 1G6_H1_L1.43_IgG1_PVA_/S267K Light Chain
SIVMTQSPATLSVSPGERATLSCRASQSVSNLVAWYQQKPGQSPRLLINYASHRYTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 19207 - protein, 107 aa, Artificial Sequence; identical to SEQ ID NO: 13557
  Description of Artificial Sequence: Synthetic polypeptide
  VL of XENP018386

SEQ ID NO: 19208 - protein, 11 aa, Artificial Sequence
  Description of Artificial Sequence: Synthetic peptide
  XENP018386 vlCDR1
RASQSVSNLVA

SEQ ID NO: 19209 - protein, 7 aa, Artificial Sequence
  Description of Artificial Sequence: Synthetic peptide
  XENP018386 vlCDR2
YASHRYT

SEQ ID NO: 19210 - protein, 9 aa, Artificial Sequence
  Description of Artificial Sequence: Synthetic peptide
  XENP018386 vlCDR3
QQDYSSPRT

SEQ ID NO: 19211 - protein, 451 aa, Artificial Sequence; identical to SEQ ID NO: 16221
  Description of Artificial Sequence: Synthetic polypeptide
  XENP018387 1G6_H1_L1.44_IgG1_PVA_/S267K Heavy Chain

SEQ ID NO: 19212 - protein, 122 aa, Artificial Sequence; identical to SEQ ID NO: 10922
  Description of Artificial Sequence: Synthetic polypeptide
  VH of XENP018387

SEQ ID NO: 19213 - protein, 5 aa, Artificial Sequence
  Description of Artificial Sequence: Synthetic peptide
  XENP018387 vhCDR1
NYWMN

SEQ ID NO: 19214 - protein, 19 aa, Artificial Sequence
  Description of Artificial Sequence: Synthetic peptide
  XENP018387 vhCDR2
EIRLKSNNYATHYAEPVKG

SEQ ID NO: 19215 - protein, 11 aa, Artificial Sequence
  Description of Artificial Sequence: Synthetic peptide
  XENP018387 vhCDR3
YYGNYGGYFDV

SEQ ID NO: 19216 - protein, 214 aa, Artificial Sequence
  Description of Artificial Sequence: Synthetic polypeptide
  XENP018387 1G6_H1_L1.44_IgG1_PVA_/S267K Light Chain
SIVMTQSPATLSVSPGERATLSCRASQSVSNTVAWYQQKPGQSPRLLINYASHRYTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 19217 - protein, 107 aa, Artificial Sequence; identical to SEQ ID NO: 13566
  Description of Artificial Sequence: Synthetic polypeptide
  VL of XENP018387

SEQ ID NO: 19218 - protein, 11 aa, Artificial Sequence
  Description of Artificial Sequence: Synthetic peptide
  XENP018387 vlCDR1
RASQSVSNTVA

SEQ ID NO: 19219 - protein, 7 aa, Artificial Sequence
  Description of Artificial Sequence: Synthetic peptide
  XENP018387 vlCDR2
YASHRYT

SEQ ID NO: 19220 - protein, 9 aa, Artificial Sequence
  Description of Artificial Sequence: Synthetic peptide
  XENP018387 vlCDR3
QQDYSSPRT

SEQ ID NO: 19221 - protein, 451 aa, Artificial Sequence; identical to SEQ ID NO: 16221
  Description of Artificial Sequence: Synthetic polypeptide
  XENP018388 1G6_H1_L1.45_IgG1_PVA_/S267K Heavy Chain

SEQ ID NO: 19222 - protein, 122 aa, Artificial Sequence; identical to SEQ ID NO: 10922
  Description of Artificial Sequence: Synthetic polypeptide
  VH of XENP018388

SEQ ID NO: 19223 - protein, 5 aa, Artificial Sequence
  Description of Artificial Sequence: Synthetic peptide
  XENP018388 vhCDR1
NYWMN

SEQ ID NO: 19224 - protein, 19 aa, Artificial Sequence
  Description of Artificial Sequence: Synthetic peptide
  XENP018388 vhCDR2
EIRLKSNNYATHYAEPVKG

SEQ ID NO: 19225 - protein, 11 aa, Artificial Sequence
  Description of Artificial Sequence: Synthetic peptide
  XENP018388 vhCDR3
YYGNYGGYFDV

SEQ ID NO: 19226 - protein, 214 aa, Artificial Sequence
  Description of Artificial Sequence: Synthetic polypeptide
  XENP018388 1G6_H1_L1.45_IgG1_PVA_/S267K Light Chain
SIVMTQSPATLSVSPGERATLSCRASQSVSNGVAWYQQKPGQSPRLLINYASHRYTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 19227 - protein, 107 aa, Artificial Sequence; identical to SEQ ID NO: 13575
  Description of Artificial Sequence: Synthetic polypeptide
  VL of XENP018388

SEQ ID NO: 19228 - protein, 11 aa, Artificial Sequence
  Description of Artificial Sequence: Synthetic peptide
  XENP018388 vlCDR1
RASQSVSNGVA

SEQ ID NO: 19229 - protein, 7 aa, Artificial Sequence
  Description of Artificial Sequence: Synthetic peptide
  XENP018388 vlCDR2
YASHRYT

SEQ ID NO: 19230 - protein, 9 aa, Artificial Sequence
  Description of Artificial Sequence: Synthetic peptide
  XENP018388 vlCDR3
QQDYSSPRT

SEQ ID NO: 19231 - protein, 451 aa, Artificial Sequence; identical to SEQ ID NO: 16221
  Description of Artificial Sequence: Synthetic polypeptide
  XENP018389 1G6_H1_L1.46_IgG1_PVA_/S267K Heavy Chain

SEQ ID NO: 19232 - protein, 122 aa, Artificial Sequence; identical to SEQ ID NO: 10922
  Description of Artificial Sequence: Synthetic polypeptide
  VH of XENP018389

SEQ ID NO: 19233 - protein, 5 aa, Artificial Sequence
  Description of Artificial Sequence: Synthetic peptide
  XENP018389 vhCDR1
NYWMN

SEQ ID NO: 19234 - protein, 19 aa, Artificial Sequence
  Description of Artificial Sequence: Synthetic peptide
  XENP018389 vhCDR2
EIRLKSNNYATHYAEPVKG

SEQ ID NO: 19235 - protein, 11 aa, Artificial Sequence
  Description of Artificial Sequence: Synthetic peptide
  XENP018389 vhCDR3
YYGNYGGYFDV

SEQ ID NO: 19236 - protein, 214 aa, Artificial Sequence
  Description of Artificial Sequence: Synthetic polypeptide
  XENP018389 1G6_H1_L1.46_IgG1_PVA_/S267K Light Chain
SIVMTQSPATLSVSPGERATLSCRASQSVSNYVAWYQQKPGQSPRLLINYASHRYTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 19237 - protein, 107 aa, Artificial Sequence; identical to SEQ ID NO: 13584
  Description of Artificial Sequence: Synthetic polypeptide
  VL of XENP018389

SEQ ID NO: 19238 - protein, 11 aa, Artificial Sequence
  Description of Artificial Sequence: Synthetic peptide
  XENP018389 vlCDR1
RASQSVSNYVA

SEQ ID NO: 19239 - protein, 7 aa, Artificial Sequence
  Description of Artificial Sequence: Synthetic peptide
  XENP018389 vlCDR2
YASHRYT

SEQ ID NO: 19240 - protein, 9 aa, Artificial Sequence
  Description of Artificial Sequence: Synthetic peptide
  XENP018389 vlCDR3
QQDYSSPRT

SEQ ID NO: 19241 - protein, 451 aa, Artificial Sequence; identical to SEQ ID NO: 16221
  Description of Artificial Sequence: Synthetic polypeptide
  XENP018390 1G6_H1_L1.47_IgG1_PVA_/S267K Heavy Chain

SEQ ID NO: 19242 - protein, 122 aa, Artificial Sequence; identical to SEQ ID NO: 10922
  Description of Artificial Sequence: Synthetic polypeptide
  VH of XENP018390

SEQ ID NO: 19243 - protein, 5 aa, Artificial Sequence
  Description of Artificial Sequence: Synthetic peptide
  XENP018390 vhCDR1
NYWMN

SEQ ID NO: 19244 - protein, 19 aa, Artificial Sequence
  Description of Artificial Sequence: Synthetic peptide
  XENP018390 vhCDR2
EIRLKSNNYATHYAEPVKG

SEQ ID NO: 19245 - protein, 11 aa, Artificial Sequence
  Description of Artificial Sequence: Synthetic peptide
  XENP018390 vhCDR3
YYGNYGGYFDV

SEQ ID NO: 19246 - protein, 214 aa, Artificial Sequence
  Description of Artificial Sequence: Synthetic polypeptide
  XENP018390 1G6_H1_L1.47_IgG1_PVA_/S267K Light Chain
SIVMTQSPATLSVSPGERATLSCRASQSVSNDLAWYQQKPGQSPRLLINYASHRYTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 19247 - protein, 107 aa, Artificial Sequence; identical to SEQ ID NO: 13593
  Description of Artificial Sequence: Synthetic polypeptide
  VL of XENP018390

SEQ ID NO: 19248 - protein, 11 aa, Artificial Sequence
  Description of Artificial Sequence: Synthetic peptide
  XENP018390 vlCDR1
RASQSVSNDLA

SEQ ID NO: 19249 - protein, 7 aa, Artificial Sequence
  Description of Artificial Sequence: Synthetic peptide
  XENP018390 vlCDR2
YASHRYT

SEQ ID NO: 19250 - protein, 9 aa, Artificial Sequence
  Description of Artificial Sequence: Synthetic peptide
  XENP018390 vlCDR3
QQDYSSPRT

SEQ ID NO: 19251 - protein, 451 aa, Artificial Sequence; identical to SEQ ID NO: 16221
  Description of Artificial Sequence: Synthetic polypeptide
  XENP018391 1G6_H1_L1.48_IgG1_PVA_/S267K Heavy Chain

SEQ ID NO: 19252 - protein, 122 aa, Artificial Sequence; identical to SEQ ID NO: 10922
  Description of Artificial Sequence: Synthetic polypeptide
  VH of XENP018391

SEQ ID NO: 19253 - protein, 5 aa, Artificial Sequence
  Description of Artificial Sequence: Synthetic peptide
  XENP018391 vhCDR1
NYWMN

SEQ ID NO: 19254 - protein, 19 aa, Artificial Sequence
  Description of Artificial Sequence: Synthetic peptide
  XENP018391 vhCDR2
EIRLKSNNYATHYAEPVKG

SEQ ID NO: 19255 - protein, 11 aa, Artificial Sequence
  Description of Artificial Sequence: Synthetic peptide
  XENP018391 vhCDR3
YYGNYGGYFDV

SEQ ID NO: 19256 - protein, 214 aa, Artificial Sequence
  Description of Artificial Sequence: Synthetic polypeptide
  XENP018391 1G6_H1_L1.48_IgG1_PVA_/S267K Light Chain
SIVMTQSPATLSVSPGERATLSCRASQSVSNDVSWYQQKPGQSPRLLINYASHRYTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 19257 - protein, 107 aa, Artificial Sequence; identical to SEQ ID NO: 13602
  Description of Artificial Sequence: Synthetic polypeptide
  VL of XENP018391

SEQ ID NO: 19258 - protein, 11 aa, Artificial Sequence
  Description of Artificial Sequence: Synthetic peptide
  XENP018391 vlCDR1
RASQSVSNDVS

SEQ ID NO: 19259 - protein, 7 aa, Artificial Sequence
  Description of Artificial Sequence: Synthetic peptide
  XENP018391 vlCDR2
YASHRYT

SEQ ID NO: 19260 - protein, 9 aa, Artificial Sequence
  Description of Artificial Sequence: Synthetic peptide
  XENP018391 vlCDR3
QQDYSSPRT

SEQ ID NO: 19261 - protein, 451 aa, Artificial Sequence; identical to SEQ ID NO: 16221
  Description of Artificial Sequence: Synthetic polypeptide
  XENP018392 1G6_H1_L1.49_IgG1_PVA_/S267K Heavy Chain

SEQ ID NO: 19262 - protein, 122 aa, Artificial Sequence; identical to SEQ ID NO: 10922
  Description of Artificial Sequence: Synthetic polypeptide
  VH of XENP018392

SEQ ID NO: 19263 - protein, 5 aa, Artificial Sequence
  Description of Artificial Sequence: Synthetic peptide
  XENP018392 vhCDR1
NYWMN

SEQ ID NO: 19264 - protein, 19 aa, Artificial Sequence
  Description of Artificial Sequence: Synthetic peptide
  XENP018392 vhCDR2
EIRLKSNNYATHYAEPVKG

SEQ ID NO: 19265 - protein, 11 aa, Artificial Sequence
  Description of Artificial Sequence: Synthetic peptide
  XENP018392 vhCDR3
YYGNYGGYFDV

SEQ ID NO: 19266 - protein, 214 aa, Artificial Sequence
  Description of Artificial Sequence: Synthetic polypeptide
  XENP018392 1G6_H1_L1.49_IgG1_PVA_/S267K Light Chain
SIVMTQSPATLSVSPGERATLSCRASQSVSNDVTWYQQKPGQSPRLLINYASHRYTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 19267 - protein, 107 aa, Artificial Sequence; identical to SEQ ID NO: 13611
  Description of Artificial Sequence: Synthetic polypeptide
  VL of XENP018392

SEQ ID NO: 19268 - protein, 11 aa, Artificial Sequence
  Description of Artificial Sequence: Synthetic peptide
  XENP018392 vlCDR1
RASQSVSNDVT

SEQ ID NO: 19269 - protein, 7 aa, Artificial Sequence
  Description of Artificial Sequence: Synthetic peptide
  XENP018392 vlCDR2
YASHRYT

SEQ ID NO: 19270 - protein, 9 aa, Artificial Sequence
  Description of Artificial Sequence: Synthetic peptide
  XENP018392 vlCDR3
QQDYSSPRT

SEQ ID NO: 19271 - protein, 451 aa, Artificial Sequence; identical to SEQ ID NO: 16221
  Description of Artificial Sequence: Synthetic polypeptide
  XENP018393 1G6_H1_L1.50_IgG1_PVA_/S267K Heavy Chain

SEQ ID NO: 19272 - protein, 122 aa, Artificial Sequence; identical to SEQ ID NO: 10922
  Description of Artificial Sequence: Synthetic polypeptide
  VH of XENP018393

SEQ ID NO: 19273 - protein, 5 aa, Artificial Sequence
  Description of Artificial Sequence: Synthetic peptide
  XENP018393 vhCDR1
NYWMN

SEQ ID NO: 19274 - protein, 19 aa, Artificial Sequence
  Description of Artificial Sequence: Synthetic peptide
  XENP018393 vhCDR2
EIRLKSNNYATHYAEPVKG

SEQ ID NO: 19275 - protein, 11 aa, Artificial Sequence
  Description of Artificial Sequence: Synthetic peptide
  XENP018393 vhCDR3
YYGNYGGYFDV

SEQ ID NO: 19276 - protein, 214 aa, Artificial Sequence
  Description of Artificial Sequence: Synthetic polypeptide
  XENP018393 1G6_H1_L1.50_IgG1_PVA_/S267K Light Chain
SIVMTQSPATLSVSPGERATLSCRASQSVSNDVAWYQQKPGQAPRLLINYASHRYTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 19277 - protein, 107 aa, Artificial Sequence; identical to SEQ ID NO: 13620
  Description of Artificial Sequence: Synthetic polypeptide
  VL of XENP018393

SEQ ID NO: 19278 - protein, 11 aa, Artificial Sequence
  Description of Artificial Sequence: Synthetic peptide
  XENP018393 vlCDR1
RASQSVSNDVA

SEQ ID NO: 19279 - protein, 7 aa, Artificial Sequence
  Description of Artificial Sequence: Synthetic peptide
  XENP018393 vlCDR2
YASHRYT

SEQ ID NO: 19280 - protein, 9 aa, Artificial Sequence
  Description of Artificial Sequence: Synthetic peptide
  XENP018393 vlCDR3
QQDYSSPRT

SEQ ID NO: 19281 - protein, 451 aa, Artificial Sequence; identical to SEQ ID NO: 16221
  Description of Artificial Sequence: Synthetic polypeptide
  XENP018394 1G6_H1_L1.51_IgG1_PVA_/S267K Heavy Chain

SEQ ID NO: 19282 - protein, 122 aa, Artificial Sequence; identical to SEQ ID NO: 10922
  Description of Artificial Sequence: Synthetic polypeptide
  VH of XENP018394

SEQ ID NO: 19283 - protein, 5 aa, Artificial Sequence
  Description of Artificial Sequence: Synthetic peptide
  XENP018394 vhCDR1
NYWMN

SEQ ID NO: 19284 - protein, 19 aa, Artificial Sequence
  Description of Artificial Sequence: Synthetic peptide
  XENP018394 vhCDR2
EIRLKSNNYATHYAEPVKG

SEQ ID NO: 19285 - protein, 11 aa, Artificial Sequence
  Description of Artificial Sequence: Synthetic peptide
  XENP018394 vhCDR3
YYGNYGGYFDV

SEQ ID NO: 19286 - protein, 214 aa, Artificial Sequence
  Description of Artificial Sequence: Synthetic polypeptide
  XENP018394 1G6_H1_L1.51_IgG1_PVA_/S267K Light Chain
SIVMTQSPATLSVSPGERATLSCRASQSVSNDVAWYQQKPGQSPKLLINYASHRYTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 19287 - protein, 107 aa, Artificial Sequence; identical to SEQ ID NO: 13629
  Description of Artificial Sequence: Synthetic polypeptide
  VL of XENP018394

SEQ ID NO: 19288 - protein, 11 aa, Artificial Sequence
  Description of Artificial Sequence: Synthetic peptide
  XENP018394 vlCDR1
RASQSVSNDVA

SEQ ID NO: 19289 - protein, 7 aa, Artificial Sequence
  Description of Artificial Sequence: Synthetic peptide
  XENP018394 vlCDR2
YASHRYT

SEQ ID NO: 19290 - protein, 9 aa, Artificial Sequence
  Description of Artificial Sequence: Synthetic peptide
  XENP018394 vlCDR3
QQDYSSPRT

SEQ ID NO: 19291 - protein, 451 aa, Artificial Sequence; identical to SEQ ID NO: 16221
  Description of Artificial Sequence: Synthetic polypeptide
  XENP018395 1G6_H1_L1.52_IgG1_PVA_/S267K Heavy Chain

SEQ ID NO: 19292 - protein, 122 aa, Artificial Sequence; identical to SEQ ID NO: 10922
  Description of Artificial Sequence: Synthetic polypeptide
  VH of XENP018395

SEQ ID NO: 19293 - protein, 5 aa, Artificial Sequence
  Description of Artificial Sequence: Synthetic peptide
  XENP018395 vhCDR1
NYWMN

SEQ ID NO: 19294 - protein, 19 aa, Artificial Sequence
  Description of Artificial Sequence: Synthetic peptide
  XENP018395 vhCDR2
EIRLKSNNYATHYAEPVKG

SEQ ID NO: 19295 - protein, 11 aa, Artificial Sequence
  Description of Artificial Sequence: Synthetic peptide
  XENP018395 vhCDR3
YYGNYGGYFDV

SEQ ID NO: 19296 - protein, 214 aa, Artificial Sequence
  Description of Artificial Sequence: Synthetic polypeptide
  XENP018395 1G6_H1_L1.52_IgG1_PVA_/S267K Light Chain
SIVMTQSPATLSVSPGERATLSCRASQSVSNDVAWYQQKPGQSPQLLINYASHRYTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 19297 - protein, 107 aa, Artificial Sequence; identical to SEQ ID NO: 13638
  Description of Artificial Sequence: Synthetic polypeptide
  VL of XENP018395

SEQ ID NO: 19298 - protein, 11 aa, Artificial Sequence
  Description of Artificial Sequence: Synthetic peptide
  XENP018395 vlCDR1
RASQSVSNDVA

SEQ ID NO: 19299 - protein, 7 aa, Artificial Sequence
  Description of Artificial Sequence: Synthetic peptide
  XENP018395 vlCDR2
YASHRYT

SEQ ID NO: 19300 - protein, 9 aa, Artificial Sequence
  Description of Artificial Sequence: Synthetic peptide
  XENP018395 vlCDR3
QQDYSSPRT

SEQ ID NO: 19301 - protein, 451 aa, Artificial Sequence; identical to SEQ ID NO: 16221
  Description of Artificial Sequence: Synthetic polypeptide
  XENP018396 1G6_H1_L1.53_IgG1_PVA_/S267K Heavy Chain

SEQ ID NO: 19302 - protein, 122 aa, Artificial Sequence; identical to SEQ ID NO: 10922
  Description of Artificial Sequence: Synthetic polypeptide
  VH of XENP018396

SEQ ID NO: 19303 - protein, 5 aa, Artificial Sequence
  Description of Artificial Sequence: Synthetic peptide
  XENP018396 vhCDR1
NYWMN

SEQ ID NO: 19304 - protein, 19 aa, Artificial Sequence
  Description of Artificial Sequence: Synthetic peptide
  XENP018396 vhCDR2
EIRLKSNNYATHYAEPVKG

SEQ ID NO: 19305 - protein, 11 aa, Artificial Sequence
  Description of Artificial Sequence: Synthetic peptide
  XENP018396 vhCDR3
YYGNYGGYFDV

SEQ ID NO: 19306 - protein, 214 aa, Artificial Sequence
  Description of Artificial Sequence: Synthetic polypeptide
  XENP018396 1G6_H1_L1.53_IgG1_PVA_/S267K Light Chain
SIVMTQSPATLSVSPGERATLSCRASQSVSNDVAWYQQKPGQSPILLINYASHRYTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 19307 - protein, 107 aa, Artificial Sequence; identical to SEQ ID NO: 13647
  Description of Artificial Sequence: Synthetic polypeptide
  VL of XENP018396

SEQ ID NO: 19308 - protein, 11 aa, Artificial Sequence
  Description of Artificial Sequence: Synthetic peptide
  XENP018396 vlCDR1
RASQSVSNDVA

SEQ ID NO: 19309 - protein, 7 aa, Artificial Sequence
  Description of Artificial Sequence: Synthetic peptide
  XENP018396 vlCDR2
YASHRYT

SEQ ID NO: 19310 - protein, 9 aa, Artificial Sequence
  Description of Artificial Sequence: Synthetic peptide
  XENP018396 vlCDR3
QQDYSSPRT

SEQ ID NO: 19311 - protein, 451 aa, Artificial Sequence; identical to SEQ ID NO: 16221
  Description of Artificial Sequence: Synthetic polypeptide
  XENP018401 1G6_H1_L1.54_IgG1_PVA_/S267K Heavy Chain

SEQ ID NO: 19312 - protein, 122 aa, Artificial Sequence; identical to SEQ ID NO: 10922
  Description of Artificial Sequence: Synthetic polypeptide
  VH of XENP018401

SEQ ID NO: 19313 - protein, 5 aa, Artificial Sequence
  Description of Artificial Sequence: Synthetic peptide
  XENP018401 vhCDR1
NYWMN

SEQ ID NO: 19314 - protein, 19 aa, Artificial Sequence
  Description of Artificial Sequence: Synthetic peptide
  XENP018401 vhCDR2
EIRLKSNNYATHYAEPVKG

SEQ ID NO: 19315 - protein, 11 aa, Artificial Sequence
  Description of Artificial Sequence: Synthetic peptide
  XENP018401 vhCDR3
YYGNYGGYFDV

SEQ ID NO: 19316 - protein, 214 aa, Artificial Sequence
  Description of Artificial Sequence: Synthetic polypeptide
  XENP018401 1G6_H1_L1.54_IgG1_PVA_/S267K Light Chain
SIVMTQSPATLSVSPGERATLSCRASQSVSNDVAWYQQKPGQSPRLLIYYASHRYTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 19317 - protein, 107 aa, Artificial Sequence; identical to SEQ ID NO: 13656
  Description of Artificial Sequence: Synthetic polypeptide
  VL of XENP018401

SEQ ID NO: 19318 - protein, 11 aa, Artificial Sequence
  Description of Artificial Sequence: Synthetic peptide
  XENP018401 vlCDR1
RASQSVSNDVA

SEQ ID NO: 19319 - protein, 7 aa, Artificial Sequence
  Description of Artificial Sequence: Synthetic peptide
  XENP018401 vlCDR2
YASHRYT

SEQ ID NO: 19320 - protein, 9 aa, Artificial Sequence
  Description of Artificial Sequence: Synthetic peptide
  XENP018401 vlCDR3
QQDYSSPRT

SEQ ID NO: 19321 - protein, 451 aa, Artificial Sequence; identical to SEQ ID NO: 16221
  Description of Artificial Sequence: Synthetic polypeptide
  XENP018402 1G6_H1_L1.55_IgG1_PVA_/S267K Heavy Chain

SEQ ID NO: 19322 - protein, 122 aa, Artificial Sequence; identical to SEQ ID NO: 10922
  Description of Artificial Sequence: Synthetic polypeptide
  VH of XENP018402

SEQ ID NO: 19323 - protein, 5 aa, Artificial Sequence
  Description of Artificial Sequence: Synthetic peptide
  XENP018402 vhCDR1
NYWMN

SEQ ID NO: 19324 - protein, 19 aa, Artificial Sequence
  Description of Artificial Sequence: Synthetic peptide
  XENP018402 vhCDR2
EIRLKSNNYATHYAEPVKG

SEQ ID NO: 19325 - protein, 11 aa, Artificial Sequence
  Description of Artificial Sequence: Synthetic peptide
  XENP018402 vhCDR3
YYGNYGGYFDV

SEQ ID NO: 19326 - protein, 214 aa, Artificial Sequence
  Description of Artificial Sequence: Synthetic polypeptide
  XENP018402 1G6_H1_L1.55_IgG1_PVA_/S267K Light Chain
SIVMTQSPATLSVSPGERATLSCRASQSVSNDVAWYQQKPGQSPRLLINFASHRYTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 19327 - protein, 107 aa, Artificial Sequence; identical to SEQ ID NO: 13665
  Description of Artificial Sequence: Synthetic polypeptide
  VL of XENP018402

SEQ ID NO: 19328 - protein, 11 aa, Artificial Sequence
  Description of Artificial Sequence: Synthetic peptide
  XENP018402 vlCDR1
RASQSVSNDVA

SEQ ID NO: 19329 - protein, 7 aa, Artificial Sequence
  Description of Artificial Sequence: Synthetic peptide
  XENP018402 vlCDR2
FASHRYT

SEQ ID NO: 19330 - protein, 9 aa, Artificial Sequence
  Description of Artificial Sequence: Synthetic peptide
  XENP018402 vlCDR3
QQDYSSPRT

SEQ ID NO: 19331 - protein, 451 aa, Artificial Sequence; identical to SEQ ID NO: 16221
  Description of Artificial Sequence: Synthetic polypeptide
  XENP018403 1G6_H1_L1.56_IgG1_PVA_/S267K Heavy Chain

SEQ ID NO: 19332 - protein, 122 aa, Artificial Sequence; identical to SEQ ID NO: 10922
  Description of Artificial Sequence: Synthetic polypeptide
  VH of XENP018403

SEQ ID NO: 19333 - protein, 5 aa, Artificial Sequence
  Description of Artificial Sequence: Synthetic peptide
  XENP018403 vhCDR1
NYWMN

SEQ ID NO: 19334 - protein, 19 aa, Artificial Sequence
  Description of Artificial Sequence: Synthetic peptide
  XENP018403 vhCDR2
EIRLKSNNYATHYAEPVKG

SEQ ID NO: 19335 - protein, 11 aa, Artificial Sequence
  Description of Artificial Sequence: Synthetic peptide
  XENP018403 vhCDR3
YYGNYGGYFDV

SEQ ID NO: 19336 - protein, 214 aa, Artificial Sequence
  Description of Artificial Sequence: Synthetic polypeptide
  XENP018403 1G6_H1_L1.56_IgG1_PVA_/S267K Light Chain
SIVMTQSPATLSVSPGERATLSCRASQSVSNDVAWYQQKPGQSPRLLINHASHRYTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 19337 - protein, 107 aa, Artificial Sequence; identical to SEQ ID NO: 13674
  Description of Artificial Sequence: Synthetic polypeptide
  VL of XENP018403

SEQ ID NO: 19338 - protein, 11 aa, Artificial Sequence
  Description of Artificial Sequence: Synthetic peptide
  XENP018403 vlCDR1
RASQSVSNDVA

SEQ ID NO: 19339 - protein, 7 aa, Artificial Sequence
  Description of Artificial Sequence: Synthetic peptide
  XENP018403 vlCDR2
HASHRYT

SEQ ID NO: 19340 - protein, 9 aa, Artificial Sequence
  Description of Artificial Sequence: Synthetic peptide
  XENP018403 vlCDR3
QQDYSSPRT

SEQ ID NO: 19341 - protein, 451 aa, Artificial Sequence; identical to SEQ ID NO: 16221
  Description of Artificial Sequence: Synthetic polypeptide
  XENP018404 1G6_H1_L1.57_IgG1_PVA_/S267K Heavy Chain

SEQ ID NO: 19342 - protein, 122 aa, Artificial Sequence; identical to SEQ ID NO: 10922
  Description of Artificial Sequence: Synthetic polypeptide
  VH of XENP018404

SEQ ID NO: 19343 - protein, 5 aa, Artificial Sequence
  Description of Artificial Sequence: Synthetic peptide
  XENP018404 vhCDR1
NYWMN

SEQ ID NO: 19344 - protein, 19 aa, Artificial Sequence
  Description of Artificial Sequence: Synthetic peptide
  XENP018404 vhCDR2
EIRLKSNNYATHYAEPVKG

SEQ ID NO: 19345 - protein, 11 aa, Artificial Sequence
  Description of Artificial Sequence: Synthetic peptide
  XENP018404 vhCDR3
YYGNYGGYFDV

SEQ ID NO: 19346 - protein, 214 aa, Artificial Sequence
  Description of Artificial Sequence: Synthetic polypeptide
  XENP018404 1G6_H1_L1.57_IgG1_PVA_/S267K Light Chain
SIVMTQSPATLSVSPGERATLSCRASQSVSNDVAWYQQKPGQSPRLLINLASHRYTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 19347 - protein, 107 aa, Artificial Sequence; identical to SEQ ID NO: 13683
  Description of Artificial Sequence: Synthetic polypeptide
  VL of XENP018404

SEQ ID NO: 19348 - protein, 11 aa, Artificial Sequence
  Description of Artificial Sequence: Synthetic peptide
  XENP018404 vlCDR1
RASQSVSNDVA

SEQ ID NO: 19349 - protein, 7 aa, Artificial Sequence
  Description of Artificial Sequence: Synthetic peptide
  XENP018404 vlCDR2
LASHRYT

SEQ ID NO: 19350 - protein, 9 aa, Artificial Sequence
  Description of Artificial Sequence: Synthetic peptide
  XENP018404 vlCDR3
QQDYSSPRT

SEQ ID NO: 19351 - protein, 451 aa, Artificial Sequence; identical to SEQ ID NO: 16221
  Description of Artificial Sequence: Synthetic polypeptide
  XENP018405 1G6_H1_L1.58_IgG1_PVA_/S267K Heavy Chain

SEQ ID NO: 19352 - protein, 122 aa, Artificial Sequence; identical to SEQ ID NO: 10922
  Description of Artificial Sequence: Synthetic polypeptide
  VH of XENP018405

SEQ ID NO: 19353 - protein, 5 aa, Artificial Sequence
  Description of Artificial Sequence: Synthetic peptide
  XENP018405 vhCDR1
NYWMN

SEQ ID NO: 19354 - protein, 19 aa, Artificial Sequence
  Description of Artificial Sequence: Synthetic peptide
  XENP018405 vhCDR2
EIRLKSNNYATHYAEPVKG

SEQ ID NO: 19355 - protein, 11 aa, Artificial Sequence
  Description of Artificial Sequence: Synthetic peptide
  XENP018405 vhCDR3
YYGNYGGYFDV

SEQ ID NO: 19356 - protein, 214 aa, Artificial Sequence
  Description of Artificial Sequence: Synthetic polypeptide
  XENP018405 1G6_H1_L1.58_IgG1_PVA_/S267K Light Chain
SIVMTQSPATLSVSPGERATLSCRASQSVSNDVAWYQQKPGQSPRLLINWASHRYTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 19357 - protein, 107 aa, Artificial Sequence; identical to SEQ ID NO: 13692
  Description of Artificial Sequence: Synthetic polypeptide
  VL of XENP018405

SEQ ID NO: 19358 - protein, 11 aa, Artificial Sequence
  Description of Artificial Sequence: Synthetic peptide
  XENP018405 vlCDR1
RASQSVSNDVA

SEQ ID NO: 19359 - protein, 7 aa, Artificial Sequence
  Description of Artificial Sequence: Synthetic peptide
  XENP018405 vlCDR2
WASHRYT

SEQ ID NO: 19360 - protein, 9 aa, Artificial Sequence
  Description of Artificial Sequence: Synthetic peptide
  XENP018405 vlCDR3
QQDYSSPRT

SEQ ID NO: 19361 - protein, 451 aa, Artificial Sequence; identical to SEQ ID NO: 16221
  Description of Artificial Sequence: Synthetic polypeptide
  XENP018406 1G6_H1_L1.59_IgG1_PVA_/S267K Heavy Chain

SEQ ID NO: 19362 - protein, 122 aa, Artificial Sequence; identical to SEQ ID NO: 10922
  Description of Artificial Sequence: Synthetic polypeptide
  VH of XENP018406

SEQ ID NO: 19363 - protein, 5 aa, Artificial Sequence
  Description of Artificial Sequence: Synthetic peptide
  XENP018406 vhCDR1
NYWMN

SEQ ID NO: 19364 - protein, 19 aa, Artificial Sequence
  Description of Artificial Sequence: Synthetic peptide
  XENP018406 vhCDR2
EIRLKSNNYATHYAEPVKG

SEQ ID NO: 19365 - protein, 11 aa, Artificial Sequence
  Description of Artificial Sequence: Synthetic peptide
  XENP018406 vhCDR3
YYGNYGGYFDV

SEQ ID NO: 19366 - protein, 214 aa, Artificial Sequence
  Description of Artificial Sequence: Synthetic polypeptide
  XENP018406 1G6_H1_L1.59_IgG1_PVA_/S267K Light Chain
SIVMTQSPATLSVSPGERATLSCRASQSVSNDVAWYQQKPGQSPRLLINVASHRYTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 19367 - protein, 107 aa, Artificial Sequence; identical to SEQ ID NO: 13701
  Description of Artificial Sequence: Synthetic polypeptide
  VL of XENP018406

SEQ ID NO: 19368 - protein, 11 aa, Artificial Sequence
  Description of Artificial Sequence: Synthetic peptide
  XENP018406 vlCDR1
RASQSVSNDVA

SEQ ID NO: 19369 - protein, 7 aa, Artificial Sequence
  Description of Artificial Sequence: Synthetic peptide
  XENP018406 vlCDR2
VASHRYT

SEQ ID NO: 19370 - protein, 9 aa, Artificial Sequence
  Description of Artificial Sequence: Synthetic peptide
  XENP018406 vlCDR3
QQDYSSPRT

SEQ ID NO: 19371 - protein, 451 aa, Artificial Sequence; identical to SEQ ID NO: 16221
  Description of Artificial Sequence: Synthetic polypeptide
  XENP018407 1G6_H1_L1.60_IgG1_PVA_/S267K Heavy Chain

SEQ ID NO: 19372 - protein, 122 aa, Artificial Sequence; identical to SEQ ID NO: 10922
  Description of Artificial Sequence: Synthetic polypeptide
  VH of XENP018407

SEQ ID NO: 19373 - protein, 5 aa, Artificial Sequence
  Description of Artificial Sequence: Synthetic peptide
  XENP018407 vhCDR1
NYWMN

SEQ ID NO: 19374 - protein, 19 aa, Artificial Sequence
  Description of Artificial Sequence: Synthetic peptide
  XENP018407 vhCDR2
EIRLKSNNYATHYAEPVKG

SEQ ID NO: 19375 - protein, 11 aa, Artificial Sequence
  Description of Artificial Sequence: Synthetic peptide
  XENP018407 vhCDR3
YYGNYGGYFDV

SEQ ID NO: 19376 - protein, 214 aa, Artificial Sequence
  Description of Artificial Sequence: Synthetic polypeptide
  XENP018407 1G6_H1_L1.60_IgG1_PVA_/S267K Light Chain
SIVMTQSPATLSVSPGERATLSCRASQSVSNDVAWYQQKPGQSPRLLINAASHRYTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 19377 - protein, 107 aa, Artificial Sequence; identical to SEQ ID NO: 13710
  Description of Artificial Sequence: Synthetic polypeptide
  VL of XENP018407

SEQ ID NO: 19378 - protein, 11 aa, Artificial Sequence
  Description of Artificial Sequence: Synthetic peptide
  XENP018407 vlCDR1
RASQSVSNDVA

SEQ ID NO: 19379 - protein, 7 aa, Artificial Sequence
  Description of Artificial Sequence: Synthetic peptide
  XENP018407 vlCDR2
AASHRYT

SEQ ID NO: 19380 - protein, 9 aa, Artificial Sequence
  Description of Artificial Sequence: Synthetic peptide
  XENP018407 vlCDR3
QQDYSSPRT

SEQ ID NO: 19381 - protein, 451 aa, Artificial Sequence; identical to SEQ ID NO: 16221
  Description of Artificial Sequence: Synthetic polypeptide
  XENP018408 1G6_H1_L1.61_IgG1_PVA_/S267K Heavy Chain

SEQ ID NO: 19382 - protein, 122 aa, Artificial Sequence; identical to SEQ ID NO: 10922
  Description of Artificial Sequence: Synthetic polypeptide
  VH of XENP018408

SEQ ID NO: 19383 - protein, 5 aa, Artificial Sequence
  Description of Artificial Sequence: Synthetic peptide
  XENP018408 vhCDR1
NYWMN

SEQ ID NO: 19384 - protein, 19 aa, Artificial Sequence
  Description of Artificial Sequence: Synthetic peptide
  XENP018408 vhCDR2
EIRLKSNNYATHYAEPVKG

SEQ ID NO: 19385 - protein, 11 aa, Artificial Sequence
  Description of Artificial Sequence: Synthetic peptide
  XENP018408 vhCDR3
YYGNYGGYFDV

SEQ ID NO: 19386 - protein, 214 aa, Artificial Sequence
  Description of Artificial Sequence: Synthetic polypeptide
  XENP018408 1G6_H1_L1.61_IgG1_PVA_/S267K Light Chain
SIVMTQSPATLSVSPGERATLSCRASQSVSNDVAWYQQKPGQSPRLLINQASHRYTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 19387 - protein, 107 aa, Artificial Sequence; identical to SEQ ID NO: 13719
  Description of Artificial Sequence: Synthetic polypeptide
  VL of XENP018408

SEQ ID NO: 19388 - protein, 11 aa, Artificial Sequence
  Description of Artificial Sequence: Synthetic peptide
  XENP018408 vlCDR1
RASQSVSNDVA

SEQ ID NO: 19389 - protein, 7 aa, Artificial Sequence
  Description of Artificial Sequence: Synthetic peptide
  XENP018408 vlCDR2
QASHRYT

SEQ ID NO: 19390 - protein, 9 aa, Artificial Sequence
  Description of Artificial Sequence: Synthetic peptide
  XENP018408 vlCDR3
QQDYSSPRT

SEQ ID NO: 19391 - protein, 451 aa, Artificial Sequence; identical to SEQ ID NO: 16221
  Description of Artificial Sequence: Synthetic polypeptide
  XENP018409 1G6_H1_L1.62_IgG1_PVA_/S267K Heavy Chain

SEQ ID NO: 19392 - protein, 122 aa, Artificial Sequence; identical to SEQ ID NO: 10922
  Description of Artificial Sequence: Synthetic polypeptide
  VH of XENP018409

SEQ ID NO: 19393 - protein, 5 aa, Artificial Sequence
  Description of Artificial Sequence: Synthetic peptide
  XENP018409 vhCDR1
NYWMN

SEQ ID NO: 19394 - protein, 19 aa, Artificial Sequence
  Description of Artificial Sequence: Synthetic peptide
  XENP018409 vhCDR2
EIRLKSNNYATHYAEPVKG

SEQ ID NO: 19395 - protein, 11 aa, Artificial Sequence
  Description of Artificial Sequence: Synthetic peptide
  XENP018409 vhCDR3
YYGNYGGYFDV

SEQ ID NO: 19396 - protein, 214 aa, Artificial Sequence
  Description of Artificial Sequence: Synthetic polypeptide
  XENP018409 1G6_H1_L1.62_IgG1_PVA_/S267K Light Chain
SIVMTQSPATLSVSPGERATLSCRASQSVSNDVAWYQQKPGQSPRLLINDASHRYTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 19397 - protein, 107 aa, Artificial Sequence; identical to SEQ ID NO: 13728
  Description of Artificial Sequence: Synthetic polypeptide
  VL of XENP018409

SEQ ID NO: 19398 - protein, 11 aa, Artificial Sequence
  Description of Artificial Sequence: Synthetic peptide
  XENP018409 vlCDR1
RASQSVSNDVA

SEQ ID NO: 19399 - protein, 7 aa, Artificial Sequence
  Description of Artificial Sequence: Synthetic peptide
  XENP018409 vlCDR2
DASHRYT

SEQ ID NO: 19400 - protein, 9 aa, Artificial Sequence
  Description of Artificial Sequence: Synthetic peptide
  XENP018409 vlCDR3
QQDYSSPRT

SEQ ID NO: 19401 - protein, 451 aa, Artificial Sequence; identical to SEQ ID NO: 16221
  Description of Artificial Sequence: Synthetic polypeptide
  XENP018410 1G6_H1_L1.63_IgG1_PVA_/S267K Heavy Chain

SEQ ID NO: 19402 - protein, 122 aa, Artificial Sequence; identical to SEQ ID NO: 10922
  Description of Artificial Sequence: Synthetic polypeptide
  VH of XENP018410

SEQ ID NO: 19403 - protein, 5 aa, Artificial Sequence
  Description of Artificial Sequence: Synthetic peptide
  XENP018410 vhCDR1
NYWMN

SEQ ID NO: 19404 - protein, 19 aa, Artificial Sequence
  Description of Artificial Sequence: Synthetic peptide
  XENP018410 vhCDR2
EIRLKSNNYATHYAEPVKG

SEQ ID NO: 19405 - protein, 11 aa, Artificial Sequence
  Description of Artificial Sequence: Synthetic peptide
  XENP018410 vhCDR3
YYGNYGGYFDV

SEQ ID NO: 19406 - protein, 214 aa, Artificial Sequence
  Description of Artificial Sequence: Synthetic polypeptide
  XENP018410 1G6_H1_L1.63_IgG1_PVA_/S267K Light Chain
SIVMTQSPATLSVSPGERATLSCRASQSVSNDVAWYQQKPGQSPRLLINKASHRYTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 19407 - protein, 107 aa, Artificial Sequence; identical to SEQ ID NO: 13737
  Description of Artificial Sequence: Synthetic polypeptide
  VL of XENP018410

SEQ ID NO: 19408 - protein, 11 aa, Artificial Sequence
  Description of Artificial Sequence: Synthetic peptide
  XENP018410 vlCDR1
RASQSVSNDVA

SEQ ID NO: 19409 - protein, 7 aa, Artificial Sequence
  Description of Artificial Sequence: Synthetic peptide
  XENP018410 vlCDR2
KASHRYT

SEQ ID NO: 19410 - protein, 9 aa, Artificial Sequence
  Description of Artificial Sequence: Synthetic peptide
  XENP018410 vlCDR3
QQDYSSPRT

SEQ ID NO: 19411 - protein, 451 aa, Artificial Sequence; identical to SEQ ID NO: 16221
  Description of Artificial Sequence: Synthetic polypeptide
  XENP018411 1G6_H1_L1.64_IgG1_PVA_/S267K Heavy Chain

SEQ ID NO: 19412 - protein, 122 aa, Artificial Sequence; identical to SEQ ID NO: 10922
  Description of Artificial Sequence: Synthetic polypeptide
  VH of XENP018411

SEQ ID NO: 19413 - protein, 5 aa, Artificial Sequence
  Description of Artificial Sequence: Synthetic peptide
  XENP018411 vhCDR1
NYWMN

SEQ ID NO: 19414 - protein, 19 aa, Artificial Sequence
  Description of Artificial Sequence: Synthetic peptide
  XENP018411 vhCDR2
EIRLKSNNYATHYAEPVKG

SEQ ID NO: 19415 - protein, 11 aa, Artificial Sequence
  Description of Artificial Sequence: Synthetic peptide
  XENP018411 vhCDR3
YYGNYGGYFDV

SEQ ID NO: 19416 - protein, 214 aa, Artificial Sequence
  Description of Artificial Sequence: Synthetic polypeptide
  XENP018411 1G6_H1_L1.64_IgG1_PVA_/S267K Light Chain
SIVMTQSPATLSVSPGERATLSCRASQSVSNDVAWYQQKPGQSPRLLINYASYRYTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 19417 - protein, 107 aa, Artificial Sequence; identical to SEQ ID NO: 13746
  Description of Artificial Sequence: Synthetic polypeptide
  VL of XENP018411

SEQ ID NO: 19418 - protein, 11 aa, Artificial Sequence
  Description of Artificial Sequence: Synthetic peptide
  XENP018411 vlCDR1
RASQSVSNDVA

SEQ ID NO: 19419 - protein, 7 aa, Artificial Sequence
  Description of Artificial Sequence: Synthetic peptide
  XENP018411 vlCDR2
YASYRYT

SEQ ID NO: 19420 - protein, 9 aa, Artificial Sequence
  Description of Artificial Sequence: Synthetic peptide
  XENP018411 vlCDR3
QQDYSSPRT

SEQ ID NO: 19421 - protein, 451 aa, Artificial Sequence; identical to SEQ ID NO: 16221
  Description of Artificial Sequence: Synthetic polypeptide
  XENP018412 1G6_H1_L1.65_IgG1_PVA_/S267K Heavy Chain

SEQ ID NO: 19422 - protein, 122 aa, Artificial Sequence; identical to SEQ ID NO: 10922
  Description of Artificial Sequence: Synthetic polypeptide
  VH of XENP018412

SEQ ID NO: 19423 - protein, 5 aa, Artificial Sequence
  Description of Artificial Sequence: Synthetic peptide
  XENP018412 vhCDR1
NYWMN

SEQ ID NO: 19424 - protein, 19 aa, Artificial Sequence
  Description of Artificial Sequence: Synthetic peptide
  XENP018412 vhCDR2
EIRLKSNNYATHYAEPVKG

SEQ ID NO: 19425 - protein, 11 aa, Artificial Sequence
  Description of Artificial Sequence: Synthetic peptide
  XENP018412 vhCDR3
YYGNYGGYFDV

SEQ ID NO: 19426 - protein, 214 aa, Artificial Sequence
  Description of Artificial Sequence: Synthetic polypeptide
  XENP018412 1G6_H1_L1.65_IgG1_PVA_/S267K Light Chain
SIVMTQSPATLSVSPGERATLSCRASQSVSNDVAWYQQKPGQSPRLLINYASQRYTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 19427 - protein, 107 aa, Artificial Sequence; identical to SEQ ID NO: 13755
  Description of Artificial Sequence: Synthetic polypeptide
  VL of XENP018412

SEQ ID NO: 19428 - protein, 11 aa, Artificial Sequence
  Description of Artificial Sequence: Synthetic peptide
  XENP018412 vlCDR1
RASQSVSNDVA

SEQ ID NO: 19429 - protein, 7 aa, Artificial Sequence
  Description of Artificial Sequence: Synthetic peptide
  XENP018412 vlCDR2
YASQRYT

SEQ ID NO: 19430 - protein, 9 aa, Artificial Sequence
  Description of Artificial Sequence: Synthetic peptide
  XENP018412 vlCDR3
QQDYSSPRT

SEQ ID NO: 19431 - protein, 451 aa, Artificial Sequence; identical to SEQ ID NO: 16221
  Description of Artificial Sequence: Synthetic polypeptide
  XENP018413 1G6_H1_L1.66_IgG1_PVA_/S267K Heavy Chain

SEQ ID NO: 19432 - protein, 122 aa, Artificial Sequence; identical to SEQ ID NO: 10922
  Description of Artificial Sequence: Synthetic polypeptide
  VH of XENP018413

SEQ ID NO: 19433 - protein, 5 aa, Artificial Sequence
  Description of Artificial Sequence: Synthetic peptide
  XENP018413 vhCDR1
NYWMN

SEQ ID NO: 19434 - protein, 19 aa, Artificial Sequence
  Description of Artificial Sequence: Synthetic peptide
  XENP018413 vhCDR2
EIRLKSNNYATHYAEPVKG

SEQ ID NO: 19435 - protein, 11 aa, Artificial Sequence
  Description of Artificial Sequence: Synthetic peptide
  XENP018413 vhCDR3
YYGNYGGYFDV

SEQ ID NO: 19436 - protein, 214 aa, Artificial Sequence
  Description of Artificial Sequence: Synthetic polypeptide
  XENP018413 1G6_H1_L1.66_IgG1_PVA_/S267K Light Chain
SIVMTQSPATLSVSPGERATLSCRASQSVSNDVAWYQQKPGQSPRLLINYASDRYTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 19437 - protein, 107 aa, Artificial Sequence; identical to SEQ ID NO: 13764
  Description of Artificial Sequence: Synthetic polypeptide
  VL of XENP018413

SEQ ID NO: 19438 - protein, 11 aa, Artificial Sequence
  Description of Artificial Sequence: Synthetic peptide
  XENP018413 vlCDR1
RASQSVSNDVA

SEQ ID NO: 19439 - protein, 7 aa, Artificial Sequence
  Description of Artificial Sequence: Synthetic peptide
  XENP018413 vlCDR2
YASDRYT

SEQ ID NO: 19440 - protein, 9 aa, Artificial Sequence
  Description of Artificial Sequence: Synthetic peptide
  XENP018413 vlCDR3
QQDYSSPRT

SEQ ID NO: 19441 - protein, 451 aa, Artificial Sequence; identical to SEQ ID NO: 16221
  Description of Artificial Sequence: Synthetic polypeptide
  XENP018414 1G6_H1_L1.67_IgG1_PVA_/S267K Heavy Chain

SEQ ID NO: 19442 - protein, 122 aa, Artificial Sequence; identical to SEQ ID NO: 10922
  Description of Artificial Sequence: Synthetic polypeptide
  VH of XENP018414

SEQ ID NO: 19443 - protein, 5 aa, Artificial Sequence
  Description of Artificial Sequence: Synthetic peptide
  XENP018414 vhCDR1
NYWMN

SEQ ID NO: 19444 - protein, 19 aa, Artificial Sequence
  Description of Artificial Sequence: Synthetic peptide
  XENP018414 vhCDR2
EIRLKSNNYATHYAEPVKG

SEQ ID NO: 19445 - protein, 11 aa, Artificial Sequence
  Description of Artificial Sequence: Synthetic peptide
  XENP018414 vhCDR3
YYGNYGGYFDV

SEQ ID NO: 19446 - protein, 214 aa, Artificial Sequence
  Description of Artificial Sequence: Synthetic polypeptide
  XENP018414 1G6_H1_L1.67_IgG1_PVA_/S267K Light Chain
SIVMTQSPATLSVSPGERATLSCRASQSVSNDVAWYQQKPGQSPRLLINYASWRYTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 19447 - protein, 107 aa, Artificial Sequence; identical to SEQ ID NO: 13773
  Description of Artificial Sequence: Synthetic polypeptide
  VL of XENP018414

SEQ ID NO: 19448 - protein, 11 aa, Artificial Sequence
  Description of Artificial Sequence: Synthetic peptide
  XENP018414 vlCDR1
RASQSVSNDVA

SEQ ID NO: 19449 - protein, 7 aa, Artificial Sequence
  Description of Artificial Sequence: Synthetic peptide
  XENP018414 vlCDR2
YASWRYT

SEQ ID NO: 19450 - protein, 9 aa, Artificial Sequence
  Description of Artificial Sequence: Synthetic peptide
  XENP018414 vlCDR3
QQDYSSPRT

SEQ ID NO: 19451 - protein, 451 aa, Artificial Sequence; identical to SEQ ID NO: 16221
  Description of Artificial Sequence: Synthetic polypeptide
  XENP018415 1G6_H1_L1.68_IgG1_PVA_/S267K Heavy Chain

SEQ ID NO: 19452 - protein, 122 aa, Artificial Sequence; identical to SEQ ID NO: 10922
  Description of Artificial Sequence: Synthetic polypeptide
  VH of XENP018415

SEQ ID NO: 19453 - protein, 5 aa, Artificial Sequence
  Description of Artificial Sequence: Synthetic peptide
  XENP018415 vhCDR1
NYWMN

SEQ ID NO: 19454 - protein, 19 aa, Artificial Sequence
  Description of Artificial Sequence: Synthetic peptide
  XENP018415 vhCDR2
EIRLKSNNYATHYAEPVKG

SEQ ID NO: 19455 - protein, 11 aa, Artificial Sequence
  Description of Artificial Sequence: Synthetic peptide
  XENP018415 vhCDR3
YYGNYGGYFDV

SEQ ID NO: 19456 - protein, 214 aa, Artificial Sequence
  Description of Artificial Sequence: Synthetic polypeptide
  XENP018415 1G6_H1_L1.68_IgG1_PVA_/S267K Light Chain
SIVMTQSPATLSVSPGERATLSCRASQSVSNDVAWYQQKPGQSPRLLINYASARYTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 19457 - protein, 107 aa, Artificial Sequence; identical to SEQ ID NO: 13782
  Description of Artificial Sequence: Synthetic polypeptide
  VL of XENP018415

SEQ ID NO: 19458 - protein, 11 aa, Artificial Sequence
  Description of Artificial Sequence: Synthetic peptide
  XENP018415 vlCDR1
RASQSVSNDVA

SEQ ID NO: 19459 - protein, 7 aa, Artificial Sequence
  Description of Artificial Sequence: Synthetic peptide
  XENP018415 vlCDR2
YASARYT

SEQ ID NO: 19460 - protein, 9 aa, Artificial Sequence
  Description of Artificial Sequence: Synthetic peptide
  XENP018415 vlCDR3
QQDYSSPRT

SEQ ID NO: 19461 - protein, 451 aa, Artificial Sequence; identical to SEQ ID NO: 16221
  Description of Artificial Sequence: Synthetic polypeptide
  XENP018416 1G6_H1_L1.69_IgG1_PVA_/S267K Heavy Chain

SEQ ID NO: 19462 - protein, 122 aa, Artificial Sequence; identical to SEQ ID NO: 10922
  Description of Artificial Sequence: Synthetic polypeptide
  VH of XENP018416

SEQ ID NO: 19463 - protein, 5 aa, Artificial Sequence
  Description of Artificial Sequence: Synthetic peptide
  XENP018416 vhCDR1
NYWMN

SEQ ID NO: 19464 - protein, 19 aa, Artificial Sequence
  Description of Artificial Sequence: Synthetic peptide
  XENP018416 vhCDR2
EIRLKSNNYATHYAEPVKG

SEQ ID NO: 19465 - protein, 11 aa, Artificial Sequence
  Description of Artificial Sequence: Synthetic peptide
  XENP018416 vhCDR3
YYGNYGGYFDV

SEQ ID NO: 19466 - protein, 214 aa, Artificial Sequence
  Description of Artificial Sequence: Synthetic polypeptide
  XENP018416 1G6_H1_L1.69_IgG1_PVA_/S267K Light Chain
SIVMTQSPATLSVSPGERATLSCRASQSVSNDVAWYQQKPGQSPRLLINYASTRYTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 19467 - protein, 107 aa, Artificial Sequence; identical to SEQ ID NO: 13791
  Description of Artificial Sequence: Synthetic polypeptide
  VL of XENP018416

SEQ ID NO: 19468 - protein, 11 aa, Artificial Sequence
  Description of Artificial Sequence: Synthetic peptide
  XENP018416 vlCDR1
RASQSVSNDVA

SEQ ID NO: 19469 - protein, 7 aa, Artificial Sequence
  Description of Artificial Sequence: Synthetic peptide
  XENP018416 vlCDR2
YASTRYT

SEQ ID NO: 19470 - protein, 9 aa, Artificial Sequence
  Description of Artificial Sequence: Synthetic peptide
  XENP018416 vlCDR3
QQDYSSPRT

SEQ ID NO: 19471 - protein, 451 aa, Artificial Sequence; identical to SEQ ID NO: 16221
  Description of Artificial Sequence: Synthetic polypeptide
  XENP018417 1G6_H1_L1.70_IgG1_PVA_/S267K Heavy Chain

SEQ ID NO: 19472 - protein, 122 aa, Artificial Sequence; identical to SEQ ID NO: 10922
  Description of Artificial Sequence: Synthetic polypeptide
  VH of XENP018417

SEQ ID NO: 19473 - protein, 5 aa, Artificial Sequence
  Description of Artificial Sequence: Synthetic peptide
  XENP018417 vhCDR1
NYWMN

SEQ ID NO: 19474 - protein, 19 aa, Artificial Sequence
  Description of Artificial Sequence: Synthetic peptide
  XENP018417 vhCDR2
EIRLKSNNYATHYAEPVKG

SEQ ID NO: 19475 - protein, 11 aa, Artificial Sequence
  Description of Artificial Sequence: Synthetic peptide
  XENP018417 vhCDR3
YYGNYGGYFDV

SEQ ID NO: 19476 - protein, 214 aa, Artificial Sequence
  Description of Artificial Sequence: Synthetic polypeptide
  XENP018417 1G6_H1_L1.70_IgG1_PVA_/S267K Light Chain
SIVMTQSPATLSVSPGERATLSCRASQSVSNDVAWYQQKPGQSPRLLINYASKRYTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 19477 - protein, 107 aa, Artificial Sequence; identical to SEQ ID NO: 13800
  Description of Artificial Sequence: Synthetic polypeptide
  VL of XENP018417

SEQ ID NO: 19478 - protein, 11 aa, Artificial Sequence
  Description of Artificial Sequence: Synthetic peptide
  XENP018417 vlCDR1
RASQSVSNDVA

SEQ ID NO: 19479 - protein, 7 aa, Artificial Sequence
  Description of Artificial Sequence: Synthetic peptide
  XENP018417 vlCDR2
YASKRYT

SEQ ID NO: 19480 - protein, 9 aa, Artificial Sequence
  Description of Artificial Sequence: Synthetic peptide
  XENP018417 vlCDR3
QQDYSSPRT

SEQ ID NO: 19481 - protein, 451 aa, Artificial Sequence; identical to SEQ ID NO: 16221
  Description of Artificial Sequence: Synthetic polypeptide
  XENP018418 1G6_H1_L1.71_IgG1_PVA_/S267K Heavy Chain

SEQ ID NO: 19482 - protein, 122 aa, Artificial Sequence; identical to SEQ ID NO: 10922
  Description of Artificial Sequence: Synthetic polypeptide
  VH of XENP018418

SEQ ID NO: 19483 - protein, 5 aa, Artificial Sequence
  Description of Artificial Sequence: Synthetic peptide
  XENP018418 vhCDR1
NYWMN

SEQ ID NO: 19484 - protein, 19 aa, Artificial Sequence
  Description of Artificial Sequence: Synthetic peptide
  XENP018418 vhCDR2
EIRLKSNNYATHYAEPVKG

SEQ ID NO: 19485 - protein, 11 aa, Artificial Sequence
  Description of Artificial Sequence: Synthetic peptide
  XENP018418 vhCDR3
YYGNYGGYFDV

SEQ ID NO: 19486 - protein, 214 aa, Artificial Sequence
  Description of Artificial Sequence: Synthetic polypeptide
  XENP018418 1G6_H1_L1.71_IgG1_PVA_/S267K Light Chain
SIVMTQSPATLSVSPGERATLSCRASQSVSNDVAWYQQKPGQSPRLLINYASGRYTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 19487 - protein, 107 aa, Artificial Sequence; identical to SEQ ID NO: 13809
  Description of Artificial Sequence: Synthetic polypeptide
  VL of XENP018418

SEQ ID NO: 19488 - protein, 11 aa, Artificial Sequence
  Description of Artificial Sequence: Synthetic peptide
  XENP018418 vlCDR1
RASQSVSNDVA

SEQ ID NO: 19489 - protein, 7 aa, Artificial Sequence
  Description of Artificial Sequence: Synthetic peptide
  XENP018418 vlCDR2
YASGRYT

SEQ ID NO: 19490 - protein, 9 aa, Artificial Sequence
  Description of Artificial Sequence: Synthetic peptide
  XENP018418 vlCDR3
QQDYSSPRT

SEQ ID NO: 19491 - protein, 451 aa, Artificial Sequence; identical to SEQ ID NO: 16221
  Description of Artificial Sequence: Synthetic polypeptide
  XENP018419 1G6_H1_L1.72_IgG1_PVA_/S267K Heavy Chain

SEQ ID NO: 19492 - protein, 122 aa, Artificial Sequence; identical to SEQ ID NO: 10922
  Description of Artificial Sequence: Synthetic polypeptide
  VH of XENP018419

SEQ ID NO: 19493 - protein, 5 aa, Artificial Sequence
  Description of Artificial Sequence: Synthetic peptide
  XENP018419 vhCDR1
NYWMN

SEQ ID NO: 19494 - protein, 19 aa, Artificial Sequence
  Description of Artificial Sequence: Synthetic peptide
  XENP018419 vhCDR2
EIRLKSNNYATHYAEPVKG

SEQ ID NO: 19495 - protein, 11 aa, Artificial Sequence
  Description of Artificial Sequence: Synthetic peptide
  XENP018419 vhCDR3
YYGNYGGYFDV

SEQ ID NO: 19496 - protein, 214 aa, Artificial Sequence
  Description of Artificial Sequence: Synthetic polypeptide
  XENP018419 1G6_H1_L1.72_IgG1_PVA_/S267K Light Chain
SIVMTQSPATLSVSPGERATLSCRASQSVSNDVAWYQQKPGQSPRLLINYASLRYTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 19497 - protein, 107 aa, Artificial Sequence; identical to SEQ ID NO: 13818
  Description of Artificial Sequence: Synthetic polypeptide
  VL of XENP018419

SEQ ID NO: 19498 - protein, 11 aa, Artificial Sequence
  Description of Artificial Sequence: Synthetic peptide
  XENP018419 vlCDR1
RASQSVSNDVA

SEQ ID NO: 19499 - protein, 7 aa, Artificial Sequence
  Description of Artificial Sequence: Synthetic peptide
  XENP018419 vlCDR2
YASLRYT

SEQ ID NO: 19500 - protein, 9 aa, Artificial Sequence
  Description of Artificial Sequence: Synthetic peptide
  XENP018419 vlCDR3
QQDYSSPRT

SEQ ID NO: 19501 - protein, 451 aa, Artificial Sequence; identical to SEQ ID NO: 16221
  Description of Artificial Sequence: Synthetic polypeptide
  XENP018420 1G6_H1_L1.73_IgG1_PVA_/S267K Heavy Chain

SEQ ID NO: 19502 - protein, 122 aa, Artificial Sequence; identical to SEQ ID NO: 10922
  Description of Artificial Sequence: Synthetic polypeptide
  VH of XENP018420

SEQ ID NO: 19503 - protein, 5 aa, Artificial Sequence
  Description of Artificial Sequence: Synthetic peptide
  XENP018420 vhCDR1
NYWMN

SEQ ID NO: 19504 - protein, 19 aa, Artificial Sequence
  Description of Artificial Sequence: Synthetic peptide
  XENP018420 vhCDR2
EIRLKSNNYATHYAEPVKG

SEQ ID NO: 19505 - protein, 11 aa, Artificial Sequence
  Description of Artificial Sequence: Synthetic peptide
  XENP018420 vhCDR3
YYGNYGGYFDV

SEQ ID NO: 19506 - protein, 214 aa, Artificial Sequence
  Description of Artificial Sequence: Synthetic polypeptide
  XENP018420 1G6_H1_L1.73_IgG1_PVA_/S267K Light Chain
SIVMTQSPATLSVSPGERATLSCRASQSVSNDVAWYQQKPGQSPRLLINYASHLYTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 19507 - protein, 107 aa, Artificial Sequence; identical to SEQ ID NO: 13827
  Description of Artificial Sequence: Synthetic polypeptide
  VL of XENP018420

SEQ ID NO: 19508 - protein, 11 aa, Artificial Sequence
  Description of Artificial Sequence: Synthetic peptide
  XENP018420 vlCDR1
RASQSVSNDVA

SEQ ID NO: 19509 - protein, 7 aa, Artificial Sequence
  Description of Artificial Sequence: Synthetic peptide
  XENP018420 vlCDR2
YASHLYT

SEQ ID NO: 19510 - protein, 9 aa, Artificial Sequence
  Description of Artificial Sequence: Synthetic peptide
  XENP018420 vlCDR3
QQDYSSPRT

SEQ ID NO: 19511 - protein, 451 aa, Artificial Sequence; identical to SEQ ID NO: 16221
  Description of Artificial Sequence: Synthetic polypeptide
  XENP018421 1G6_H1_L1.74_IgG1_PVA_/S267K Heavy Chain

SEQ ID NO: 19512 - protein, 122 aa, Artificial Sequence; identical to SEQ ID NO: 10922
  Description of Artificial Sequence: Synthetic polypeptide
  VH of XENP018421

SEQ ID NO: 19513 - protein, 5 aa, Artificial Sequence
  Description of Artificial Sequence: Synthetic peptide
  XENP018421 vhCDR1
NYWMN

SEQ ID NO: 19514 - protein, 19 aa, Artificial Sequence
  Description of Artificial Sequence: Synthetic peptide
  XENP018421 vhCDR2
EIRLKSNNYATHYAEPVKG

SEQ ID NO: 19515 - protein, 11 aa, Artificial Sequence
  Description of Artificial Sequence: Synthetic peptide
  XENP018421 vhCDR3
YYGNYGGYFDV

SEQ ID NO: 19516 - protein, 214 aa, Artificial Sequence
  Description of Artificial Sequence: Synthetic polypeptide
  XENP018421 1G6_H1_L1.74_IgG1_PVA_/S267K Light Chain
SIVMTQSPATLSVSPGERATLSCRASQSVSNDVAWYQQKPGQSPRLLINYASHWYTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 19517 - protein, 107 aa, Artificial Sequence; identical to SEQ ID NO: 13836
  Description of Artificial Sequence: Synthetic polypeptide
  VL of XENP018421

SEQ ID NO: 19518 - protein, 11 aa, Artificial Sequence
  Description of Artificial Sequence: Synthetic peptide
  XENP018421 vlCDR1
RASQSVSNDVA

SEQ ID NO: 19519 - protein, 7 aa, Artificial Sequence
  Description of Artificial Sequence: Synthetic peptide
  XENP018421 vlCDR2
YASHWYT

SEQ ID NO: 19520 - protein, 9 aa, Artificial Sequence
  Description of Artificial Sequence: Synthetic peptide
  XENP018421 vlCDR3
QQDYSSPRT

SEQ ID NO: 19521 - protein, 451 aa, Artificial Sequence; identical to SEQ ID NO: 16221
  Description of Artificial Sequence: Synthetic polypeptide
  XENP018422 1G6_H1_L1.75_IgG1_PVA_/S267K Heavy Chain

SEQ ID NO: 19522 - protein, 122 aa, Artificial Sequence; identical to SEQ ID NO: 10922
  Description of Artificial Sequence: Synthetic polypeptide
  VH of XENP018422

SEQ ID NO: 19523 - protein, 5 aa, Artificial Sequence
  Description of Artificial Sequence: Synthetic peptide
  XENP018422 vhCDR1
NYWMN

SEQ ID NO: 19524 - protein, 19 aa, Artificial Sequence
  Description of Artificial Sequence: Synthetic peptide
  XENP018422 vhCDR2
EIRLKSNNYATHYAEPVKG

SEQ ID NO: 19525 - protein, 11 aa, Artificial Sequence
  Description of Artificial Sequence: Synthetic peptide
  XENP018422 vhCDR3
YYGNYGGYFDV

SEQ ID NO: 19526 - protein, 214 aa, Artificial Sequence
  Description of Artificial Sequence: Synthetic polypeptide
  XENP018422 1G6_H1_L1.75_IgG1_PVA_/S267K Light Chain
SIVMTQSPATLSVSPGERATLSCRASQSVSNDVAWYQQKPGQSPRLLINYASHSYTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 19527 - protein, 107 aa, Artificial Sequence; identical to SEQ ID NO: 13845
  Description of Artificial Sequence: Synthetic polypeptide
  VL of XENP018422

SEQ ID NO: 19528 - protein, 11 aa, Artificial Sequence
  Description of Artificial Sequence: Synthetic peptide
  XENP018422 vlCDR1
RASQSVSNDVA

SEQ ID NO: 19529 - protein, 7 aa, Artificial Sequence
  Description of Artificial Sequence: Synthetic peptide
  XENP018422 vlCDR2
YASHSYT

SEQ ID NO: 19530 - protein, 9 aa, Artificial Sequence
  Description of Artificial Sequence: Synthetic peptide
  XENP018422 vlCDR3
QQDYSSPRT

SEQ ID NO: 19531 - protein, 451 aa, Artificial Sequence; identical to SEQ ID NO: 16221
  Description of Artificial Sequence: Synthetic polypeptide
  XENP018423 1G6_H1_L1.76_IgG1_PVA_/S267K Heavy Chain

SEQ ID NO: 19532 - protein, 122 aa, Artificial Sequence; identical to SEQ ID NO: 10922
  Description of Artificial Sequence: Synthetic polypeptide
  VH of XENP018423

SEQ ID NO: 19533 - protein, 5 aa, Artificial Sequence
  Description of Artificial Sequence: Synthetic peptide
  XENP018423 vhCDR1
NYWMN

SEQ ID NO: 19534 - protein, 19 aa, Artificial Sequence
  Description of Artificial Sequence: Synthetic peptide
  XENP018423 vhCDR2
EIRLKSNNYATHYAEPVKG

SEQ ID NO: 19535 - protein, 11 aa, Artificial Sequence
  Description of Artificial Sequence: Synthetic peptide
  XENP018423 vhCDR3
YYGNYGGYFDV

SEQ ID NO: 19536 - protein, 214 aa, Artificial Sequence
  Description of Artificial Sequence: Synthetic polypeptide
  XENP018423 1G6_H1_L1.76_IgG1_PVA_/S267K Light Chain
SIVMTQSPATLSVSPGERATLSCRASQSVSNDVAWYQQKPGQSPRLLINYASHRFTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 19537 - protein, 107 aa, Artificial Sequence; identical to SEQ ID NO: 13854
  Description of Artificial Sequence: Synthetic polypeptide
  VL of XENP018423

SEQ ID NO: 19538 - protein, 11 aa, Artificial Sequence
  Description of Artificial Sequence: Synthetic peptide
  XENP018423 vlCDR1
RASQSVSNDVA

SEQ ID NO: 19539 - protein, 7 aa, Artificial Sequence
  Description of Artificial Sequence: Synthetic peptide
  XENP018423 vlCDR2
YASHRFT

SEQ ID NO: 19540 - protein, 9 aa, Artificial Sequence
  Description of Artificial Sequence: Synthetic peptide
  XENP018423 vlCDR3
QQDYSSPRT

SEQ ID NO: 19541 - protein, 451 aa, Artificial Sequence; identical to SEQ ID NO: 16221
  Description of Artificial Sequence: Synthetic polypeptide
  XENP018424 1G6_H1_L1.77_IgG1_PVA_/S267K Heavy Chain

SEQ ID NO: 19542 - protein, 122 aa, Artificial Sequence; identical to SEQ ID NO: 10922
  Description of Artificial Sequence: Synthetic polypeptide
  VH of XENP018424

SEQ ID NO: 19543 - protein, 5 aa, Artificial Sequence
  Description of Artificial Sequence: Synthetic peptide
  XENP018424 vhCDR1
NYWMN

SEQ ID NO: 19544 - protein, 19 aa, Artificial Sequence
  Description of Artificial Sequence: Synthetic peptide
  XENP018424 vhCDR2
EIRLKSNNYATHYAEPVKG

SEQ ID NO: 19545 - protein, 11 aa, Artificial Sequence
  Description of Artificial Sequence: Synthetic peptide
  XENP018424 vhCDR3
YYGNYGGYFDV

SEQ ID NO: 19546 - protein, 214 aa, Artificial Sequence
  Description of Artificial Sequence: Synthetic polypeptide
  XENP018424 1G6_H1_L1.77_IgG1_PVA_/S267K Light Chain
SIVMTQSPATLSVSPGERATLSCRASQSVSNDVAWYQQKPGQSPRLLINYASHRHTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 19547 - protein, 107 aa, Artificial Sequence; identical to SEQ ID NO: 13863
  Description of Artificial Sequence: Synthetic polypeptide
  VL of XENP018424

SEQ ID NO: 19548 - protein, 11 aa, Artificial Sequence
  Description of Artificial Sequence: Synthetic peptide
  XENP018424 vlCDR1
RASQSVSNDVA

SEQ ID NO: 19549 - protein, 7 aa, Artificial Sequence
  Description of Artificial Sequence: Synthetic peptide
  XENP018424 vlCDR2
YASHRHT

SEQ ID NO: 19550 - protein, 9 aa, Artificial Sequence
  Description of Artificial Sequence: Synthetic peptide
  XENP018424 vlCDR3
QQDYSSPRT

SEQ ID NO: 19551 - protein, 451 aa, Artificial Sequence; identical to SEQ ID NO: 16221
  Description of Artificial Sequence: Synthetic polypeptide
  XENP018425 1G6_H1_L1.78_IgG1_PVA_/S267K Heavy Chain

SEQ ID NO: 19552 - protein, 122 aa, Artificial Sequence; identical to SEQ ID NO: 10922
  Description of Artificial Sequence: Synthetic polypeptide
  VH of XENP018425

SEQ ID NO: 19553 - protein, 5 aa, Artificial Sequence
  Description of Artificial Sequence: Synthetic peptide
  XENP018425 vhCDR1
NYWMN

SEQ ID NO: 19554 - protein, 19 aa, Artificial Sequence
  Description of Artificial Sequence: Synthetic peptide
  XENP018425 vhCDR2
EIRLKSNNYATHYAEPVKG

SEQ ID NO: 19555 - protein, 11 aa, Artificial Sequence
  Description of Artificial Sequence: Synthetic peptide
  XENP018425 vhCDR3
YYGNYGGYFDV

SEQ ID NO: 19556 - protein, 214 aa, Artificial Sequence
  Description of Artificial Sequence: Synthetic polypeptide
  XENP018425 1G6_H1_L1.78_IgG1_PVA_/S267K Light Chain
SIVMTQSPATLSVSPGERATLSCRASQSVSNDVAWYQQKPGQSPRLLINYASHRLTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 19557 - protein, 107 aa, Artificial Sequence; identical to SEQ ID NO: 13872
  Description of Artificial Sequence: Synthetic polypeptide
  VL of XENP018425

SEQ ID NO: 19558 - protein, 11 aa, Artificial Sequence
  Description of Artificial Sequence: Synthetic peptide
  XENP018425 vlCDR1
RASQSVSNDVA

SEQ ID NO: 19559 - protein, 7 aa, Artificial Sequence
  Description of Artificial Sequence: Synthetic peptide
  XENP018425 vlCDR2
YASHRLT

SEQ ID NO: 19560 - protein, 9 aa, Artificial Sequence
  Description of Artificial Sequence: Synthetic peptide
  XENP018425 vlCDR3
QQDYSSPRT

SEQ ID NO: 19561 - protein, 451 aa, Artificial Sequence; identical to SEQ ID NO: 16221
  Description of Artificial Sequence: Synthetic polypeptide
  XENP018426 1G6_H1_L1.79_IgG1_PVA_/S267K Heavy Chain

SEQ ID NO: 19562 - protein, 122 aa, Artificial Sequence; identical to SEQ ID NO: 10922
  Description of Artificial Sequence: Synthetic polypeptide
  VH of XENP018426

SEQ ID NO: 19563 - protein, 5 aa, Artificial Sequence
  Description of Artificial Sequence: Synthetic peptide
  XENP018426 vhCDR1
NYWMN

SEQ ID NO: 19564 - protein, 19 aa, Artificial Sequence
  Description of Artificial Sequence: Synthetic peptide
  XENP018426 vhCDR2
EIRLKSNNYATHYAEPVKG

SEQ ID NO: 19565 - protein, 11 aa, Artificial Sequence
  Description of Artificial Sequence: Synthetic peptide
  XENP018426 vhCDR3
YYGNYGGYFDV

SEQ ID NO: 19566 - protein, 214 aa, Artificial Sequence
  Description of Artificial Sequence: Synthetic polypeptide
  XENP018426 1G6_H1_L1.79_IgG1_PVA_/S267K Light Chain
SIVMTQSPATLSVSPGERATLSCRASQSVSNDVAWYQQKPGQSPRLLINYASHRWTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 19567 - protein, 107 aa, Artificial Sequence; identical to SEQ ID NO: 13881
  Description of Artificial Sequence: Synthetic polypeptide
  VL of XENP018426

SEQ ID NO: 19568 - protein, 11 aa, Artificial Sequence
  Description of Artificial Sequence: Synthetic peptide
  XENP018426 vlCDR1
RASQSVSNDVA

SEQ ID NO: 19569 - protein, 7 aa, Artificial Sequence
  Description of Artificial Sequence: Synthetic peptide
  XENP018426 vlCDR2
YASHRWT

SEQ ID NO: 19570 - protein, 9 aa, Artificial Sequence
  Description of Artificial Sequence: Synthetic peptide
  XENP018426 vlCDR3
QQDYSSPRT

SEQ ID NO: 19571 - protein, 451 aa, Artificial Sequence; identical to SEQ ID NO: 16221
  Description of Artificial Sequence: Synthetic polypeptide
  XENP018427 1G6_H1_L1.80_IgG1_PVA_/S267K Heavy Chain

SEQ ID NO: 19572 - protein, 122 aa, Artificial Sequence; identical to SEQ ID NO: 10922
  Description of Artificial Sequence: Synthetic polypeptide
  VH of XENP018427

SEQ ID NO: 19573 - protein, 5 aa, Artificial Sequence
  Description of Artificial Sequence: Synthetic peptide
  XENP018427 vhCDR1
NYWMN

SEQ ID NO: 19574 - protein, 19 aa, Artificial Sequence
  Description of Artificial Sequence: Synthetic peptide
  XENP018427 vhCDR2
EIRLKSNNYATHYAEPVKG

SEQ ID NO: 19575 - protein, 11 aa, Artificial Sequence
  Description of Artificial Sequence: Synthetic peptide
  XENP018427 vhCDR3
YYGNYGGYFDV

SEQ ID NO: 19576 - protein, 214 aa, Artificial Sequence
  Description of Artificial Sequence: Synthetic polypeptide
  XENP018427 1G6_H1_L1.80_IgG1_PVA_/S267K Light Chain
SIVMTQSPATLSVSPGERATLSCRASQSVSNDVAWYQQKPGQSPRLLINYASHRVTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 19577 - protein, 107 aa, Artificial Sequence; identical to SEQ ID NO: 13890
  Description of Artificial Sequence: Synthetic polypeptide
  VL of XENP018427

SEQ ID NO: 19578 - protein, 11 aa, Artificial Sequence
  Description of Artificial Sequence: Synthetic peptide
  XENP018427 vlCDR1
RASQSVSNDVA

SEQ ID NO: 19579 - protein, 7 aa, Artificial Sequence
  Description of Artificial Sequence: Synthetic peptide
  XENP018427 vlCDR2
YASHRVT

SEQ ID NO: 19580 - protein, 9 aa, Artificial Sequence
  Description of Artificial Sequence: Synthetic peptide
  XENP018427 vlCDR3
QQDYSSPRT

SEQ ID NO: 19581 - protein, 451 aa, Artificial Sequence; identical to SEQ ID NO: 16221
  Description of Artificial Sequence: Synthetic polypeptide
  XENP018428 1G6_H1_L1.81_IgG1_PVA_/S267K Heavy Chain

SEQ ID NO: 19582 - protein, 122 aa, Artificial Sequence; identical to SEQ ID NO: 10922
  Description of Artificial Sequence: Synthetic polypeptide
  VH of XENP018428

SEQ ID NO: 19583 - protein, 5 aa, Artificial Sequence
  Description of Artificial Sequence: Synthetic peptide
  XENP018428 vhCDR1
NYWMN

SEQ ID NO: 19584 - protein, 19 aa, Artificial Sequence
  Description of Artificial Sequence: Synthetic peptide
  XENP018428 vhCDR2
EIRLKSNNYATHYAEPVKG

SEQ ID NO: 19585 - protein, 11 aa, Artificial Sequence
  Description of Artificial Sequence: Synthetic peptide
  XENP018428 vhCDR3
YYGNYGGYFDV

SEQ ID NO: 19586 - protein, 214 aa, Artificial Sequence
  Description of Artificial Sequence: Synthetic polypeptide
  XENP018428 1G6_H1_L1.81_IgG1_PVA_/S267K Light Chain
SIVMTQSPATLSVSPGERATLSCRASQSVSNDVAWYQQKPGQSPRLLINYASHRATGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 19587 - protein, 107 aa, Artificial Sequence; identical to SEQ ID NO: 13899
  Description of Artificial Sequence: Synthetic polypeptide
  VL of XENP018428

SEQ ID NO: 19588 - protein, 11 aa, Artificial Sequence
  Description of Artificial Sequence: Synthetic peptide
  XENP018428 vlCDR1
RASQSVSNDVA

SEQ ID NO: 19589 - protein, 7 aa, Artificial Sequence
  Description of Artificial Sequence: Synthetic peptide
  XENP018428 vlCDR2
YASHRAT

SEQ ID NO: 19590 - protein, 9 aa, Artificial Sequence
  Description of Artificial Sequence: Synthetic peptide
  XENP018428 vlCDR3
QQDYSSPRT

SEQ ID NO: 19591 - protein, 451 aa, Artificial Sequence; identical to SEQ ID NO: 16221
  Description of Artificial Sequence: Synthetic polypeptide
  XENP018429 1G6_H1_L1.82_IgG1_PVA_/S267K Heavy Chain

SEQ ID NO: 19592 - protein, 122 aa, Artificial Sequence; identical to SEQ ID NO: 10922
  Description of Artificial Sequence: Synthetic polypeptide
  VH of XENP018429

SEQ ID NO: 19593 - protein, 5 aa, Artificial Sequence
  Description of Artificial Sequence: Synthetic peptide
  XENP018429 vhCDR1
NYWMN

SEQ ID NO: 19594 - protein, 19 aa, Artificial Sequence
  Description of Artificial Sequence: Synthetic peptide
  XENP018429 vhCDR2
EIRLKSNNYATHYAEPVKG

SEQ ID NO: 19595 - protein, 11 aa, Artificial Sequence
  Description of Artificial Sequence: Synthetic peptide
  XENP018429 vhCDR3
YYGNYGGYFDV

SEQ ID NO: 19596 - protein, 214 aa, Artificial Sequence
  Description of Artificial Sequence: Synthetic polypeptide
  XENP018429 1G6_H1_L1.82_IgG1_PVA_/S267K Light Chain
SIVMTQSPATLSVSPGERATLSCRASQSVSNDVAWYQQKPGQSPRLLINYASHRQTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 19597 - protein, 107 aa, Artificial Sequence; identical to SEQ ID NO: 13908
  Description of Artificial Sequence: Synthetic polypeptide
  VL of XENP018429

SEQ ID NO: 19598 - protein, 11 aa, Artificial Sequence
  Description of Artificial Sequence: Synthetic peptide
  XENP018429 vlCDR1
RASQSVSNDVA

SEQ ID NO: 19599 - protein, 7 aa, Artificial Sequence
  Description of Artificial Sequence: Synthetic peptide
  XENP018429 vlCDR2
YASHRQT

SEQ ID NO: 19600 - protein, 9 aa, Artificial Sequence
  Description of Artificial Sequence: Synthetic peptide
  XENP018429 vlCDR3
QQDYSSPRT

SEQ ID NO: 19601 - protein, 451 aa, Artificial Sequence; identical to SEQ ID NO: 16221
  Description of Artificial Sequence: Synthetic polypeptide
  XENP018430 1G6_H1_L1.83_IgG1_PVA_/S267K Heavy Chain

SEQ ID NO: 19602 - protein, 122 aa, Artificial Sequence; identical to SEQ ID NO: 10922
  Description of Artificial Sequence: Synthetic polypeptide
  VH of XENP018430

SEQ ID NO: 19603 - protein, 5 aa, Artificial Sequence
  Description of Artificial Sequence: Synthetic peptide
  XENP018430 vhCDR1
NYWMN

SEQ ID NO: 19604 - protein, 19 aa, Artificial Sequence
  Description of Artificial Sequence: Synthetic peptide
  XENP018430 vhCDR2
EIRLKSNNYATHYAEPVKG

SEQ ID NO: 19605 - protein, 11 aa, Artificial Sequence
  Description of Artificial Sequence: Synthetic peptide
  XENP018430 vhCDR3
YYGNYGGYFDV

SEQ ID NO: 19606 - protein, 214 aa, Artificial Sequence
  Description of Artificial Sequence: Synthetic polypeptide
  XENP018430 1G6_H1_L1.83_IgG1_PVA_/S267K Light Chain
SIVMTQSPATLSVSPGERATLSCRASQSVSNDVAWYQQKPGQSPRLLINYASHRDTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 19607 - protein, 107 aa, Artificial Sequence; identical to SEQ ID NO: 13917
  Description of Artificial Sequence: Synthetic polypeptide
  VL of XENP018430

SEQ ID NO: 19608 - protein, 11 aa, Artificial Sequence
  Description of Artificial Sequence: Synthetic peptide
  XENP018430 vlCDR1
RASQSVSNDVA

SEQ ID NO: 19609 - protein, 7 aa, Artificial Sequence
  Description of Artificial Sequence: Synthetic peptide
  XENP018430 vlCDR2
YASHRDT

SEQ ID NO: 19610 - protein, 9 aa, Artificial Sequence
  Description of Artificial Sequence: Synthetic peptide
  XENP018430 vlCDR3
QQDYSSPRT

SEQ ID NO: 19611 - protein, 451 aa, Artificial Sequence; identical to SEQ ID NO: 16221
  Description of Artificial Sequence: Synthetic polypeptide
  XENP018431 1G6_H1_L1.84_IgG1_PVA_/S267K Heavy Chain

SEQ ID NO: 19612 - protein, 122 aa, Artificial Sequence; identical to SEQ ID NO: 10922
  Description of Artificial Sequence: Synthetic polypeptide
  VH of XENP018431

SEQ ID NO: 19613 - protein, 5 aa, Artificial Sequence
  Description of Artificial Sequence: Synthetic peptide
  XENP018431 vhCDR1
NYWMN

SEQ ID NO: 19614 - protein, 19 aa, Artificial Sequence
  Description of Artificial Sequence: Synthetic peptide
  XENP018431 vhCDR2
EIRLKSNNYATHYAEPVKG

SEQ ID NO: 19615 - protein, 11 aa, Artificial Sequence
  Description of Artificial Sequence: Synthetic peptide
  XENP018431 vhCDR3
YYGNYGGYFDV

SEQ ID NO: 19616 - protein, 214 aa, Artificial Sequence
  Description of Artificial Sequence: Synthetic polypeptide
  XENP018431 1G6_H1_L1.84_IgG1_PVA_/S267K Light Chain
SIVMTQSPATLSVSPGERATLSCRASQSVSNDVAWYQQKPGQSPRLLINYASHRKTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 19617 - protein, 107 aa, Artificial Sequence; identical to SEQ ID NO: 13926
  Description of Artificial Sequence: Synthetic polypeptide
  VL of XENP018431

SEQ ID NO: 19618 - protein, 11 aa, Artificial Sequence
  Description of Artificial Sequence: Synthetic peptide
  XENP018431 vlCDR1
RASQSVSNDVA

SEQ ID NO: 19619 - protein, 7 aa, Artificial Sequence
  Description of Artificial Sequence: Synthetic peptide
  XENP018431 vlCDR2
YASHRKT

SEQ ID NO: 19620 - protein, 9 aa, Artificial Sequence
  Description of Artificial Sequence: Synthetic peptide
  XENP018431 vlCDR3
QQDYSSPRT

SEQ ID NO: 19621 - protein, 451 aa, Artificial Sequence; identical to SEQ ID NO: 16221
  Description of Artificial Sequence: Synthetic polypeptide
  XENP018432 1G6_H1_L1.85_IgG1_PVA_/S267K Heavy Chain

SEQ ID NO: 19622 - protein, 122 aa, Artificial Sequence; identical to SEQ ID NO: 10922
  Description of Artificial Sequence: Synthetic polypeptide
  VH of XENP018432

SEQ ID NO: 19623 - protein, 5 aa, Artificial Sequence
  Description of Artificial Sequence: Synthetic peptide
  XENP018432 vhCDR1
NYWMN

SEQ ID NO: 19624 - protein, 19 aa, Artificial Sequence
  Description of Artificial Sequence: Synthetic peptide
  XENP018432 vhCDR2
EIRLKSNNYATHYAEPVKG

SEQ ID NO: 19625 - protein, 11 aa, Artificial Sequence
  Description of Artificial Sequence: Synthetic peptide
  XENP018432 vhCDR3
YYGNYGGYFDV

SEQ ID NO: 19626 - protein, 214 aa, Artificial Sequence
  Description of Artificial Sequence: Synthetic polypeptide
  XENP018432 1G6_H1_L1.85_IgG1_PVA_/S267K Light Chain
SIVMTQSPATLSVSPGERATLSCRASQSVSNDVAWYQQKPGQSPRLLINYASHRYVGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 19627 - protein, 107 aa, Artificial Sequence; identical to SEQ ID NO: 13935
  Description of Artificial Sequence: Synthetic polypeptide
  VL of XENP018432

SEQ ID NO: 19628 - protein, 11 aa, Artificial Sequence
  Description of Artificial Sequence: Synthetic peptide
  XENP018432 vlCDR1
RASQSVSNDVA

SEQ ID NO: 19629 - protein, 7 aa, Artificial Sequence
  Description of Artificial Sequence: Synthetic peptide
  XENP018432 vlCDR2
YASHRYV

SEQ ID NO: 19630 - protein, 9 aa, Artificial Sequence
  Description of Artificial Sequence: Synthetic peptide
  XENP018432 vlCDR3
QQDYSSPRT

SEQ ID NO: 19631 - protein, 451 aa, Artificial Sequence; identical to SEQ ID NO: 16221
  Description of Artificial Sequence: Synthetic polypeptide
  XENP018433 1G6_H1_L1.86_IgG1_PVA_/S267K Heavy Chain

SEQ ID NO: 19632 - protein, 122 aa, Artificial Sequence; identical to SEQ ID NO: 10922
  Description of Artificial Sequence: Synthetic polypeptide
  VH of XENP018433

SEQ ID NO: 19633 - protein, 5 aa, Artificial Sequence
  Description of Artificial Sequence: Synthetic peptide
  XENP018433 vhCDR1
NYWMN

SEQ ID NO: 19634 - protein, 19 aa, Artificial Sequence
  Description of Artificial Sequence: Synthetic peptide
  XENP018433 vhCDR2
EIRLKSNNYATHYAEPVKG

SEQ ID NO: 19635 - protein, 11 aa, Artificial Sequence
  Description of Artificial Sequence: Synthetic peptide
  XENP018433 vhCDR3
YYGNYGGYFDV

SEQ ID NO: 19636 - protein, 214 aa, Artificial Sequence
  Description of Artificial Sequence: Synthetic polypeptide
  XENP018433 1G6_H1_L1.86_IgG1_PVA_/S267K Light Chain
SIVMTQSPATLSVSPGERATLSCRASQSVSNDVAWYQQKPGQSPRLLINYASHRYSGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 19637 - protein, 107 aa, Artificial Sequence; identical to SEQ ID NO: 13944
  Description of Artificial Sequence: Synthetic polypeptide
  VL of XENP018433

SEQ ID NO: 19638 - protein, 11 aa, Artificial Sequence
  Description of Artificial Sequence: Synthetic peptide
  XENP018433 vlCDR1
RASQSVSNDVA

SEQ ID NO: 19639 - protein, 7 aa, Artificial Sequence
  Description of Artificial Sequence: Synthetic peptide
  XENP018433 vlCDR2
YASHRYS

SEQ ID NO: 19640 - protein, 9 aa, Artificial Sequence
  Description of Artificial Sequence: Synthetic peptide
  XENP018433 vlCDR3
QQDYSSPRT

SEQ ID NO: 19641 - protein, 451 aa, Artificial Sequence; identical to SEQ ID NO: 16221
  Description of Artificial Sequence: Synthetic polypeptide
  XENP018434 1G6_H1_L1.87_IgG1_PVA_/S267K Heavy Chain

SEQ ID NO: 19642 - protein, 122 aa, Artificial Sequence; identical to SEQ ID NO: 10922
  Description of Artificial Sequence: Synthetic polypeptide
  VH of XENP018434

SEQ ID NO: 19643 - protein, 5 aa, Artificial Sequence
  Description of Artificial Sequence: Synthetic peptide
  XENP018434 vhCDR1
NYWMN

SEQ ID NO: 19644 - protein, 19 aa, Artificial Sequence
  Description of Artificial Sequence: Synthetic peptide
  XENP018434 vhCDR2
EIRLKSNNYATHYAEPVKG

SEQ ID NO: 19645 - protein, 11 aa, Artificial Sequence
  Description of Artificial Sequence: Synthetic peptide
  XENP018434 vhCDR3
YYGNYGGYFDV

SEQ ID NO: 19646 - protein, 214 aa, Artificial Sequence
  Description of Artificial Sequence: Synthetic polypeptide
  XENP018434 1G6_H1_L1.87_IgG1_PVA_/S267K Light Chain
SIVMTQSPATLSVSPGERATLSCRASQSVSNDVAWYQQKPGQSPRLLINYASHRYAGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 19647 - protein, 107 aa, Artificial Sequence; identical to SEQ ID NO: 13953
  Description of Artificial Sequence: Synthetic polypeptide
  VL of XENP018434

SEQ ID NO: 19648 - protein, 11 aa, Artificial Sequence
  Description of Artificial Sequence: Synthetic peptide
  XENP018434 vlCDR1
RASQSVSNDVA

SEQ ID NO: 19649 - protein, 7 aa, Artificial Sequence
  Description of Artificial Sequence: Synthetic peptide
  XENP018434 vlCDR2
YASHRYA

SEQ ID NO: 19650 - protein, 9 aa, Artificial Sequence
  Description of Artificial Sequence: Synthetic peptide
  XENP018434 vlCDR3
QQDYSSPRT

SEQ ID NO: 19651 - protein, 451 aa, Artificial Sequence; identical to SEQ ID NO: 16221
  Description of Artificial Sequence: Synthetic polypeptide
  XENP018435 1G6_H1_L1.88_IgG1_PVA_/S267K Heavy Chain

SEQ ID NO: 19652 - protein, 122 aa, Artificial Sequence; identical to SEQ ID NO: 10922
  Description of Artificial Sequence: Synthetic polypeptide
  VH of XENP018435

SEQ ID NO: 19653 - protein, 5 aa, Artificial Sequence
  Description of Artificial Sequence: Synthetic peptide
  XENP018435 vhCDR1
NYWMN

SEQ ID NO: 19654 - protein, 19 aa, Artificial Sequence
  Description of Artificial Sequence: Synthetic peptide
  XENP018435 vhCDR2
EIRLKSNNYATHYAEPVKG

SEQ ID NO: 19655 - protein, 11 aa, Artificial Sequence
  Description of Artificial Sequence: Synthetic peptide
  XENP018435 vhCDR3
YYGNYGGYFDV

SEQ ID NO: 19656 - protein, 214 aa, Artificial Sequence
  Description of Artificial Sequence: Synthetic polypeptide
  XENP018435 1G6_H1_L1.88_IgG1_PVA_/S267K Light Chain
SIVMTQSPATLSVSPGERATLSCRASQSVSNDVAWYQQKPGQSPRLLINYASHRYIGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 19657 - protein, 107 aa, Artificial Sequence; identical to SEQ ID NO: 13962
  Description of Artificial Sequence: Synthetic polypeptide
  VL of XENP018435

SEQ ID NO: 19658 - protein, 11 aa, Artificial Sequence
  Description of Artificial Sequence: Synthetic peptide
  XENP018435 vlCDR1
RASQSVSNDVA

SEQ ID NO: 19659 - protein, 7 aa, Artificial Sequence
  Description of Artificial Sequence: Synthetic peptide
  XENP018435 vlCDR2
YASHRYI

SEQ ID NO: 19660 - protein, 9 aa, Artificial Sequence
  Description of Artificial Sequence: Synthetic peptide
  XENP018435 vlCDR3
QQDYSSPRT

SEQ ID NO: 19661 - protein, 451 aa, Artificial Sequence; identical to SEQ ID NO: 16221
  Description of Artificial Sequence: Synthetic polypeptide
  XENP018436 1G6_H1_L1.89_IgG1_PVA_/S267K Heavy Chain

SEQ ID NO: 19662 - protein, 122 aa, Artificial Sequence; identical to SEQ ID NO: 10922
  Description of Artificial Sequence: Synthetic polypeptide
  VH of XENP018436

SEQ ID NO: 19663 - protein, 5 aa, Artificial Sequence
  Description of Artificial Sequence: Synthetic peptide
  XENP018436 vhCDR1
NYWMN

SEQ ID NO: 19664 - protein, 19 aa, Artificial Sequence
  Description of Artificial Sequence: Synthetic peptide
  XENP018436 vhCDR2
EIRLKSNNYATHYAEPVKG

SEQ ID NO: 19665 - protein, 11 aa, Artificial Sequence
  Description of Artificial Sequence: Synthetic peptide
  XENP018436 vhCDR3
YYGNYGGYFDV

SEQ ID NO: 19666 - protein, 214 aa, Artificial Sequence
  Description of Artificial Sequence: Synthetic polypeptide
  XENP018436 1G6_H1_L1.89_IgG1_PVA_/S267K Light Chain
SIVMTQSPATLSVSPGERATLSCRASQSVSNDVAWYQQKPGQSPRLLINYASHRYQGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 19667 - protein, 107 aa, Artificial Sequence; identical to SEQ ID NO: 13971
  Description of Artificial Sequence: Synthetic polypeptide
  VL of XENP018436

SEQ ID NO: 19668 - protein, 11 aa, Artificial Sequence
  Description of Artificial Sequence: Synthetic peptide
  XENP018436 vlCDR1
RASQSVSNDVA

SEQ ID NO: 19669 - protein, 7 aa, Artificial Sequence
  Description of Artificial Sequence: Synthetic peptide
  XENP018436 vlCDR2
YASHRYQ

SEQ ID NO: 19670 - protein, 9 aa, Artificial Sequence
  Description of Artificial Sequence: Synthetic peptide
  XENP018436 vlCDR3
QQDYSSPRT

SEQ ID NO: 19671 - protein, 451 aa, Artificial Sequence; identical to SEQ ID NO: 16221
  Description of Artificial Sequence: Synthetic polypeptide
  XENP018437 1G6_H1_L1.90_IgG1_PVA_/S267K Heavy Chain

SEQ ID NO: 19672 - protein, 122 aa, Artificial Sequence; identical to SEQ ID NO: 10922
  Description of Artificial Sequence: Synthetic polypeptide
  VH of XENP018437

SEQ ID NO: 19673 - protein, 5 aa, Artificial Sequence
  Description of Artificial Sequence: Synthetic peptide
  XENP018437 vhCDR1
NYWMN

SEQ ID NO: 19674 - protein, 19 aa, Artificial Sequence
  Description of Artificial Sequence: Synthetic peptide
  XENP018437 vhCDR2
EIRLKSNNYATHYAEPVKG

SEQ ID NO: 19675 - protein, 11 aa, Artificial Sequence
  Description of Artificial Sequence: Synthetic peptide
  XENP018437 vhCDR3
YYGNYGGYFDV

SEQ ID NO: 19676 - protein, 214 aa, Artificial Sequence
  Description of Artificial Sequence: Synthetic polypeptide
  XENP018437 1G6_H1_L1.90_IgG1_PVA_/S267K Light Chain
SIVMTQSPATLSVSPGERATLSCRASQSVSNDVAWYQQKPGQSPRLLINYASHRYHGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 19677 - protein, 107 aa, Artificial Sequence; identical to SEQ ID NO: 13980
  Description of Artificial Sequence: Synthetic polypeptide
  VL of XENP018437

SEQ ID NO: 19678 - protein, 11 aa, Artificial Sequence
  Description of Artificial Sequence: Synthetic peptide
  XENP018437 vlCDR1
RASQSVSNDVA

SEQ ID NO: 19679 - protein, 7 aa, Artificial Sequence
  Description of Artificial Sequence: Synthetic peptide
  XENP018437 vlCDR2
YASHRYH

SEQ ID NO: 19680 - protein, 9 aa, Artificial Sequence
  Description of Artificial Sequence: Synthetic peptide
  XENP018437 vlCDR3
QQDYSSPRT

SEQ ID NO: 19681 - protein, 451 aa, Artificial Sequence; identical to SEQ ID NO: 16221
  Description of Artificial Sequence: Synthetic polypeptide
  XENP018438 1G6_H1_L1.91_IgG1_PVA_/S267K Heavy Chain

SEQ ID NO: 19682 - protein, 122 aa, Artificial Sequence; identical to SEQ ID NO: 10922
  Description of Artificial Sequence: Synthetic polypeptide
  VH of XENP018438

SEQ ID NO: 19683 - protein, 5 aa, Artificial Sequence
  Description of Artificial Sequence: Synthetic peptide
  XENP018438 vhCDR1
NYWMN

SEQ ID NO: 19684 - protein, 19 aa, Artificial Sequence
  Description of Artificial Sequence: Synthetic peptide
  XENP018438 vhCDR2
EIRLKSNNYATHYAEPVKG

SEQ ID NO: 19685 - protein, 11 aa, Artificial Sequence
  Description of Artificial Sequence: Synthetic peptide
  XENP018438 vhCDR3
YYGNYGGYFDV

SEQ ID NO: 19686 - protein, 214 aa, Artificial Sequence
  Description of Artificial Sequence: Synthetic polypeptide
  XENP018438 1G6_H1_L1.91_IgG1_PVA_/S267K Light Chain
SIVMTQSPATLSVSPGERATLSCRASQSVSNDVAWYQQKPGQSPRLLINYASHRYDGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 19687 - protein, 107 aa, Artificial Sequence; identical to SEQ ID NO: 13989
  Description of Artificial Sequence: Synthetic polypeptide
  VL of XENP018438

SEQ ID NO: 19688 - protein, 11 aa, Artificial Sequence
  Description of Artificial Sequence: Synthetic peptide
  XENP018438 vlCDR1
RASQSVSNDVA

SEQ ID NO: 19689 - protein, 7 aa, Artificial Sequence
  Description of Artificial Sequence: Synthetic peptide
  XENP018438 vlCDR2
YASHRYD

SEQ ID NO: 19690 - protein, 9 aa, Artificial Sequence
  Description of Artificial Sequence: Synthetic peptide
  XENP018438 vlCDR3
QQDYSSPRT

SEQ ID NO: 19691 - protein, 451 aa, Artificial Sequence; identical to SEQ ID NO: 16221
  Description of Artificial Sequence: Synthetic polypeptide
  XENP018439 1G6_H1_L1.92_IgG1_PVA_/S267K Heavy Chain

SEQ ID NO: 19692 - protein, 122 aa, Artificial Sequence; identical to SEQ ID NO: 10922
  Description of Artificial Sequence: Synthetic polypeptide
  VH of XENP018439

SEQ ID NO: 19693 - protein, 5 aa, Artificial Sequence
  Description of Artificial Sequence: Synthetic peptide
  XENP018439 vhCDR1
NYWMN

SEQ ID NO: 19694 - protein, 19 aa, Artificial Sequence
  Description of Artificial Sequence: Synthetic peptide
  XENP018439 vhCDR2
EIRLKSNNYATHYAEPVKG

SEQ ID NO: 19695 - protein, 11 aa, Artificial Sequence
  Description of Artificial Sequence: Synthetic peptide
  XENP018439 vhCDR3
YYGNYGGYFDV

SEQ ID NO: 19696 - protein, 214 aa, Artificial Sequence
  Description of Artificial Sequence: Synthetic polypeptide
  XENP018439 1G6_H1_L1.92_IgG1_PVA_/S267K Light Chain
SIVMTQSPATLSVSPGERATLSCRASQSVSNDVAWYQQKPGQSPRLLINYASHRYKGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 19697 - protein, 107 aa, Artificial Sequence; identical to SEQ ID NO: 13998
  Description of Artificial Sequence: Synthetic polypeptide
  VL of XENP018439

SEQ ID NO: 19698 - protein, 11 aa, Artificial Sequence
  Description of Artificial Sequence: Synthetic peptide
  XENP018439 vlCDR1
RASQSVSNDVA

SEQ ID NO: 19699 - protein, 7 aa, Artificial Sequence
  Description of Artificial Sequence: Synthetic peptide
  XENP018439 vlCDR2
YASHRYK

SEQ ID NO: 19700 - protein, 9 aa, Artificial Sequence
  Description of Artificial Sequence: Synthetic peptide
  XENP018439 vlCDR3
QQDYSSPRT

SEQ ID NO: 19701 - protein, 451 aa, Artificial Sequence; identical to SEQ ID NO: 16221
  Description of Artificial Sequence: Synthetic polypeptide
  XENP018440 1G6_H1_L1.93_IgG1_PVA_/S267K Heavy Chain

SEQ ID NO: 19702 - protein, 122 aa, Artificial Sequence; identical to SEQ ID NO: 10922
  Description of Artificial Sequence: Synthetic polypeptide
  VH of XENP018440

SEQ ID NO: 19703 - protein, 5 aa, Artificial Sequence
  Description of Artificial Sequence: Synthetic peptide
  XENP018440 vhCDR1
NYWMN

SEQ ID NO: 19704 - protein, 19 aa, Artificial Sequence
  Description of Artificial Sequence: Synthetic peptide
  XENP018440 vhCDR2
EIRLKSNNYATHYAEPVKG

SEQ ID NO: 19705 - protein, 11 aa, Artificial Sequence
  Description of Artificial Sequence: Synthetic peptide
  XENP018440 vhCDR3
YYGNYGGYFDV

SEQ ID NO: 19706 - protein, 214 aa, Artificial Sequence
  Description of Artificial Sequence: Synthetic polypeptide
  XENP018440 1G6_H1_L1.93_IgG1_PVA_/S267K Light Chain
SIVMTQSPATLSVSPGERATLSCRASQSVSNDVAWYQQKPGQSPRLLINYASHRYYGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 19707 - protein, 107 aa, Artificial Sequence; identical to SEQ ID NO: 14007
  Description of Artificial Sequence: Synthetic polypeptide
  VL of XENP018440

SEQ ID NO: 19708 - protein, 11 aa, Artificial Sequence
  Description of Artificial Sequence: Synthetic peptide
  XENP018440 vlCDR1
RASQSVSNDVA

SEQ ID NO: 19709 - protein, 7 aa, Artificial Sequence
  Description of Artificial Sequence: Synthetic peptide
  XENP018440 vlCDR2
YASHRYY

SEQ ID NO: 19710 - protein, 9 aa, Artificial Sequence
  Description of Artificial Sequence: Synthetic peptide
  XENP018440 vlCDR3
QQDYSSPRT

SEQ ID NO: 19711 - protein, 451 aa, Artificial Sequence; identical to SEQ ID NO: 16221
  Description of Artificial Sequence: Synthetic polypeptide
  XENP018441 1G6_H1_L1.94_IgG1_PVA_/S267K Heavy Chain

SEQ ID NO: 19712 - protein, 122 aa, Artificial Sequence; identical to SEQ ID NO: 10922
  Description of Artificial Sequence: Synthetic polypeptide
  VH of XENP018441

SEQ ID NO: 19713 - protein, 5 aa, Artificial Sequence
  Description of Artificial Sequence: Synthetic peptide
  XENP018441 vhCDR1
NYWMN

SEQ ID NO: 19714 - protein, 19 aa, Artificial Sequence
  Description of Artificial Sequence: Synthetic peptide
  XENP018441 vhCDR2
EIRLKSNNYATHYAEPVKG

SEQ ID NO: 19715 - protein, 11 aa, Artificial Sequence
  Description of Artificial Sequence: Synthetic peptide
  XENP018441 vhCDR3
YYGNYGGYFDV

SEQ ID NO: 19716 - protein, 214 aa, Artificial Sequence
  Description of Artificial Sequence: Synthetic polypeptide
  XENP018441 1G6_H1_L1.94_IgG1_PVA_/S267K Light Chain
SIVMTQSPATLSVSPGERATLSCRASQSVSNDVAWYQQKPGQSPRLLINYASHRYTSVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 19717 - protein, 107 aa, Artificial Sequence; identical to SEQ ID NO: 14016
  Description of Artificial Sequence: Synthetic polypeptide
  VL of XENP018441

SEQ ID NO: 19718 - protein, 11 aa, Artificial Sequence
  Description of Artificial Sequence: Synthetic peptide
  XENP018441 vlCDR1
RASQSVSNDVA

SEQ ID NO: 19719 - protein, 7 aa, Artificial Sequence
  Description of Artificial Sequence: Synthetic peptide
  XENP018441 vlCDR2
YASHRYT

SEQ ID NO: 19720 - protein, 9 aa, Artificial Sequence
  Description of Artificial Sequence: Synthetic peptide
  XENP018441 vlCDR3
QQDYSSPRT

SEQ ID NO: 19721 - protein, 451 aa, Artificial Sequence; identical to SEQ ID NO: 16221
  Description of Artificial Sequence: Synthetic polypeptide
  XENP018442 1G6_H1_L1.95_IgG1_PVA_/S267K Heavy Chain

SEQ ID NO: 19722 - protein, 122 aa, Artificial Sequence; identical to SEQ ID NO: 10922
  Description of Artificial Sequence: Synthetic polypeptide
  VH of XENP018442

SEQ ID NO: 19723 - protein, 5 aa, Artificial Sequence
  Description of Artificial Sequence: Synthetic peptide
  XENP018442 vhCDR1
NYWMN

SEQ ID NO: 19724 - protein, 19 aa, Artificial Sequence
  Description of Artificial Sequence: Synthetic peptide
  XENP018442 vhCDR2
EIRLKSNNYATHYAEPVKG

SEQ ID NO: 19725 - protein, 11 aa, Artificial Sequence
  Description of Artificial Sequence: Synthetic peptide
  XENP018442 vhCDR3
YYGNYGGYFDV

SEQ ID NO: 19726 - protein, 214 aa, Artificial Sequence
  Description of Artificial Sequence: Synthetic polypeptide
  XENP018442 1G6_H1_L1.95_IgG1_PVA_/S267K Light Chain
SIVMTQSPATLSVSPGERATLSCRASQSVSNDVAWYQQKPGQSPRLLINYASHRYTGIPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 19727 - protein, 107 aa, Artificial Sequence; identical to SEQ ID NO: 14025
  Description of Artificial Sequence: Synthetic polypeptide
  VL of XENP018442

SEQ ID NO: 19728 - protein, 11 aa, Artificial Sequence
  Description of Artificial Sequence: Synthetic peptide
  XENP018442 vlCDR1
RASQSVSNDVA

SEQ ID NO: 19729 - protein, 7 aa, Artificial Sequence
  Description of Artificial Sequence: Synthetic peptide
  XENP018442 vlCDR2
YASHRYT

SEQ ID NO: 19730 - protein, 9 aa, Artificial Sequence
  Description of Artificial Sequence: Synthetic peptide
  XENP018442 vlCDR3
QQDYSSPRT

SEQ ID NO: 19731 - protein, 451 aa, Artificial Sequence; identical to SEQ ID NO: 16221
  Description of Artificial Sequence: Synthetic polypeptide
  XENP018443 1G6_H1_L1.96_IgG1_PVA_/S267K Heavy Chain

SEQ ID NO: 19732 - protein, 122 aa, Artificial Sequence; identical to SEQ ID NO: 10922
  Description of Artificial Sequence: Synthetic polypeptide
  VH of XENP018443

SEQ ID NO: 19733 - protein, 5 aa, Artificial Sequence
  Description of Artificial Sequence: Synthetic peptide
  XENP018443 vhCDR1
NYWMN

SEQ ID NO: 19734 - protein, 19 aa, Artificial Sequence
  Description of Artificial Sequence: Synthetic peptide
  XENP018443 vhCDR2
EIRLKSNNYATHYAEPVKG

SEQ ID NO: 19735 - protein, 11 aa, Artificial Sequence
  Description of Artificial Sequence: Synthetic peptide
  XENP018443 vhCDR3
YYGNYGGYFDV

SEQ ID NO: 19736 - protein, 214 aa, Artificial Sequence
  Description of Artificial Sequence: Synthetic polypeptide
  XENP018443 1G6_H1_L1.96_IgG1_PVA_/S267K Light Chain
SIVMTQSPATLSVSPGERATLSCRASQSVSNDVAWYQQKPGQSPRLLINYASHRYTGVPARFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 19737 - protein, 107 aa, Artificial Sequence; identical to SEQ ID NO: 14034
  Description of Artificial Sequence: Synthetic polypeptide
  VL of XENP018443

SEQ ID NO: 19738 - protein, 11 aa, Artificial Sequence
  Description of Artificial Sequence: Synthetic peptide
  XENP018443 vlCDR1
RASQSVSNDVA

SEQ ID NO: 19739 - protein, 7 aa, Artificial Sequence
  Description of Artificial Sequence: Synthetic peptide
  XENP018443 vlCDR2
YASHRYT

SEQ ID NO: 19740 - protein, 9 aa, Artificial Sequence
  Description of Artificial Sequence: Synthetic peptide
  XENP018443 vlCDR3
QQDYSSPRT

SEQ ID NO: 19741 - protein, 451 aa, Artificial Sequence; identical to SEQ ID NO: 16221
  Description of Artificial Sequence: Synthetic polypeptide
  XENP018444 1G6_H1_L1.97_IgG1_PVA_/S267K Heavy Chain

SEQ ID NO: 19742 - protein, 122 aa, Artificial Sequence; identical to SEQ ID NO: 10922
  Description of Artificial Sequence: Synthetic polypeptide
  VH of XENP018444

SEQ ID NO: 19743 - protein, 5 aa, Artificial Sequence
  Description of Artificial Sequence: Synthetic peptide
  XENP018444 vhCDR1
NYWMN

SEQ ID NO: 19744 - protein, 19 aa, Artificial Sequence
  Description of Artificial Sequence: Synthetic peptide
  XENP018444 vhCDR2
EIRLKSNNYATHYAEPVKG

SEQ ID NO: 19745 - protein, 11 aa, Artificial Sequence
  Description of Artificial Sequence: Synthetic peptide
  XENP018444 vhCDR3
YYGNYGGYFDV

SEQ ID NO: 19746 - protein, 214 aa, Artificial Sequence
  Description of Artificial Sequence: Synthetic polypeptide
  XENP018444 1G6_H1_L1.97_IgG1_PVA_/S267K Light Chain
SIVMTQSPATLSVSPGERATLSCRASQSVSNDVAWYQQKPGQSPRLLINYASHRYTGVPDRFSGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 19747 - protein, 107 aa, Artificial Sequence; identical to SEQ ID NO: 14043
  Description of Artificial Sequence: Synthetic polypeptide
  VL of XENP018444

SEQ ID NO: 19748 - protein, 11 aa, Artificial Sequence
  Description of Artificial Sequence: Synthetic peptide
  XENP018444 vlCDR1
RASQSVSNDVA

SEQ ID NO: 19749 - protein, 7 aa, Artificial Sequence
  Description of Artificial Sequence: Synthetic peptide
  XENP018444 vlCDR2
YASHRYT

SEQ ID NO: 19750 - protein, 9 aa, Artificial Sequence
  Description of Artificial Sequence: Synthetic peptide
  XENP018444 vlCDR3
QQDYSSPRT

SEQ ID NO: 19751 - protein, 451 aa, Artificial Sequence; identical to SEQ ID NO: 16221
  Description of Artificial Sequence: Synthetic polypeptide
  XENP018445 1G6_H1_L1.98_IgG1_PVA_/S267K Heavy Chain

SEQ ID NO: 19752 - protein, 122 aa, Artificial Sequence; identical to SEQ ID NO: 10922
  Description of Artificial Sequence: Synthetic polypeptide
  VH of XENP018445

SEQ ID NO: 19753 - protein, 5 aa, Artificial Sequence
  Description of Artificial Sequence: Synthetic peptide
  XENP018445 vhCDR1
NYWMN

SEQ ID NO: 19754 - protein, 19 aa, Artificial Sequence
  Description of Artificial Sequence: Synthetic peptide
  XENP018445 vhCDR2
EIRLKSNNYATHYAEPVKG

SEQ ID NO: 19755 - protein, 11 aa, Artificial Sequence
  Description of Artificial Sequence: Synthetic peptide
  XENP018445 vhCDR3
YYGNYGGYFDV

SEQ ID NO: 19756 - protein, 214 aa, Artificial Sequence
  Description of Artificial Sequence: Synthetic polypeptide
  XENP018445 1G6_H1_L1.98_IgG1_PVA_/S267K Light Chain
SIVMTQSPATLSVSPGERATLSCRASQSVSNDVAWYQQKPGQSPRLLINYASHRYTGVPDRFTGSGSGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 19757 - protein, 107 aa, Artificial Sequence; identical to SEQ ID NO: 14052
  Description of Artificial Sequence: Synthetic polypeptide
  VL of XENP018445

SEQ ID NO: 19758 - protein, 11 aa, Artificial Sequence
  Description of Artificial Sequence: Synthetic peptide
  XENP018445 vlCDR1
RASQSVSNDVA

SEQ ID NO: 19759 - protein, 7 aa, Artificial Sequence
  Description of Artificial Sequence: Synthetic peptide
  XENP018445 vlCDR2
YASHRYT

SEQ ID NO: 19760 - protein, 9 aa, Artificial Sequence
  Description of Artificial Sequence: Synthetic peptide
  XENP018445 vlCDR3
QQDYSSPRT

SEQ ID NO: 19761 - protein, 451 aa, Artificial Sequence; identical to SEQ ID NO: 16221
  Description of Artificial Sequence: Synthetic polypeptide
  XENP018446 1G6_H1_L1.99_IgG1_PVA_/S267K Heavy Chain

SEQ ID NO: 19762 - protein, 122 aa, Artificial Sequence; identical to SEQ ID NO: 10922
  Description of Artificial Sequence: Synthetic polypeptide
  VH of XENP018446

SEQ ID NO: 19763 - protein, 5 aa, Artificial Sequence
  Description of Artificial Sequence: Synthetic peptide
  XENP018446 vhCDR1
NYWMN

SEQ ID NO: 19764 - protein, 19 aa, Artificial Sequence
  Description of Artificial Sequence: Synthetic peptide
  XENP018446 vhCDR2
EIRLKSNNYATHYAEPVKG

SEQ ID NO: 19765 - protein, 11 aa, Artificial Sequence
  Description of Artificial Sequence: Synthetic peptide
  XENP018446 vhCDR3
YYGNYGGYFDV

SEQ ID NO: 19766 - protein, 214 aa, Artificial Sequence
  Description of Artificial Sequence: Synthetic polypeptide
  XENP018446 1G6_H1_L1.99_IgG1_PVA_/S267K Light Chain
SIVMTQSPATLSVSPGERATLSCRASQSVSNDVAWYQQKPGQSPRLLINYASHRYTGVPDRFTGSGPGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 19767 - protein, 107 aa, Artificial Sequence; identical to SEQ ID NO: 14061
  Description of Artificial Sequence: Synthetic polypeptide
  VL of XENP018446

SEQ ID NO: 19768 - protein, 11 aa, Artificial Sequence
  Description of Artificial Sequence: Synthetic peptide
  XENP018446 vlCDR1
RASQSVSNDVA

SEQ ID NO: 19769 - protein, 7 aa, Artificial Sequence
  Description of Artificial Sequence: Synthetic peptide
  XENP018446 vlCDR2
YASHRYT

SEQ ID NO: 19770 - protein, 9 aa, Artificial Sequence
  Description of Artificial Sequence: Synthetic peptide
  XENP018446 vlCDR3
QQDYSSPRT

SEQ ID NO: 19771 - protein, 451 aa, Artificial Sequence; identical to SEQ ID NO: 16221
  Description of Artificial Sequence: Synthetic polypeptide
  XENP018447 1G6_H1_L1.100_IgG1_PVA_/S267K Heavy Chain

SEQ ID NO: 19772 - protein, 122 aa, Artificial Sequence; identical to SEQ ID NO: 10922
  Description of Artificial Sequence: Synthetic polypeptide
  VH of XENP018447

SEQ ID NO: 19773 - protein, 5 aa, Artificial Sequence
  Description of Artificial Sequence: Synthetic peptide
  XENP018447 vhCDR1
NYWMN

SEQ ID NO: 19774 - protein, 19 aa, Artificial Sequence
  Description of Artificial Sequence: Synthetic peptide
  XENP018447 vhCDR2
EIRLKSNNYATHYAEPVKG

SEQ ID NO: 19775 - protein, 11 aa, Artificial Sequence
  Description of Artificial Sequence: Synthetic peptide
  XENP018447 vhCDR3
YYGNYGGYFDV

SEQ ID NO: 19776 - protein, 214 aa, Artificial Sequence
  Description of Artificial Sequence: Synthetic polypeptide
  XENP018447 1G6_H1_L1.100_IgG1_PVA_/S267K Light Chain
SIVMTQSPATLSVSPGERATLSCRASQSVSNDVAWYQQKPGQSPRLLINYASHRYTGVPDRFTGSGYGTDFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 19777 - protein, 107 aa, Artificial Sequence; identical to SEQ ID NO: 14070
  Description of Artificial Sequence: Synthetic polypeptide
  VL of XENP018447

SEQ ID NO: 19778 - protein, 11 aa, Artificial Sequence
  Description of Artificial Sequence: Synthetic peptide
  XENP018447 vlCDR1
RASQSVSNDVA

SEQ ID NO: 19779 - protein, 7 aa, Artificial Sequence
  Description of Artificial Sequence: Synthetic peptide
  XENP018447 vlCDR2
YASHRYT

SEQ ID NO: 19780 - protein, 9 aa, Artificial Sequence
  Description of Artificial Sequence: Synthetic peptide
  XENP018447 vlCDR3
QQDYSSPRT

SEQ ID NO: 19781 - protein, 451 aa, Artificial Sequence; identical to SEQ ID NO: 16221
  Description of Artificial Sequence: Synthetic polypeptide
  XENP018448 1G6_H1_L1.101_IgG1_PVA_/S267K Heavy Chain

SEQ ID NO: 19782 - protein, 122 aa, Artificial Sequence; identical to SEQ ID NO: 10922
  Description of Artificial Sequence: Synthetic polypeptide
  VH of XENP018448

SEQ ID NO: 19783 - protein, 5 aa, Artificial Sequence
  Description of Artificial Sequence: Synthetic peptide
  XENP018448 vhCDR1
NYWMN

SEQ ID NO: 19784 - protein, 19 aa, Artificial Sequence
  Description of Artificial Sequence: Synthetic peptide
  XENP018448 vhCDR2
EIRLKSNNYATHYAEPVKG

SEQ ID NO: 19785 - protein, 11 aa, Artificial Sequence
  Description of Artificial Sequence: Synthetic peptide
  XENP018448 vhCDR3
YYGNYGGYFDV

SEQ ID NO: 19786 - protein, 214 aa, Artificial Sequence
  Description of Artificial Sequence: Synthetic polypeptide
  XENP018448 1G6_H1_L1.101_IgG1_PVA_/S267K Light Chain
SIVMTQSPATLSVSPGERATLSCRASQSVSNDVAWYQQKPGQSPRLLINYASHRYTGVPDRFTGSGYGTEFTFTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 19787 - protein, 107 aa, Artificial Sequence; identical to SEQ ID NO: 14079
  Description of Artificial Sequence: Synthetic polypeptide
  VL of XENP018448

SEQ ID NO: 19788 - protein, 11 aa, Artificial Sequence
  Description of Artificial Sequence: Synthetic peptide
  XENP018448 vlCDR1
RASQSVSNDVA

SEQ ID NO: 19789 - protein, 7 aa, Artificial Sequence
  Description of Artificial Sequence: Synthetic peptide
  XENP018448 vlCDR2
YASHRYT

SEQ ID NO: 19790 - protein, 9 aa, Artificial Sequence
  Description of Artificial Sequence: Synthetic peptide
  XENP018448 vlCDR3
QQDYSSPRT

SEQ ID NO: 19791 - protein, 451 aa, Artificial Sequence; identical to SEQ ID NO: 16221
  Description of Artificial Sequence: Synthetic polypeptide
  XENP018449 1G6_H1_L1.102_IgG1_PVA_/S267K Heavy Chain

SEQ ID NO: 19792 - protein, 122 aa, Artificial Sequence; identical to SEQ ID NO: 10922
  Description of Artificial Sequence: Synthetic polypeptide
  VH of XENP018449

SEQ ID NO: 19793 - protein, 5 aa, Artificial Sequence
  Description of Artificial Sequence: Synthetic peptide
  XENP018449 vhCDR1
NYWMN

SEQ ID NO: 19794 - protein, 19 aa, Artificial Sequence
  Description of Artificial Sequence: Synthetic peptide
  XENP018449 vhCDR2
EIRLKSNNYATHYAEPVKG

SEQ ID NO: 19795 - protein, 11 aa, Artificial Sequence
  Description of Artificial Sequence: Synthetic peptide
  XENP018449 vhCDR3
YYGNYGGYFDV

SEQ ID NO: 19796 - protein, 214 aa, Artificial Sequence
  Description of Artificial Sequence: Synthetic polypeptide
  XENP018449 1G6_H1_L1.102_IgG1_PVA_/S267K Light Chain
SIVMTQSPATLSVSPGERATLSCRASQSVSNDVAWYQQKPGQSPRLLINYASHRYTGVPDRFTGSGYGTEFTLTISTLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 19797 - protein, 107 aa, Artificial Sequence; identical to SEQ ID NO: 14088
  Description of Artificial Sequence: Synthetic polypeptide
  VL of XENP018449

SEQ ID NO: 19798 - protein, 11 aa, Artificial Sequence
  Description of Artificial Sequence: Synthetic peptide
  XENP018449 vlCDR1
RASQSVSNDVA

SEQ ID NO: 19799 - protein, 7 aa, Artificial Sequence
  Description of Artificial Sequence: Synthetic peptide
  XENP018449 vlCDR2
YASHRYT

SEQ ID NO: 19800 - protein, 9 aa, Artificial Sequence
  Description of Artificial Sequence: Synthetic peptide
  XENP018449 vlCDR3
QQDYSSPRT

SEQ ID NO: 19801 - protein, 451 aa, Artificial Sequence; identical to SEQ ID NO: 16221
  Description of Artificial Sequence: Synthetic polypeptide
  XENP018450 1G6_H1_L1.103_IgG1_PVA_/S267K Heavy Chain

SEQ ID NO: 19802 - protein, 122 aa, Artificial Sequence; identical to SEQ ID NO: 10922
  Description of Artificial Sequence: Synthetic polypeptide
  VH of XENP018450

SEQ ID NO: 19803 - protein, 5 aa, Artificial Sequence
  Description of Artificial Sequence: Synthetic peptide
  XENP018450 vhCDR1
NYWMN

SEQ ID NO: 19804 - protein, 19 aa, Artificial Sequence
  Description of Artificial Sequence: Synthetic peptide
  XENP018450 vhCDR2
EIRLKSNNYATHYAEPVKG

SEQ ID NO: 19805 - protein, 11 aa, Artificial Sequence
  Description of Artificial Sequence: Synthetic peptide
  XENP018450 vhCDR3
YYGNYGGYFDV

SEQ ID NO: 19806 - protein, 214 aa, Artificial Sequence
  Description of Artificial Sequence: Synthetic polypeptide
  XENP018450 1G6_H1_L1.103_IgG1_PVA_/S267K Light Chain
SIVMTQSPATLSVSPGERATLSCRASQSVSNDVAWYQQKPGQSPRLLINYASHRYTGVPDRFTGSGYGTEFTLTISSVQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 19807 - protein, 107 aa, Artificial Sequence; identical to SEQ ID NO: 14097
  Description of Artificial Sequence: Synthetic polypeptide
  VL of XENP018450

SEQ ID NO: 19808 - protein, 11 aa, Artificial Sequence
  Description of Artificial Sequence: Synthetic peptide
  XENP018450 vlCDR1
RASQSVSNDVA

SEQ ID NO: 19809 - protein, 7 aa, Artificial Sequence
  Description of Artificial Sequence: Synthetic peptide
  XENP018450 vlCDR2
YASHRYT

SEQ ID NO: 19810 - protein, 9 aa, Artificial Sequence
  Description of Artificial Sequence: Synthetic peptide
  XENP018450 vlCDR3
QQDYSSPRT

SEQ ID NO: 19811 - protein, 451 aa, Artificial Sequence; identical to SEQ ID NO: 16221
  Description of Artificial Sequence: Synthetic polypeptide
  XENP018451 1G6_H1_L1.104_IgG1_PVA_/S267K Heavy Chain

SEQ ID NO: 19812 - protein, 122 aa, Artificial Sequence; identical to SEQ ID NO: 10922
  Description of Artificial Sequence: Synthetic polypeptide
  VH of XENP018451

SEQ ID NO: 19813 - protein, 5 aa, Artificial Sequence
  Description of Artificial Sequence: Synthetic peptide
  XENP018451 vhCDR1
NYWMN

SEQ ID NO: 19814 - protein, 19 aa, Artificial Sequence
  Description of Artificial Sequence: Synthetic peptide
  XENP018451 vhCDR2
EIRLKSNNYATHYAEPVKG

SEQ ID NO: 19815 - protein, 11 aa, Artificial Sequence
  Description of Artificial Sequence: Synthetic peptide
  XENP018451 vhCDR3
YYGNYGGYFDV

SEQ ID NO: 19816 - protein, 214 aa, Artificial Sequence
  Description of Artificial Sequence: Synthetic polypeptide
  XENP018451 1G6_H1_L1.104_IgG1_PVA_/S267K Light Chain
SIVMTQSPATLSVSPGERATLSCRASQSVSNDVAWYQQKPGQSPRLLINYASHRYTGVPDRFTGSGYGTEFTLTISSLQAEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 19817 - protein, 107 aa, Artificial Sequence; identical to SEQ ID NO: 14106
  Description of Artificial Sequence: Synthetic polypeptide
  VL of XENP018451

SEQ ID NO: 19818 - protein, 11 aa, Artificial Sequence
  Description of Artificial Sequence: Synthetic peptide
  XENP018451 vlCDR1
RASQSVSNDVA

SEQ ID NO: 19819 - protein, 7 aa, Artificial Sequence
  Description of Artificial Sequence: Synthetic peptide
  XENP018451 vlCDR2
YASHRYT

SEQ ID NO: 19820 - protein, 9 aa, Artificial Sequence
  Description of Artificial Sequence: Synthetic peptide
  XENP018451 vlCDR3
QQDYSSPRT

SEQ ID NO: 19821 - protein, 451 aa, Artificial Sequence; identical to SEQ ID NO: 16221
  Description of Artificial Sequence: Synthetic polypeptide
  XENP018452 1G6_H1_L1.105_IgG1_PVA_/S267K Heavy Chain

SEQ ID NO: 19822 - protein, 122 aa, Artificial Sequence; identical to SEQ ID NO: 10922
  Description of Artificial Sequence: Synthetic polypeptide
  VH of XENP018452

SEQ ID NO: 19823 - protein, 5 aa, Artificial Sequence
  Description of Artificial Sequence: Synthetic peptide
  XENP018452 vhCDR1
NYWMN

SEQ ID NO: 19824 - protein, 19 aa, Artificial Sequence
  Description of Artificial Sequence: Synthetic peptide
  XENP018452 vhCDR2
EIRLKSNNYATHYAEPVKG

SEQ ID NO: 19825 - protein, 11 aa, Artificial Sequence
  Description of Artificial Sequence: Synthetic peptide
  XENP018452 vhCDR3
YYGNYGGYFDV

SEQ ID NO: 19826 - protein, 214 aa, Artificial Sequence
  Description of Artificial Sequence: Synthetic polypeptide
  XENP018452 1G6_H1_L1.105_IgG1_PVA_/S267K Light Chain
SIVMTQSPATLSVSPGERATLSCRASQSVSNDVAWYQQKPGQSPRLLINYASHRYTGVPDRFTGSGYGTEFTLTISSLQSEDLAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 19827 - protein, 107 aa, Artificial Sequence; identical to SEQ ID NO: 14115
  Description of Artificial Sequence: Synthetic polypeptide
  VL of XENP018452

SEQ ID NO: 19828 - protein, 11 aa, Artificial Sequence
  Description of Artificial Sequence: Synthetic peptide
  XENP018452 vlCDR1
RASQSVSNDVA

SEQ ID NO: 19829 - protein, 7 aa, Artificial Sequence
  Description of Artificial Sequence: Synthetic peptide
  XENP018452 vlCDR2
YASHRYT

SEQ ID NO: 19830 - protein, 9 aa, Artificial Sequence
  Description of Artificial Sequence: Synthetic peptide
  XENP018452 vlCDR3
QQDYSSPRT

SEQ ID NO: 19831 - protein, 451 aa, Artificial Sequence; identical to SEQ ID NO: 16221
  Description of Artificial Sequence: Synthetic polypeptide
  XENP018453 1G6_H1_L1.106_IgG1_PVA_/S267K Heavy Chain

SEQ ID NO: 19832 - protein, 122 aa, Artificial Sequence; identical to SEQ ID NO: 10922
  Description of Artificial Sequence: Synthetic polypeptide
  VH of XENP018453

SEQ ID NO: 19833 - protein, 5 aa, Artificial Sequence
  Description of Artificial Sequence: Synthetic peptide
  XENP018453 vhCDR1
NYWMN

SEQ ID NO: 19834 - protein, 19 aa, Artificial Sequence
  Description of Artificial Sequence: Synthetic peptide
  XENP018453 vhCDR2
EIRLKSNNYATHYAEPVKG

SEQ ID NO: 19835 - protein, 11 aa, Artificial Sequence
  Description of Artificial Sequence: Synthetic peptide
  XENP018453 vhCDR3
YYGNYGGYFDV

SEQ ID NO: 19836 - protein, 214 aa, Artificial Sequence
  Description of Artificial Sequence: Synthetic polypeptide
  XENP018453 1G6_H1_L1.106_IgG1_PVA_/S267K Light Chain
SIVMTQSPATLSVSPGERATLSCRASQSVSNDVAWYQQKPGQSPRLLINYASHRYTGVPDRFTGSGYGTEFTLTISSLQSEDFAVYYCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 19837 - protein, 107 aa, Artificial Sequence; identical to SEQ ID NO: 14124
  Description of Artificial Sequence: Synthetic polypeptide
  VL of XENP018453

SEQ ID NO: 19838 - protein, 11 aa, Artificial Sequence
  Description of Artificial Sequence: Synthetic peptide
  XENP018453 vlCDR1
RASQSVSNDVA

SEQ ID NO: 19839 - protein, 7 aa, Artificial Sequence
  Description of Artificial Sequence: Synthetic peptide
  XENP018453 vlCDR2
YASHRYT

SEQ ID NO: 19840 - protein, 9 aa, Artificial Sequence
  Description of Artificial Sequence: Synthetic peptide
  XENP018453 vlCDR3
QQDYSSPRT

SEQ ID NO: 19841 - protein, 451 aa, Artificial Sequence; identical to SEQ ID NO: 16221
  Description of Artificial Sequence: Synthetic polypeptide
  XENP018454 1G6_H1_L1.107_IgG1_PVA_/S267K Heavy Chain

SEQ ID NO: 19842 - protein, 122 aa, Artificial Sequence; identical to SEQ ID NO: 10922
  Description of Artificial Sequence: Synthetic polypeptide
  VH of XENP018454

SEQ ID NO: 19843 - protein, 5 aa, Artificial Sequence
  Description of Artificial Sequence: Synthetic peptide
  XENP018454 vhCDR1
NYWMN

SEQ ID NO: 19844 - protein, 19 aa, Artificial Sequence
  Description of Artificial Sequence: Synthetic peptide
  XENP018454 vhCDR2
EIRLKSNNYATHYAEPVKG

SEQ ID NO: 19845 - protein, 11 aa, Artificial Sequence
  Description of Artificial Sequence: Synthetic peptide
  XENP018454 vhCDR3
YYGNYGGYFDV

SEQ ID NO: 19846 - protein, 214 aa, Artificial Sequence
  Description of Artificial Sequence: Synthetic polypeptide
  XENP018454 1G6_H1_L1.107_IgG1_PVA_/S267K Light Chain
SIVMTQSPATLSVSPGERATLSCRASQSVSNDVAWYQQKPGQSPRLLINYASHRYTGVPDRFTGSGYGTEFTLTISSLQSEDFAVYFCQQQYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 19847 - protein, 107 aa, Artificial Sequence; identical to SEQ ID NO: 14133
  Description of Artificial Sequence: Synthetic polypeptide
  VL of XENP018454

SEQ ID NO: 19848 - protein, 11 aa, Artificial Sequence
  Description of Artificial Sequence: Synthetic peptide
  XENP018454 vlCDR1
RASQSVSNDVA

SEQ ID NO: 19849 - protein, 7 aa, Artificial Sequence
  Description of Artificial Sequence: Synthetic peptide
  XENP018454 vlCDR2
YASHRYT

SEQ ID NO: 19850 - protein, 9 aa, Artificial Sequence
  Description of Artificial Sequence: Synthetic peptide
  XENP018454 vlCDR3
QQQYSSPRT

SEQ ID NO: 19851 - protein, 451 aa, Artificial Sequence; identical to SEQ ID NO: 16221
  Description of Artificial Sequence: Synthetic polypeptide
  XENP018455 1G6_H1_L1.108_IgG1_PVA_/S267K Heavy Chain

SEQ ID NO: 19852 - protein, 122 aa, Artificial Sequence; identical to SEQ ID NO: 10922
  Description of Artificial Sequence: Synthetic polypeptide
  VH of XENP018455

SEQ ID NO: 19853 - protein, 5 aa, Artificial Sequence
  Description of Artificial Sequence: Synthetic peptide
  XENP018455 vhCDR1
NYWMN

SEQ ID NO: 19854 - protein, 19 aa, Artificial Sequence
  Description of Artificial Sequence: Synthetic peptide
  XENP018455 vhCDR2
EIRLKSNNYATHYAEPVKG

SEQ ID NO: 19855 - protein, 11 aa, Artificial Sequence
  Description of Artificial Sequence: Synthetic peptide
  XENP018455 vhCDR3
YYGNYGGYFDV

SEQ ID NO: 19856 - protein, 214 aa, Artificial Sequence
  Description of Artificial Sequence: Synthetic polypeptide
  XENP018455 1G6_H1_L1.108_IgG1_PVA_/S267K Light Chain
SIVMTQSPATLSVSPGERATLSCRASQSVSNDVAWYQQKPGQSPRLLINYASHRYTGVPDRFTGSGYGTEFTLTISSLQSEDFAVYFCQQEYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 19857 - protein, 107 aa, Artificial Sequence; identical to SEQ ID NO: 14142
  Description of Artificial Sequence: Synthetic polypeptide
  VL of XENP018455

SEQ ID NO: 19858 - protein, 11 aa, Artificial Sequence
  Description of Artificial Sequence: Synthetic peptide
  XENP018455 vlCDR1
RASQSVSNDVA

SEQ ID NO: 19859 - protein, 7 aa, Artificial Sequence
  Description of Artificial Sequence: Synthetic peptide
  XENP018455 vlCDR2
YASHRYT

SEQ ID NO: 19860 - protein, 9 aa, Artificial Sequence
  Description of Artificial Sequence: Synthetic peptide
  XENP018455 vlCDR3
QQEYSSPRT

SEQ ID NO: 19861 - protein, 451 aa, Artificial Sequence; identical to SEQ ID NO: 16221
  Description of Artificial Sequence: Synthetic polypeptide
  XENP018456 1G6_H1_L1.109_IgG1_PVA_/S267K Heavy Chain

SEQ ID NO: 19862 - protein, 122 aa, Artificial Sequence; identical to SEQ ID NO: 10922
  Description of Artificial Sequence: Synthetic polypeptide
  VH of XENP018456

SEQ ID NO: 19863 - protein, 5 aa, Artificial Sequence
  Description of Artificial Sequence: Synthetic peptide
  XENP018456 vhCDR1
NYWMN

SEQ ID NO: 19864 - protein, 19 aa, Artificial Sequence
  Description of Artificial Sequence: Synthetic peptide
  XENP018456 vhCDR2
EIRLKSNNYATHYAEPVKG

SEQ ID NO: 19865 - protein, 11 aa, Artificial Sequence
  Description of Artificial Sequence: Synthetic peptide
  XENP018456 vhCDR3
YYGNYGGYFDV

SEQ ID NO: 19866 - protein, 214 aa, Artificial Sequence
  Description of Artificial Sequence: Synthetic polypeptide
  XENP018456 1G6_H1_L1.109_IgG1_PVA_/S267K Light Chain
SIVMTQSPATLSVSPGERATLSCRASQSVSNDVAWYQQKPGQSPRLLINYASHRYTGVPDRFTGSGYGTEFTLTISSLQSEDFAVYFCQQHYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 19867 - protein, 107 aa, Artificial Sequence; identical to SEQ ID NO: 14151
  Description of Artificial Sequence: Synthetic polypeptide
  VL of XENP018456

SEQ ID NO: 19868 - protein, 11 aa, Artificial Sequence
  Description of Artificial Sequence: Synthetic peptide
  XENP018456 vlCDR1
RASQSVSNDVA

SEQ ID NO: 19869 - protein, 7 aa, Artificial Sequence
  Description of Artificial Sequence: Synthetic peptide
  XENP018456 vlCDR2
YASHRYT

SEQ ID NO: 19870 - protein, 9 aa, Artificial Sequence
  Description of Artificial Sequence: Synthetic peptide
  XENP018456 vlCDR3
QQHYSSPRT

SEQ ID NO: 19871 - protein, 451 aa, Artificial Sequence; identical to SEQ ID NO: 16221
  Description of Artificial Sequence: Synthetic polypeptide
  XENP018457 1G6_H1_L1.110_IgG1_PVA_/S267K Heavy Chain

SEQ ID NO: 19872 - protein, 122 aa, Artificial Sequence; identical to SEQ ID NO: 10922
  Description of Artificial Sequence: Synthetic polypeptide
  VH of XENP018457

SEQ ID NO: 19873 - protein, 5 aa, Artificial Sequence
  Description of Artificial Sequence: Synthetic peptide
  XENP018457 vhCDR1
NYWMN

SEQ ID NO: 19874 - protein, 19 aa, Artificial Sequence
  Description of Artificial Sequence: Synthetic peptide
  XENP018457 vhCDR2
EIRLKSNNYATHYAEPVKG

SEQ ID NO: 19875 - protein, 11 aa, Artificial Sequence
  Description of Artificial Sequence: Synthetic peptide
  XENP018457 vhCDR3
YYGNYGGYFDV

SEQ ID NO: 19876 - protein, 214 aa, Artificial Sequence
  Description of Artificial Sequence: Synthetic polypeptide
  XENP018457 1G6_H1_L1.110_IgG1_PVA_/S267K Light Chain
SIVMTQSPATLSVSPGERATLSCRASQSVSNDVAWYQQKPGQSPRLLINYASHRYTGVPDRFTGSGYGTEFTLTISSLQSEDFAVYFCQQSYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 19877 - protein, 107 aa, Artificial Sequence; identical to SEQ ID NO: 14160
  Description of Artificial Sequence: Synthetic polypeptide
  VL of XENP018457

SEQ ID NO: 19878 - protein, 11 aa, Artificial Sequence
  Description of Artificial Sequence: Synthetic peptide
  XENP018457 vlCDR1
RASQSVSNDVA

SEQ ID NO: 19879 - protein, 7 aa, Artificial Sequence
  Description of Artificial Sequence: Synthetic peptide
  XENP018457 vlCDR2
YASHRYT

SEQ ID NO: 19880 - protein, 9 aa, Artificial Sequence
  Description of Artificial Sequence: Synthetic peptide
  XENP018457 vlCDR3
QQSYSSPRT

SEQ ID NO: 19881 - protein, 451 aa, Artificial Sequence; identical to SEQ ID NO: 16221
  Description of Artificial Sequence: Synthetic polypeptide
  XENP018458 1G6_H1_L1.111_IgG1_PVA_/S267K Heavy Chain

SEQ ID NO: 19882 - protein, 122 aa, Artificial Sequence; identical to SEQ ID NO: 10922
  Description of Artificial Sequence: Synthetic polypeptide
  VH of XENP018458

SEQ ID NO: 19883 - protein, 5 aa, Artificial Sequence
  Description of Artificial Sequence: Synthetic peptide
  XENP018458 vhCDR1
NYWMN

SEQ ID NO: 19884 - protein, 19 aa, Artificial Sequence
  Description of Artificial Sequence: Synthetic peptide
  XENP018458 vhCDR2
EIRLKSNNYATHYAEPVKG

SEQ ID NO: 19885 - protein, 11 aa, Artificial Sequence
  Description of Artificial Sequence: Synthetic peptide
  XENP018458 vhCDR3
YYGNYGGYFDV

SEQ ID NO: 19886 - protein, 214 aa, Artificial Sequence
  Description of Artificial Sequence: Synthetic polypeptide
  XENP018458 1G6_H1_L1.111_IgG1_PVA_/S267K Light Chain
SIVMTQSPATLSVSPGERATLSCRASQSVSNDVAWYQQKPGQSPRLLINYASHRYTGVPDRFTGSGYGTEFTLTISSLQSEDFAVYFCQQRYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 19887 - protein, 107 aa, Artificial Sequence; identical to SEQ ID NO: 14169
  Description of Artificial Sequence: Synthetic polypeptide
  VL of XENP018458

SEQ ID NO: 19888 - protein, 11 aa, Artificial Sequence
  Description of Artificial Sequence: Synthetic peptide
  XENP018458 vlCDR1
RASQSVSNDVA

SEQ ID NO: 19889 - protein, 7 aa, Artificial Sequence
  Description of Artificial Sequence: Synthetic peptide
  XENP018458 vlCDR2
YASHRYT

SEQ ID NO: 19890 - protein, 9 aa, Artificial Sequence
  Description of Artificial Sequence: Synthetic peptide
  XENP018458 vlCDR3
QQRYSSPRT

SEQ ID NO: 19891 - protein, 451 aa, Artificial Sequence; identical to SEQ ID NO: 16221
  Description of Artificial Sequence: Synthetic polypeptide
  XENP018459 1G6_H1_L1.112_IgG1_PVA_/S267K Heavy Chain

SEQ ID NO: 19892 - protein, 122 aa, Artificial Sequence; identical to SEQ ID NO: 10922
  Description of Artificial Sequence: Synthetic polypeptide
  VH of XENP018459

SEQ ID NO: 19893 - protein, 5 aa, Artificial Sequence
  Description of Artificial Sequence: Synthetic peptide
  XENP018459 vhCDR1
NYWMN

SEQ ID NO: 19894 - protein, 19 aa, Artificial Sequence
  Description of Artificial Sequence: Synthetic peptide
  XENP018459 vhCDR2
EIRLKSNNYATHYAEPVKG

SEQ ID NO: 19895 - protein, 11 aa, Artificial Sequence
  Description of Artificial Sequence: Synthetic peptide
  XENP018459 vhCDR3
YYGNYGGYFDV

SEQ ID NO: 19896 - protein, 214 aa, Artificial Sequence
  Description of Artificial Sequence: Synthetic polypeptide
  XENP018459 1G6_H1_L1.112_IgG1_PVA_/S267K Light Chain
SIVMTQSPATLSVSPGERATLSCRASQSVSNDVAWYQQKPGQSPRLLINYASHRYTGVPDRFTGSGYGTEFTLTISSLQSEDFAVYFCQQLYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 19897 - protein, 107 aa, Artificial Sequence; identical to SEQ ID NO: 14178
  Description of Artificial Sequence: Synthetic polypeptide
  VL of XENP018459

SEQ ID NO: 19898 - protein, 11 aa, Artificial Sequence
  Description of Artificial Sequence: Synthetic peptide
  XENP018459 vlCDR1
RASQSVSNDVA

SEQ ID NO: 19899 - protein, 7 aa, Artificial Sequence
  Description of Artificial Sequence: Synthetic peptide
  XENP018459 vlCDR2
YASHRYT

SEQ ID NO: 19900 - protein, 9 aa, Artificial Sequence
  Description of Artificial Sequence: Synthetic peptide
  XENP018459 vlCDR3
QQLYSSPRT

SEQ ID NO: 19901 - protein, 451 aa, Artificial Sequence; identical to SEQ ID NO: 16221
  Description of Artificial Sequence: Synthetic polypeptide
  XENP018460 1G6_H1_L1.113_IgG1_PVA_/S267K Heavy Chain

SEQ ID NO: 19902 - protein, 122 aa, Artificial Sequence; identical to SEQ ID NO: 10922
  Description of Artificial Sequence: Synthetic polypeptide
  VH of XENP018460

SEQ ID NO: 19903 - protein, 5 aa, Artificial Sequence
  Description of Artificial Sequence: Synthetic peptide
  XENP018460 vhCDR1
NYWMN

SEQ ID NO: 19904 - protein, 19 aa, Artificial Sequence
  Description of Artificial Sequence: Synthetic peptide
  XENP018460 vhCDR2
EIRLKSNNYATHYAEPVKG

SEQ ID NO: 19905 - protein, 11 aa, Artificial Sequence
  Description of Artificial Sequence: Synthetic peptide
  XENP018460 vhCDR3
YYGNYGGYFDV

SEQ ID NO: 19906 - protein, 214 aa, Artificial Sequence
  Description of Artificial Sequence: Synthetic polypeptide
  XENP018460 1G6_H1_L1.113_IgG1_PVA_/S267K Light Chain
SIVMTQSPATLSVSPGERATLSCRASQSVSNDVAWYQQKPGQSPRLLINYASHRYTGVPDRFTGSGYGTEFTLTISSLQSEDFAVYFCQQTYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 19907 - protein, 107 aa, Artificial Sequence; identical to SEQ ID NO: 14187
  Description of Artificial Sequence: Synthetic polypeptide
  VL of XENP018460

SEQ ID NO: 19908 - protein, 11 aa, Artificial Sequence
  Description of Artificial Sequence: Synthetic peptide
  XENP018460 vlCDR1
RASQSVSNDVA

SEQ ID NO: 19909 - protein, 7 aa, Artificial Sequence
  Description of Artificial Sequence: Synthetic peptide
  XENP018460 vlCDR2
YASHRYT

SEQ ID NO: 19910 - protein, 9 aa, Artificial Sequence
  Description of Artificial Sequence: Synthetic peptide
  XENP018460 vlCDR3
QQTYSSPRT

SEQ ID NO: 19911 - protein, 451 aa, Artificial Sequence; identical to SEQ ID NO: 16221
  Description of Artificial Sequence: Synthetic polypeptide
  XENP018461 1G6_H1_L1.114_IgG1_PVA_/S267K Heavy Chain

SEQ ID NO: 19912 - protein, 122 aa, Artificial Sequence; identical to SEQ ID NO: 10922
  Description of Artificial Sequence: Synthetic polypeptide
  VH of XENP018461

SEQ ID NO: 19913 - protein, 5 aa, Artificial Sequence
  Description of Artificial Sequence: Synthetic peptide
  XENP018461 vhCDR1
NYWMN

SEQ ID NO: 19914 - protein, 19 aa, Artificial Sequence
  Description of Artificial Sequence: Synthetic peptide
  XENP018461 vhCDR2
EIRLKSNNYATHYAEPVKG

SEQ ID NO: 19915 - protein, 11 aa, Artificial Sequence
  Description of Artificial Sequence: Synthetic peptide
  XENP018461 vhCDR3
YYGNYGGYFDV

SEQ ID NO: 19916 - protein, 214 aa, Artificial Sequence
  Description of Artificial Sequence: Synthetic polypeptide
  XENP018461 1G6_H1_L1.114_IgG1_PVA_/S267K Light Chain
SIVMTQSPATLSVSPGERATLSCRASQSVSNDVAWYQQKPGQSPRLLINYASHRYTGVPDRFTGSGYGTEFTLTISSLQSEDFAVYFCQQGYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 19917 - protein, 107 aa, Artificial Sequence; identical to SEQ ID NO: 14196
  Description of Artificial Sequence: Synthetic polypeptide
  VL of XENP018461

SEQ ID NO: 19918 - protein, 11 aa, Artificial Sequence
  Description of Artificial Sequence: Synthetic peptide
  XENP018461 vlCDR1
RASQSVSNDVA

SEQ ID NO: 19919 - protein, 7 aa, Artificial Sequence
  Description of Artificial Sequence: Synthetic peptide
  XENP018461 vlCDR2
YASHRYT

SEQ ID NO: 19920 - protein, 9 aa, Artificial Sequence
  Description of Artificial Sequence: Synthetic peptide
  XENP018461 vlCDR3
QQGYSSPRT

SEQ ID NO: 19921 - protein, 451 aa, Artificial Sequence; identical to SEQ ID NO: 16221
  Description of Artificial Sequence: Synthetic polypeptide
  XENP018462 1G6_H1_L1.115_IgG1_PVA_/S267K Heavy Chain

SEQ ID NO: 19922 - protein, 122 aa, Artificial Sequence; identical to SEQ ID NO: 10922
  Description of Artificial Sequence: Synthetic polypeptide
  VH of XENP018462

SEQ ID NO: 19923 - protein, 5 aa, Artificial Sequence
  Description of Artificial Sequence: Synthetic peptide
  XENP018462 vhCDR1
NYWMN

SEQ ID NO: 19924 - protein, 19 aa, Artificial Sequence
  Description of Artificial Sequence: Synthetic peptide
  XENP018462 vhCDR2
EIRLKSNNYATHYAEPVKG

SEQ ID NO: 19925 - protein, 11 aa, Artificial Sequence
  Description of Artificial Sequence: Synthetic peptide
  XENP018462 vhCDR3
YYGNYGGYFDV

SEQ ID NO: 19926 - protein, 214 aa, Artificial Sequence
  Description of Artificial Sequence: Synthetic polypeptide
  XENP018462 1G6_H1_L1.115_IgG1_PVA_/S267K Light Chain
SIVMTQSPATLSVSPGERATLSCRASQSVSNDVAWYQQKPGQSPRLLINYASHRYTGVPDRFTGSGYGTEFTLTISSLQSEDFAVYFCQQYYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 19927 - protein, 107 aa, Artificial Sequence; identical to SEQ ID NO: 14205
  Description of Artificial Sequence: Synthetic polypeptide
  VL of XENP018462

SEQ ID NO: 19928 - protein, 11 aa, Artificial Sequence
  Description of Artificial Sequence: Synthetic peptide
  XENP018462 vlCDR1
RASQSVSNDVA

SEQ ID NO: 19929 - protein, 7 aa, Artificial Sequence
  Description of Artificial Sequence: Synthetic peptide
  XENP018462 vlCDR2
YASHRYT

SEQ ID NO: 19930 - protein, 9 aa, Artificial Sequence
  Description of Artificial Sequence: Synthetic peptide
  XENP018462 vlCDR3
QQYYSSPRT

SEQ ID NO: 19931 - protein, 451 aa, Artificial Sequence; identical to SEQ ID NO: 16221
  Description of Artificial Sequence: Synthetic polypeptide
  XENP018463 1G6_H1_L1.116_IgG1_PVA_/S267K Heavy Chain

SEQ ID NO: 19932 - protein, 122 aa, Artificial Sequence; identical to SEQ ID NO: 10922
  Description of Artificial Sequence: Synthetic polypeptide
  VH of XENP018463

SEQ ID NO: 19933 - protein, 5 aa, Artificial Sequence
  Description of Artificial Sequence: Synthetic peptide
  XENP018463 vhCDR1
NYWMN

SEQ ID NO: 19934 - protein, 19 aa, Artificial Sequence
  Description of Artificial Sequence: Synthetic peptide
  XENP018463 vhCDR2
EIRLKSNNYATHYAEPVKG

SEQ ID NO: 19935 - protein, 11 aa, Artificial Sequence
  Description of Artificial Sequence: Synthetic peptide
  XENP018463 vhCDR3
YYGNYGGYFDV

SEQ ID NO: 19936 - protein, 214 aa, Artificial Sequence
  Description of Artificial Sequence: Synthetic polypeptide
  XENP018463 1G6_H1_L1.116_IgG1_PVA_/S267K Light Chain
SIVMTQSPATLSVSPGERATLSCRASQSVSNDVAWYQQKPGQSPRLLINYASHRYTGVPDRFTGSGYGTEFTLTISSLQSEDFAVYFCQQDFSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 19937 - protein, 107 aa, Artificial Sequence; identical to SEQ ID NO: 14214
  Description of Artificial Sequence: Synthetic polypeptide
  VL of XENP018463

SEQ ID NO: 19938 - protein, 11 aa, Artificial Sequence
  Description of Artificial Sequence: Synthetic peptide
  XENP018463 vlCDR1
RASQSVSNDVA

SEQ ID NO: 19939 - protein, 7 aa, Artificial Sequence
  Description of Artificial Sequence: Synthetic peptide
  XENP018463 vlCDR2
YASHRYT

SEQ ID NO: 19940 - protein, 9 aa, Artificial Sequence
  Description of Artificial Sequence: Synthetic peptide
  XENP018463 vlCDR3
QQDFSSPRT

SEQ ID NO: 19941 - protein, 451 aa, Artificial Sequence; identical to SEQ ID NO: 16221
  Description of Artificial Sequence: Synthetic polypeptide
  XENP018464 1G6_H1_L1.117_IgG1_PVA_/S267K Heavy Chain

SEQ ID NO: 19942 - protein, 122 aa, Artificial Sequence; identical to SEQ ID NO: 10922
  Description of Artificial Sequence: Synthetic polypeptide
  VH of XENP018464

SEQ ID NO: 19943 - protein, 5 aa, Artificial Sequence
  Description of Artificial Sequence: Synthetic peptide
  XENP018464 vhCDR1
NYWMN

SEQ ID NO: 19944 - protein, 19 aa, Artificial Sequence
  Description of Artificial Sequence: Synthetic peptide
  XENP018464 vhCDR2
EIRLKSNNYATHYAEPVKG

SEQ ID NO: 19945 - protein, 11 aa, Artificial Sequence
  Description of Artificial Sequence: Synthetic peptide
  XENP018464 vhCDR3
YYGNYGGYFDV

SEQ ID NO: 19946 - protein, 214 aa, Artificial Sequence
  Description of Artificial Sequence: Synthetic polypeptide
  XENP018464 1G6_H1_L1.117_IgG1_PVA_/S267K Light Chain
SIVMTQSPATLSVSPGERATLSCRASQSVSNDVAWYQQKPGQSPRLLINYASHRYTGVPDRFTGSGYGTEFTLTISSLQSEDFAVYFCQQDHSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 19947 - protein, 107 aa, Artificial Sequence; identical to SEQ ID NO: 14223
  Description of Artificial Sequence: Synthetic polypeptide
  VL of XENP018464

SEQ ID NO: 19948 - protein, 11 aa, Artificial Sequence
  Description of Artificial Sequence: Synthetic peptide
  XENP018464 vlCDR1
RASQSVSNDVA

SEQ ID NO: 19949 - protein, 7 aa, Artificial Sequence
  Description of Artificial Sequence: Synthetic peptide
  XENP018464 vlCDR2
YASHRYT

SEQ ID NO: 19950 - protein, 9 aa, Artificial Sequence
  Description of Artificial Sequence: Synthetic peptide
  XENP018464 vlCDR3
QQDHSSPRT

SEQ ID NO: 19951 - protein, 451 aa, Artificial Sequence; identical to SEQ ID NO: 16221
  Description of Artificial Sequence: Synthetic polypeptide
  XENP018465 1G6_H1_L1.118_IgG1_PVA_/S267K Heavy Chain

SEQ ID NO: 19952 - protein, 122 aa, Artificial Sequence; identical to SEQ ID NO: 10922
  Description of Artificial Sequence: Synthetic polypeptide
  VH of XENP018465

SEQ ID NO: 19953 - protein, 5 aa, Artificial Sequence
  Description of Artificial Sequence: Synthetic peptide
  XENP018465 vhCDR1
NYWMN

SEQ ID NO: 19954 - protein, 19 aa, Artificial Sequence
  Description of Artificial Sequence: Synthetic peptide
  XENP018465 vhCDR2
EIRLKSNNYATHYAEPVKG

SEQ ID NO: 19955 - protein, 11 aa, Artificial Sequence
  Description of Artificial Sequence: Synthetic peptide
  XENP018465 vhCDR3
YYGNYGGYFDV

SEQ ID NO: 19956 - protein, 214 aa, Artificial Sequence
  Description of Artificial Sequence: Synthetic polypeptide
  XENP018465 1G6_H1_L1.118_IgG1_PVA_/S267K Light Chain
SIVMTQSPATLSVSPGERATLSCRASQSVSNDVAWYQQKPGQSPRLLINYASHRYTGVPDRFTGSGYGTEFTLTISSLQSEDFAVYFCQQDLSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 19957 - protein, 107 aa, Artificial Sequence; identical to SEQ ID NO: 14232
  Description of Artificial Sequence: Synthetic polypeptide
  VL of XENP018465

SEQ ID NO: 19958 - protein, 11 aa, Artificial Sequence
  Description of Artificial Sequence: Synthetic peptide
  XENP018465 vlCDR1
RASQSVSNDVA

SEQ ID NO: 19959 - protein, 7 aa, Artificial Sequence
  Description of Artificial Sequence: Synthetic peptide
  XENP018465 vlCDR2
YASHRYT

SEQ ID NO: 19960 - protein, 9 aa, Artificial Sequence
  Description of Artificial Sequence: Synthetic peptide
  XENP018465 vlCDR3
QQDLSSPRT

SEQ ID NO: 19961 - protein, 451 aa, Artificial Sequence; identical to SEQ ID NO: 16221
  Description of Artificial Sequence: Synthetic polypeptide
  XENP018466 1G6_H1_L1.119_IgG1_PVA_/S267K Heavy Chain

SEQ ID NO: 19962 - protein, 122 aa, Artificial Sequence; identical to SEQ ID NO: 10922
  Description of Artificial Sequence: Synthetic polypeptide
  VH of XENP018466

SEQ ID NO: 19963 - protein, 5 aa, Artificial Sequence
  Description of Artificial Sequence: Synthetic peptide
  XENP018466 vhCDR1
NYWMN

SEQ ID NO: 19964 - protein, 19 aa, Artificial Sequence
  Description of Artificial Sequence: Synthetic peptide
  XENP018466 vhCDR2
EIRLKSNNYATHYAEPVKG

SEQ ID NO: 19965 - protein, 11 aa, Artificial Sequence
  Description of Artificial Sequence: Synthetic peptide
  XENP018466 vhCDR3
YYGNYGGYFDV

SEQ ID NO: 19966 - protein, 214 aa, Artificial Sequence
  Description of Artificial Sequence: Synthetic polypeptide
  XENP018466 1G6_H1_L1.119_IgG1_PVA_/S267K Light Chain
SIVMTQSPATLSVSPGERATLSCRASQSVSNDVAWYQQKPGQSPRLLINYASHRYTGVPDRFTGSGYGTEFTLTISSLQSEDFAVYFCQQDWSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 19967 - protein, 107 aa, Artificial Sequence; identical to SEQ ID NO: 14241
  Description of Artificial Sequence: Synthetic polypeptide
  VL of XENP018466

SEQ ID NO: 19968 - protein, 11 aa, Artificial Sequence
  Description of Artificial Sequence: Synthetic peptide
  XENP018466 vlCDR1
RASQSVSNDVA

SEQ ID NO: 19969 - protein, 7 aa, Artificial Sequence
  Description of Artificial Sequence: Synthetic peptide
  XENP018466 vlCDR2
YASHRYT

SEQ ID NO: 19970 - protein, 9 aa, Artificial Sequence
  Description of Artificial Sequence: Synthetic peptide
  XENP018466 vlCDR3
QQDWSSPRT

SEQ ID NO: 19971 - protein, 451 aa, Artificial Sequence; identical to SEQ ID NO: 16221
  Description of Artificial Sequence: Synthetic polypeptide
  XENP018467 1G6_H1_L1.120_IgG1_PVA_/S267K Heavy Chain

SEQ ID NO: 19972 - protein, 122 aa, Artificial Sequence; identical to SEQ ID NO: 10922
  Description of Artificial Sequence: Synthetic polypeptide
  VH of XENP018467

SEQ ID NO: 19973 - protein, 5 aa, Artificial Sequence
  Description of Artificial Sequence: Synthetic peptide
  XENP018467 vhCDR1
NYWMN

SEQ ID NO: 19974 - protein, 19 aa, Artificial Sequence
  Description of Artificial Sequence: Synthetic peptide
  XENP018467 vhCDR2
EIRLKSNNYATHYAEPVKG

SEQ ID NO: 19975 - protein, 11 aa, Artificial Sequence
  Description of Artificial Sequence: Synthetic peptide
  XENP018467 vhCDR3
YYGNYGGYFDV

SEQ ID NO: 19976 - protein, 214 aa, Artificial Sequence
  Description of Artificial Sequence: Synthetic polypeptide
  XENP018467 1G6_H1_L1.120_IgG1_PVA_/S267K Light Chain
SIVMTQSPATLSVSPGERATLSCRASQSVSNDVAWYQQKPGQSPRLLINYASHRYTGVPDRFTGSGYGTEFTLTISSLQSEDFAVYFCQQDVSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 19977 - protein, 107 aa, Artificial Sequence; identical to SEQ ID NO: 14250
  Description of Artificial Sequence: Synthetic polypeptide
  VL of XENP018467

SEQ ID NO: 19978 - protein, 11 aa, Artificial Sequence
  Description of Artificial Sequence: Synthetic peptide
  XENP018467 vlCDR1
RASQSVSNDVA

SEQ ID NO: 19979 - protein, 7 aa, Artificial Sequence
  Description of Artificial Sequence: Synthetic peptide
  XENP018467 vlCDR2
YASHRYT

SEQ ID NO: 19980 - protein, 9 aa, Artificial Sequence
  Description of Artificial Sequence: Synthetic peptide
  XENP018467 vlCDR3
QQDVSSPRT

SEQ ID NO: 19981 - protein, 451 aa, Artificial Sequence; identical to SEQ ID NO: 16221
  Description of Artificial Sequence: Synthetic polypeptide
  XENP018468 1G6_H1_L1.121_IgG1_PVA_/S267K Heavy Chain

SEQ ID NO: 19982 - protein, 122 aa, Artificial Sequence; identical to SEQ ID NO: 10922
  Description of Artificial Sequence: Synthetic polypeptide
  VH of XENP018468

SEQ ID NO: 19983 - protein, 5 aa, Artificial Sequence
  Description of Artificial Sequence: Synthetic peptide
  XENP018468 vhCDR1
NYWMN

SEQ ID NO: 19984 - protein, 19 aa, Artificial Sequence
  Description of Artificial Sequence: Synthetic peptide
  XENP018468 vhCDR2
EIRLKSNNYATHYAEPVKG

SEQ ID NO: 19985 - protein, 11 aa, Artificial Sequence
  Description of Artificial Sequence: Synthetic peptide
  XENP018468 vhCDR3
YYGNYGGYFDV

SEQ ID NO: 19986 - protein, 214 aa, Artificial Sequence
  Description of Artificial Sequence: Synthetic polypeptide
  XENP018468 1G6_H1_L1.121_IgG1_PVA_/S267K Light Chain
SIVMTQSPATLSVSPGERATLSCRASQSVSNDVAWYQQKPGQSPRLLINYASHRYTGVPDRFTGSGYGTEFTLTISSLQSEDFAVYFCQQDASSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 19987 - protein, 107 aa, Artificial Sequence; identical to SEQ ID NO: 14259
  Description of Artificial Sequence: Synthetic polypeptide
  VL of XENP018468

SEQ ID NO: 19988 - protein, 11 aa, Artificial Sequence
  Description of Artificial Sequence: Synthetic peptide
  XENP018468 vlCDR1
RASQSVSNDVA

SEQ ID NO: 19989 - protein, 7 aa, Artificial Sequence
  Description of Artificial Sequence: Synthetic peptide
  XENP018468 vlCDR2
YASHRYT

SEQ ID NO: 19990 - protein, 9 aa, Artificial Sequence
  Description of Artificial Sequence: Synthetic peptide
  XENP018468 vlCDR3
QQDASSPRT

SEQ ID NO: 19991 - protein, 451 aa, Artificial Sequence; identical to SEQ ID NO: 16221
  Description of Artificial Sequence: Synthetic polypeptide
  XENP018469 1G6_H1_L1.122_IgG1_PVA_/S267K Heavy Chain

SEQ ID NO: 19992 - protein, 122 aa, Artificial Sequence; identical to SEQ ID NO: 10922
  Description of Artificial Sequence: Synthetic polypeptide
  VH of XENP018469

SEQ ID NO: 19993 - protein, 5 aa, Artificial Sequence
  Description of Artificial Sequence: Synthetic peptide
  XENP018469 vhCDR1
NYWMN

SEQ ID NO: 19994 - protein, 19 aa, Artificial Sequence
  Description of Artificial Sequence: Synthetic peptide
  XENP018469 vhCDR2
EIRLKSNNYATHYAEPVKG

SEQ ID NO: 19995 - protein, 11 aa, Artificial Sequence
  Description of Artificial Sequence: Synthetic peptide
  XENP018469 vhCDR3
YYGNYGGYFDV

SEQ ID NO: 19996 - protein, 214 aa, Artificial Sequence
  Description of Artificial Sequence: Synthetic polypeptide
  XENP018469 1G6_H1_L1.122_IgG1_PVA_/S267K Light Chain
SIVMTQSPATLSVSPGERATLSCRASQSVSNDVAWYQQKPGQSPRLLINYASHRYTGVPDRFTGSGYGTEFTLTISSLQSEDFAVYFCQQDQSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 19997 - protein, 107 aa, Artificial Sequence; identical to SEQ ID NO: 14268
  Description of Artificial Sequence: Synthetic polypeptide
  VL of XENP018469

SEQ ID NO: 19998 - protein, 11 aa, Artificial Sequence
  Description of Artificial Sequence: Synthetic peptide
  XENP018469 vlCDR1
RASQSVSNDVA

SEQ ID NO: 19999 - protein, 7 aa, Artificial Sequence
  Description of Artificial Sequence: Synthetic peptide
  XENP018469 vlCDR2
YASHRYT

SEQ ID NO: 20000 - protein, 9 aa, Artificial Sequence
  Description of Artificial Sequence: Synthetic peptide
  XENP018469 vlCDR3
QQDQSSPRT

SEQ ID NO: 20001 - protein, 451 aa, Artificial Sequence; identical to SEQ ID NO: 16221
  Description of Artificial Sequence: Synthetic polypeptide
  XENP018470 1G6_H1_L1.123_IgG1_PVA_/S267K Heavy Chain

SEQ ID NO: 20002 - protein, 122 aa, Artificial Sequence; identical to SEQ ID NO: 10922
  Description of Artificial Sequence: Synthetic polypeptide
  VH of XENP018470

SEQ ID NO: 20003 - protein, 5 aa, Artificial Sequence
  Description of Artificial Sequence: Synthetic peptide
  XENP018470 vhCDR1
NYWMN

SEQ ID NO: 20004 - protein, 19 aa, Artificial Sequence
  Description of Artificial Sequence: Synthetic peptide
  XENP018470 vhCDR2
EIRLKSNNYATHYAEPVKG

SEQ ID NO: 20005 - protein, 11 aa, Artificial Sequence
  Description of Artificial Sequence: Synthetic peptide
  XENP018470 vhCDR3
YYGNYGGYFDV

SEQ ID NO: 20006 - protein, 214 aa, Artificial Sequence
  Description of Artificial Sequence: Synthetic polypeptide
  XENP018470 1G6_H1_L1.123_IgG1_PVA_/S267K Light Chain
SIVMTQSPATLSVSPGERATLSCRASQSVSNDVAWYQQKPGQSPRLLINYASHRYTGVPDRFTGSGYGTEFTLTISSLQSEDFAVYFCQQDDSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 20007 - protein, 107 aa, Artificial Sequence; identical to SEQ ID NO: 14277
  Description of Artificial Sequence: Synthetic polypeptide
  VL of XENP018470

SEQ ID NO: 20008 - protein, 11 aa, Artificial Sequence
  Description of Artificial Sequence: Synthetic peptide
  XENP018470 vlCDR1
RASQSVSNDVA

SEQ ID NO: 20009 - protein, 7 aa, Artificial Sequence
  Description of Artificial Sequence: Synthetic peptide
  XENP018470 vlCDR2
YASHRYT

SEQ ID NO: 20010 - protein, 9 aa, Artificial Sequence
  Description of Artificial Sequence: Synthetic peptide
  XENP018470 vlCDR3
QQDDSSPRT

SEQ ID NO: 20011 - protein, 451 aa, Artificial Sequence; identical to SEQ ID NO: 16221
  Description of Artificial Sequence: Synthetic polypeptide
  XENP018471 1G6_H1_L1.124_IgG1_PVA_/S267K Heavy Chain

SEQ ID NO: 20012 - protein, 122 aa, Artificial Sequence; identical to SEQ ID NO: 10922
  Description of Artificial Sequence: Synthetic polypeptide
  VH of XENP018471

SEQ ID NO: 20013 - protein, 5 aa, Artificial Sequence
  Description of Artificial Sequence: Synthetic peptide
  XENP018471 vhCDR1
NYWMN

SEQ ID NO: 20014 - protein, 19 aa, Artificial Sequence
  Description of Artificial Sequence: Synthetic peptide
  XENP018471 vhCDR2
EIRLKSNNYATHYAEPVKG

SEQ ID NO: 20015 - protein, 11 aa, Artificial Sequence
  Description of Artificial Sequence: Synthetic peptide
  XENP018471 vhCDR3
YYGNYGGYFDV

SEQ ID NO: 20016 - protein, 214 aa, Artificial Sequence
  Description of Artificial Sequence: Synthetic polypeptide
  XENP018471 1G6_H1_L1.124_IgG1_PVA_/S267K Light Chain
SIVMTQSPATLSVSPGERATLSCRASQSVSNDVAWYQQKPGQSPRLLINYASHRYTGVPDRFTGSGYGTEFTLTISSLQSEDFAVYFCQQDKSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 20017 - protein, 107 aa, Artificial Sequence; identical to SEQ ID NO: 14286
  Description of Artificial Sequence: Synthetic polypeptide
  VL of XENP018471

SEQ ID NO: 20018 - protein, 11 aa, Artificial Sequence
  Description of Artificial Sequence: Synthetic peptide
  XENP018471 vlCDR1
RASQSVSNDVA

SEQ ID NO: 20019 - protein, 7 aa, Artificial Sequence
  Description of Artificial Sequence: Synthetic peptide
  XENP018471 vlCDR2
YASHRYT

SEQ ID NO: 20020 - protein, 9 aa, Artificial Sequence
  Description of Artificial Sequence: Synthetic peptide
  XENP018471 vlCDR3
QQDKSSPRT

SEQ ID NO: 20021 - protein, 451 aa, Artificial Sequence; identical to SEQ ID NO: 16221
  Description of Artificial Sequence: Synthetic polypeptide
  XENP018472 1G6_H1_L1.125_IgG1_PVA_/S267K Heavy Chain

SEQ ID NO: 20022 - protein, 122 aa, Artificial Sequence; identical to SEQ ID NO: 10922
  Description of Artificial Sequence: Synthetic polypeptide
  VH of XENP018472

SEQ ID NO: 20023 - protein, 5 aa, Artificial Sequence
  Description of Artificial Sequence: Synthetic peptide
  XENP018472 vhCDR1
NYWMN

SEQ ID NO: 20024 - protein, 19 aa, Artificial Sequence
  Description of Artificial Sequence: Synthetic peptide
  XENP018472 vhCDR2
EIRLKSNNYATHYAEPVKG

SEQ ID NO: 20025 - protein, 11 aa, Artificial Sequence
  Description of Artificial Sequence: Synthetic peptide
  XENP018472 vhCDR3
YYGNYGGYFDV

SEQ ID NO: 20026 - protein, 214 aa, Artificial Sequence
  Description of Artificial Sequence: Synthetic polypeptide
  XENP018472 1G6_H1_L1.125_IgG1_PVA_/S267K Light Chain
SIVMTQSPATLSVSPGERATLSCRASQSVSNDVAWYQQKPGQSPRLLINYASHRYTGVPDRFTGSGYGTEFTLTISSLQSEDFAVYFCQQDSSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 20027 - protein, 107 aa, Artificial Sequence; identical to SEQ ID NO: 14295
  Description of Artificial Sequence: Synthetic polypeptide
  VL of XENP018472

SEQ ID NO: 20028 - protein, 11 aa, Artificial Sequence
  Description of Artificial Sequence: Synthetic peptide
  XENP018472 vlCDR1
RASQSVSNDVA

SEQ ID NO: 20029 - protein, 7 aa, Artificial Sequence
  Description of Artificial Sequence: Synthetic peptide
  XENP018472 vlCDR2
YASHRYT

SEQ ID NO: 20030 - protein, 9 aa, Artificial Sequence
  Description of Artificial Sequence: Synthetic peptide
  XENP018472 vlCDR3
QQDSSSPRT

SEQ ID NO: 20031 - protein, 451 aa, Artificial Sequence; identical to SEQ ID NO: 16221
  Description of Artificial Sequence: Synthetic polypeptide
  XENP018473 1G6_H1_L1.126_IgG1_PVA_/S267K Heavy Chain

SEQ ID NO: 20032 - protein, 122 aa, Artificial Sequence; identical to SEQ ID NO: 10922
  Description of Artificial Sequence: Synthetic polypeptide
  VH of XENP018473

SEQ ID NO: 20033 - protein, 5 aa, Artificial Sequence
  Description of Artificial Sequence: Synthetic peptide
  XENP018473 vhCDR1
NYWMN

SEQ ID NO: 20034 - protein, 19 aa, Artificial Sequence
  Description of Artificial Sequence: Synthetic peptide
  XENP018473 vhCDR2
EIRLKSNNYATHYAEPVKG

SEQ ID NO: 20035 - protein, 11 aa, Artificial Sequence
  Description of Artificial Sequence: Synthetic peptide
  XENP018473 vhCDR3
YYGNYGGYFDV

SEQ ID NO: 20036 - protein, 214 aa, Artificial Sequence
  Description of Artificial Sequence: Synthetic polypeptide
  XENP018473 1G6_H1_L1.126_IgG1_PVA_/S267K Light Chain
SIVMTQSPATLSVSPGERATLSCRASQSVSNDVAWYQQKPGQSPRLLINYASHRYTGVPDRFTGSGYGTEFTLTISSLQSEDFAVYFCQQDGSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 20037 - protein, 107 aa, Artificial Sequence; identical to SEQ ID NO: 14304
  Description of Artificial Sequence: Synthetic polypeptide
  VL of XENP018473

SEQ ID NO: 20038 - protein, 11 aa, Artificial Sequence
  Description of Artificial Sequence: Synthetic peptide
  XENP018473 vlCDR1
RASQSVSNDVA

SEQ ID NO: 20039 - protein, 7 aa, Artificial Sequence
  Description of Artificial Sequence: Synthetic peptide
  XENP018473 vlCDR2
YASHRYT

SEQ ID NO: 20040 - protein, 9 aa, Artificial Sequence
  Description of Artificial Sequence: Synthetic peptide
  XENP018473 vlCDR3
QQDGSSPRT

SEQ ID NO: 20041 - protein, 451 aa, Artificial Sequence; identical to SEQ ID NO: 16221
  Description of Artificial Sequence: Synthetic polypeptide
  XENP018474 1G6_H1_L1.127_IgG1_PVA_/S267K Heavy Chain

SEQ ID NO: 20042 - protein, 122 aa, Artificial Sequence; identical to SEQ ID NO: 10922
  Description of Artificial Sequence: Synthetic polypeptide
  VH of XENP018474

SEQ ID NO: 20043 - protein, 5 aa, Artificial Sequence
  Description of Artificial Sequence: Synthetic peptide
  XENP018474 vhCDR1
NYWMN

SEQ ID NO: 20044 - protein, 19 aa, Artificial Sequence
  Description of Artificial Sequence: Synthetic peptide
  XENP018474 vhCDR2
EIRLKSNNYATHYAEPVKG

SEQ ID NO: 20045 - protein, 11 aa, Artificial Sequence
  Description of Artificial Sequence: Synthetic peptide
  XENP018474 vhCDR3
YYGNYGGYFDV

SEQ ID NO: 20046 - protein, 214 aa, Artificial Sequence
  Description of Artificial Sequence: Synthetic polypeptide
  XENP018474 1G6_H1_L1.127_IgG1_PVA_/S267K Light Chain
SIVMTQSPATLSVSPGERATLSCRASQSVSNDVAWYQQKPGQSPRLLINYASHRYTGVPDRFTGSGYGTEFTLTISSLQSEDFAVYFCQQDYTSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 20047 - protein, 107 aa, Artificial Sequence; identical to SEQ ID NO: 14313
  Description of Artificial Sequence: Synthetic polypeptide
  VL of XENP018474

SEQ ID NO: 20048 - protein, 11 aa, Artificial Sequence
  Description of Artificial Sequence: Synthetic peptide
  XENP018474 vlCDR1
RASQSVSNDVA

SEQ ID NO: 20049 - protein, 7 aa, Artificial Sequence
  Description of Artificial Sequence: Synthetic peptide
  XENP018474 vlCDR2
YASHRYT

SEQ ID NO: 20050 - protein, 9 aa, Artificial Sequence
  Description of Artificial Sequence: Synthetic peptide
  XENP018474 vlCDR3
QQDYTSPRT

SEQ ID NO: 20051 - protein, 451 aa, Artificial Sequence; identical to SEQ ID NO: 16221
  Description of Artificial Sequence: Synthetic polypeptide
  XENP018475 1G6_H1_L1.128_IgG1_PVA_/S267K Heavy Chain

SEQ ID NO: 20052 - protein, 122 aa, Artificial Sequence; identical to SEQ ID NO: 10922
  Description of Artificial Sequence: Synthetic polypeptide
  VH of XENP018475

SEQ ID NO: 20053 - protein, 5 aa, Artificial Sequence
  Description of Artificial Sequence: Synthetic peptide
  XENP018475 vhCDR1
NYWMN

SEQ ID NO: 20054 - protein, 19 aa, Artificial Sequence
  Description of Artificial Sequence: Synthetic peptide
  XENP018475 vhCDR2
EIRLKSNNYATHYAEPVKG

SEQ ID NO: 20055 - protein, 11 aa, Artificial Sequence
  Description of Artificial Sequence: Synthetic peptide
  XENP018475 vhCDR3
YYGNYGGYFDV

SEQ ID NO: 20056 - protein, 214 aa, Artificial Sequence
  Description of Artificial Sequence: Synthetic polypeptide
  XENP018475 1G6_H1_L1.128_IgG1_PVA_/S267K Light Chain
SIVMTQSPATLSVSPGERATLSCRASQSVSNDVAWYQQKPGQSPRLLINYASHRYTGVPDRFTGSGYGTEFTLTISSLQSEDFAVYFCQQDYASPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 20057 - protein, 107 aa, Artificial Sequence; identical to SEQ ID NO: 14322
  Description of Artificial Sequence: Synthetic polypeptide
  VL of XENP018475

SEQ ID NO: 20058 - protein, 11 aa, Artificial Sequence
  Description of Artificial Sequence: Synthetic peptide
  XENP018475 vlCDR1
RASQSVSNDVA

SEQ ID NO: 20059 - protein, 7 aa, Artificial Sequence
  Description of Artificial Sequence: Synthetic peptide
  XENP018475 vlCDR2
YASHRYT

SEQ ID NO: 20060 - protein, 9 aa, Artificial Sequence
  Description of Artificial Sequence: Synthetic peptide
  XENP018475 vlCDR3
QQDYASPRT

SEQ ID NO: 20061 - protein, 451 aa, Artificial Sequence; identical to SEQ ID NO: 16221
  Description of Artificial Sequence: Synthetic polypeptide
  XENP018476 1G6_H1_L1.129_IgG1_PVA_/S267K Heavy Chain

SEQ ID NO: 20062 - protein, 122 aa, Artificial Sequence; identical to SEQ ID NO: 10922
  Description of Artificial Sequence: Synthetic polypeptide
  VH of XENP018476

SEQ ID NO: 20063 - protein, 5 aa, Artificial Sequence
  Description of Artificial Sequence: Synthetic peptide
  XENP018476 vhCDR1
NYWMN

SEQ ID NO: 20064 - protein, 19 aa, Artificial Sequence
  Description of Artificial Sequence: Synthetic peptide
  XENP018476 vhCDR2
EIRLKSNNYATHYAEPVKG

SEQ ID NO: 20065 - protein, 11 aa, Artificial Sequence
  Description of Artificial Sequence: Synthetic peptide
  XENP018476 vhCDR3
YYGNYGGYFDV

SEQ ID NO: 20066 - protein, 214 aa, Artificial Sequence
  Description of Artificial Sequence: Synthetic polypeptide
  XENP018476 1G6_H1_L1.129_IgG1_PVA_/S267K Light Chain
SIVMTQSPATLSVSPGERATLSCRASQSVSNDVAWYQQKPGQSPRLLINYASHRYTGVPDRFTGSGYGTEFTLTISSLQSEDFAVYFCQQDYQSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 20067 - protein, 107 aa, Artificial Sequence; identical to SEQ ID NO: 14331
  Description of Artificial Sequence: Synthetic polypeptide
  VL of XENP018476

SEQ ID NO: 20068 - protein, 11 aa, Artificial Sequence
  Description of Artificial Sequence: Synthetic peptide
  XENP018476 vlCDR1
RASQSVSNDVA

SEQ ID NO: 20069 - protein, 7 aa, Artificial Sequence
  Description of Artificial Sequence: Synthetic peptide
  XENP018476 vlCDR2
YASHRYT

SEQ ID NO: 20070 - protein, 9 aa, Artificial Sequence
  Description of Artificial Sequence: Synthetic peptide
  XENP018476 vlCDR3
QQDYQSPRT

SEQ ID NO: 20071 - protein, 451 aa, Artificial Sequence; identical to SEQ ID NO: 16221
  Description of Artificial Sequence: Synthetic polypeptide
  XENP018477 1G6_H1_L1.130_IgG1_PVA_/S267K Heavy Chain

SEQ ID NO: 20072 - protein, 122 aa, Artificial Sequence; identical to SEQ ID NO: 10922
  Description of Artificial Sequence: Synthetic polypeptide
  VH of XENP018477

SEQ ID NO: 20073 - protein, 5 aa, Artificial Sequence
  Description of Artificial Sequence: Synthetic peptide
  XENP018477 vhCDR1
NYWMN

SEQ ID NO: 20074 - protein, 19 aa, Artificial Sequence
  Description of Artificial Sequence: Synthetic peptide
  XENP018477 vhCDR2
EIRLKSNNYATHYAEPVKG

SEQ ID NO: 20075 - protein, 11 aa, Artificial Sequence
  Description of Artificial Sequence: Synthetic peptide
  XENP018477 vhCDR3
YYGNYGGYFDV

SEQ ID NO: 20076 - protein, 214 aa, Artificial Sequence
  Description of Artificial Sequence: Synthetic polypeptide
  XENP018477 1G6_H1_L1.130_IgG1_PVA_/S267K Light Chain
SIVMTQSPATLSVSPGERATLSCRASQSVSNDVAWYQQKPGQSPRLLINYASHRYTGVPDRFTGSGYGTEFTLTISSLQSEDFAVYFCQQDYGSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 20077 - protein, 107 aa, Artificial Sequence; identical to SEQ ID NO: 14340
  Description of Artificial Sequence: Synthetic polypeptide
  VL of XENP018477

SEQ ID NO: 20078 - protein, 11 aa, Artificial Sequence
  Description of Artificial Sequence: Synthetic peptide
  XENP018477 vlCDR1
RASQSVSNDVA

SEQ ID NO: 20079 - protein, 7 aa, Artificial Sequence
  Description of Artificial Sequence: Synthetic peptide
  XENP018477 vlCDR2
YASHRYT

SEQ ID NO: 20080 - protein, 9 aa, Artificial Sequence
  Description of Artificial Sequence: Synthetic peptide
  XENP018477 vlCDR3
QQDYGSPRT

SEQ ID NO: 20081 - protein, 451 aa, Artificial Sequence; identical to SEQ ID NO: 16221
  Description of Artificial Sequence: Synthetic polypeptide
  XENP018478 1G6_H1_L1.131_IgG1_PVA_/S267K Heavy Chain

SEQ ID NO: 20082 - protein, 122 aa, Artificial Sequence; identical to SEQ ID NO: 10922
  Description of Artificial Sequence: Synthetic polypeptide
  VH of XENP018478

SEQ ID NO: 20083 - protein, 5 aa, Artificial Sequence
  Description of Artificial Sequence: Synthetic peptide
  XENP018478 vhCDR1
NYWMN

SEQ ID NO: 20084 - protein, 19 aa, Artificial Sequence
  Description of Artificial Sequence: Synthetic peptide
  XENP018478 vhCDR2
EIRLKSNNYATHYAEPVKG

SEQ ID NO: 20085 - protein, 11 aa, Artificial Sequence
  Description of Artificial Sequence: Synthetic peptide
  XENP018478 vhCDR3
YYGNYGGYFDV

SEQ ID NO: 20086 - protein, 214 aa, Artificial Sequence
  Description of Artificial Sequence: Synthetic polypeptide
  XENP018478 1G6_H1_L1.131_IgG1_PVA_/S267K Light Chain
SIVMTQSPATLSVSPGERATLSCRASQSVSNDVAWYQQKPGQSPRLLINYASHRYTGVPDRFTGSGYGTEFTLTISSLQSEDFAVYFCQQDYVSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 20087 - protein, 107 aa, Artificial Sequence; identical to SEQ ID NO: 14349
  Description of Artificial Sequence: Synthetic polypeptide
  VL of XENP018478

SEQ ID NO: 20088 - protein, 11 aa, Artificial Sequence
  Description of Artificial Sequence: Synthetic peptide
  XENP018478 vlCDR1
RASQSVSNDVA

SEQ ID NO: 20089 - protein, 7 aa, Artificial Sequence
  Description of Artificial Sequence: Synthetic peptide
  XENP018478 vlCDR2
YASHRYT

SEQ ID NO: 20090 - protein, 9 aa, Artificial Sequence
  Description of Artificial Sequence: Synthetic peptide
  XENP018478 vlCDR3
QQDYVSPRT

SEQ ID NO: 20091 - protein, 451 aa, Artificial Sequence; identical to SEQ ID NO: 16221
  Description of Artificial Sequence: Synthetic polypeptide
  XENP018479 1G6_H1_L1.132_IgG1_PVA_/S267K Heavy Chain

SEQ ID NO: 20092 - protein, 122 aa, Artificial Sequence; identical to SEQ ID NO: 10922
  Description of Artificial Sequence: Synthetic polypeptide
  VH of XENP018479

SEQ ID NO: 20093 - protein, 5 aa, Artificial Sequence
  Description of Artificial Sequence: Synthetic peptide
  XENP018479 vhCDR1
NYWMN

SEQ ID NO: 20094 - protein, 19 aa, Artificial Sequence
  Description of Artificial Sequence: Synthetic peptide
  XENP018479 vhCDR2
EIRLKSNNYATHYAEPVKG

SEQ ID NO: 20095 - protein, 11 aa, Artificial Sequence
  Description of Artificial Sequence: Synthetic peptide
  XENP018479 vhCDR3
YYGNYGGYFDV

SEQ ID NO: 20096 - protein, 214 aa, Artificial Sequence
  Description of Artificial Sequence: Synthetic polypeptide
  XENP018479 1G6_H1_L1.132_IgG1_PVA_/S267K Light Chain
SIVMTQSPATLSVSPGERATLSCRASQSVSNDVAWYQQKPGQSPRLLINYASHRYTGVPDRFTGSGYGTEFTLTISSLQSEDFAVYFCQQDYHSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 20097 - protein, 107 aa, Artificial Sequence; identical to SEQ ID NO: 14358
  Description of Artificial Sequence: Synthetic polypeptide
  VL of XENP018479

SEQ ID NO: 20098 - protein, 11 aa, Artificial Sequence
  Description of Artificial Sequence: Synthetic peptide
  XENP018479 vlCDR1
RASQSVSNDVA

SEQ ID NO: 20099 - protein, 7 aa, Artificial Sequence
  Description of Artificial Sequence: Synthetic peptide
  XENP018479 vlCDR2
YASHRYT

SEQ ID NO: 20100 - protein, 9 aa, Artificial Sequence
  Description of Artificial Sequence: Synthetic peptide
  XENP018479 vlCDR3
QQDYHSPRT

SEQ ID NO: 20101 - protein, 451 aa, Artificial Sequence; identical to SEQ ID NO: 16221
  Description of Artificial Sequence: Synthetic polypeptide
  XENP018480 1G6_H1_L1.133_IgG1_PVA_/S267K Heavy Chain

SEQ ID NO: 20102 - protein, 122 aa, Artificial Sequence; identical to SEQ ID NO: 10922
  Description of Artificial Sequence: Synthetic polypeptide
  VH of XENP018480

SEQ ID NO: 20103 - protein, 5 aa, Artificial Sequence
  Description of Artificial Sequence: Synthetic peptide
  XENP018480 vhCDR1
NYWMN

SEQ ID NO: 20104 - protein, 19 aa, Artificial Sequence
  Description of Artificial Sequence: Synthetic peptide
  XENP018480 vhCDR2
EIRLKSNNYATHYAEPVKG

SEQ ID NO: 20105 - protein, 11 aa, Artificial Sequence
  Description of Artificial Sequence: Synthetic peptide
  XENP018480 vhCDR3
YYGNYGGYFDV

SEQ ID NO: 20106 - protein, 214 aa, Artificial Sequence
  Description of Artificial Sequence: Synthetic polypeptide
  XENP018480 1G6_H1_L1.133_IgG1_PVA_/S267K Light Chain
SIVMTQSPATLSVSPGERATLSCRASQSVSNDVAWYQQKPGQSPRLLINYASHRYTGVPDRFTGSGYGTEFTLTISSLQSEDFAVYFCQQDYDSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 20107 - protein, 107 aa, Artificial Sequence; identical to SEQ ID NO: 14367
  Description of Artificial Sequence: Synthetic polypeptide
  VL of XENP018480

SEQ ID NO: 20108 - protein, 11 aa, Artificial Sequence
  Description of Artificial Sequence: Synthetic peptide
  XENP018480 vlCDR1
RASQSVSNDVA

SEQ ID NO: 20109 - protein, 7 aa, Artificial Sequence
  Description of Artificial Sequence: Synthetic peptide
  XENP018480 vlCDR2
YASHRYT

SEQ ID NO: 20110 - protein, 9 aa, Artificial Sequence
  Description of Artificial Sequence: Synthetic peptide
  XENP018480 vlCDR3
QQDYDSPRT

SEQ ID NO: 20111 - protein, 451 aa, Artificial Sequence; identical to SEQ ID NO: 16221
  Description of Artificial Sequence: Synthetic polypeptide
  XENP018481 1G6_H1_L1.134_IgG1_PVA_/S267K Heavy Chain

SEQ ID NO: 20112 - protein, 122 aa, Artificial Sequence; identical to SEQ ID NO: 10922
  Description of Artificial Sequence: Synthetic polypeptide
  VH of XENP018481

SEQ ID NO: 20113 - protein, 5 aa, Artificial Sequence
  Description of Artificial Sequence: Synthetic peptide
  XENP018481 vhCDR1
NYWMN

SEQ ID NO: 20114 - protein, 19 aa, Artificial Sequence
  Description of Artificial Sequence: Synthetic peptide
  XENP018481 vhCDR2
EIRLKSNNYATHYAEPVKG

SEQ ID NO: 20115 - protein, 11 aa, Artificial Sequence
  Description of Artificial Sequence: Synthetic peptide
  XENP018481 vhCDR3
YYGNYGGYFDV

SEQ ID NO: 20116 - protein, 214 aa, Artificial Sequence
  Description of Artificial Sequence: Synthetic polypeptide
  XENP018481 1G6_H1_L1.134_IgG1_PVA_/S267K Light Chain
SIVMTQSPATLSVSPGERATLSCRASQSVSNDVAWYQQKPGQSPRLLINYASHRYTGVPDRFTGSGYGTEFTLTISSLQSEDFAVYFCQQDYKSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 20117 - protein, 107 aa, Artificial Sequence; identical to SEQ ID NO: 14376
  Description of Artificial Sequence: Synthetic polypeptide
  VL of XENP018481

SEQ ID NO: 20118 - protein, 11 aa, Artificial Sequence
  Description of Artificial Sequence: Synthetic peptide
  XENP018481 vlCDR1
RASQSVSNDVA

SEQ ID NO: 20119 - protein, 7 aa, Artificial Sequence
  Description of Artificial Sequence: Synthetic peptide
  XENP018481 vlCDR2
YASHRYT

SEQ ID NO: 20120 - protein, 9 aa, Artificial Sequence
  Description of Artificial Sequence: Synthetic peptide
  XENP018481 vlCDR3
QQDYKSPRT

SEQ ID NO: 20121 - protein, 451 aa, Artificial Sequence; identical to SEQ ID NO: 16221
  Description of Artificial Sequence: Synthetic polypeptide
  XENP018482 1G6_H1_L1.135_IgG1_PVA_/S267K Heavy Chain

SEQ ID NO: 20122 - protein, 122 aa, Artificial Sequence; identical to SEQ ID NO: 10922
  Description of Artificial Sequence: Synthetic polypeptide
  VH of XENP018482

SEQ ID NO: 20123 - protein, 5 aa, Artificial Sequence
  Description of Artificial Sequence: Synthetic peptide
  XENP018482 vhCDR1
NYWMN

SEQ ID NO: 20124 - protein, 19 aa, Artificial Sequence
  Description of Artificial Sequence: Synthetic peptide
  XENP018482 vhCDR2
EIRLKSNNYATHYAEPVKG

SEQ ID NO: 20125 - protein, 11 aa, Artificial Sequence
  Description of Artificial Sequence: Synthetic peptide
  XENP018482 vhCDR3
YYGNYGGYFDV

SEQ ID NO: 20126 - protein, 214 aa, Artificial Sequence
  Description of Artificial Sequence: Synthetic polypeptide
  XENP018482 1G6_H1_L1.135_IgG1_PVA_/S267K Light Chain
SIVMTQSPATLSVSPGERATLSCRASQSVSNDVAWYQQKPGQSPRLLINYASHRYTGVPDRFTGSGYGTEFTLTISSLQSEDFAVYFCQQDYFSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 20127 - protein, 107 aa, Artificial Sequence; identical to SEQ ID NO: 14385
  Description of Artificial Sequence: Synthetic polypeptide
  VL of XENP018482

SEQ ID NO: 20128 - protein, 11 aa, Artificial Sequence
  Description of Artificial Sequence: Synthetic peptide
  XENP018482 vlCDR1
RASQSVSNDVA

SEQ ID NO: 20129 - protein, 7 aa, Artificial Sequence
  Description of Artificial Sequence: Synthetic peptide
  XENP018482 vlCDR2
YASHRYT

SEQ ID NO: 20130 - protein, 9 aa, Artificial Sequence
  Description of Artificial Sequence: Synthetic peptide
  XENP018482 vlCDR3
QQDYFSPRT

SEQ ID NO: 20131 - protein, 451 aa, Artificial Sequence; identical to SEQ ID NO: 16221
  Description of Artificial Sequence: Synthetic polypeptide
  XENP018483 1G6_H1_L1.136_IgG1_PVA_/S267K Heavy Chain

SEQ ID NO: 20132 - protein, 122 aa, Artificial Sequence; identical to SEQ ID NO: 10922
  Description of Artificial Sequence: Synthetic polypeptide
  VH of XENP018483

SEQ ID NO: 20133 - protein, 5 aa, Artificial Sequence
  Description of Artificial Sequence: Synthetic peptide
  XENP018483 vhCDR1
NYWMN

SEQ ID NO: 20134 - protein, 19 aa, Artificial Sequence
  Description of Artificial Sequence: Synthetic peptide
  XENP018483 vhCDR2
EIRLKSNNYATHYAEPVKG

SEQ ID NO: 20135 - protein, 11 aa, Artificial Sequence
  Description of Artificial Sequence: Synthetic peptide
  XENP018483 vhCDR3
YYGNYGGYFDV

SEQ ID NO: 20136 - protein, 214 aa, Artificial Sequence
  Description of Artificial Sequence: Synthetic polypeptide
  XENP018483 1G6_H1_L1.136_IgG1_PVA_/S267K Light Chain
SIVMTQSPATLSVSPGERATLSCRASQSVSNDVAWYQQKPGQSPRLLINYASHRYTGVPDRFTGSGYGTEFTLTISSLQSEDFAVYFCQQDYSTPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 20137 - protein, 107 aa, Artificial Sequence; identical to SEQ ID NO: 14394
  Description of Artificial Sequence: Synthetic polypeptide
  VL of XENP018483

SEQ ID NO: 20138 - protein, 11 aa, Artificial Sequence
  Description of Artificial Sequence: Synthetic peptide
  XENP018483 vlCDR1
RASQSVSNDVA

SEQ ID NO: 20139 - protein, 7 aa, Artificial Sequence
  Description of Artificial Sequence: Synthetic peptide
  XENP018483 vlCDR2
YASHRYT

SEQ ID NO: 20140 - protein, 9 aa, Artificial Sequence
  Description of Artificial Sequence: Synthetic peptide
  XENP018483 vlCDR3
QQDYSTPRT

SEQ ID NO: 20141 - protein, 451 aa, Artificial Sequence; identical to SEQ ID NO: 16221
  Description of Artificial Sequence: Synthetic polypeptide
  XENP018484 1G6_H1_L1.137_IgG1_PVA_/S267K Heavy Chain

SEQ ID NO: 20142 - protein, 122 aa, Artificial Sequence; identical to SEQ ID NO: 10922
  Description of Artificial Sequence: Synthetic polypeptide
  VH of XENP018484

SEQ ID NO: 20143 - protein, 5 aa, Artificial Sequence
  Description of Artificial Sequence: Synthetic peptide
  XENP018484 vhCDR1
NYWMN

SEQ ID NO: 20144 - protein, 19 aa, Artificial Sequence
  Description of Artificial Sequence: Synthetic peptide
  XENP018484 vhCDR2
EIRLKSNNYATHYAEPVKG

SEQ ID NO: 20145 - protein, 11 aa, Artificial Sequence
  Description of Artificial Sequence: Synthetic peptide
  XENP018484 vhCDR3
YYGNYGGYFDV

SEQ ID NO: 20146 - protein, 214 aa, Artificial Sequence
  Description of Artificial Sequence: Synthetic polypeptide
  XENP018484 1G6_H1_L1.137_IgG1_PVA_/S267K Light Chain
SIVMTQSPATLSVSPGERATLSCRASQSVSNDVAWYQQKPGQSPRLLINYASHRYTGVPDRFTGSGYGTEFTLTISSLQSEDFAVYFCQQDYSAPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 20147 - protein, 107 aa, Artificial Sequence; identical to SEQ ID NO: 14403
  Description of Artificial Sequence: Synthetic polypeptide
  VL of XENP018484

SEQ ID NO: 20148 - protein, 11 aa, Artificial Sequence
  Description of Artificial Sequence: Synthetic peptide
  XENP018484 vlCDR1
RASQSVSNDVA

SEQ ID NO: 20149 - protein, 7 aa, Artificial Sequence
  Description of Artificial Sequence: Synthetic peptide
  XENP018484 vlCDR2
YASHRYT

SEQ ID NO: 20150 - protein, 9 aa, Artificial Sequence
  Description of Artificial Sequence: Synthetic peptide
  XENP018484 vlCDR3
QQDYSAPRT

SEQ ID NO: 20151 - protein, 451 aa, Artificial Sequence; identical to SEQ ID NO: 16221
  Description of Artificial Sequence: Synthetic polypeptide
  XENP018485 1G6_H1_L1.138_IgG1_PVA_/S267K Heavy Chain

SEQ ID NO: 20152 - protein, 122 aa, Artificial Sequence; identical to SEQ ID NO: 10922
  Description of Artificial Sequence: Synthetic polypeptide
  VH of XENP018485

SEQ ID NO: 20153 - protein, 5 aa, Artificial Sequence
  Description of Artificial Sequence: Synthetic peptide
  XENP018485 vhCDR1
NYWMN

SEQ ID NO: 20154 - protein, 19 aa, Artificial Sequence
  Description of Artificial Sequence: Synthetic peptide
  XENP018485 vhCDR2
EIRLKSNNYATHYAEPVKG

SEQ ID NO: 20155 - protein, 11 aa, Artificial Sequence
  Description of Artificial Sequence: Synthetic peptide
  XENP018485 vhCDR3
YYGNYGGYFDV

SEQ ID NO: 20156 - protein, 214 aa, Artificial Sequence
  Description of Artificial Sequence: Synthetic polypeptide
  XENP018485 1G6_H1_L1.138_IgG1_PVA_/S267K Light Chain
SIVMTQSPATLSVSPGERATLSCRASQSVSNDVAWYQQKPGQSPRLLINYASHRYTGVPDRFTGSGYGTEFTLTISSLQSEDFAVYFCQQDYSNPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 20157 - protein, 107 aa, Artificial Sequence; identical to SEQ ID NO: 14412
  Description of Artificial Sequence: Synthetic polypeptide
  VL of XENP018485

SEQ ID NO: 20158 - protein, 11 aa, Artificial Sequence
  Description of Artificial Sequence: Synthetic peptide
  XENP018485 vlCDR1
RASQSVSNDVA

SEQ ID NO: 20159 - protein, 7 aa, Artificial Sequence
  Description of Artificial Sequence: Synthetic peptide
  XENP018485 vlCDR2
YASHRYT

SEQ ID NO: 20160 - protein, 9 aa, Artificial Sequence
  Description of Artificial Sequence: Synthetic peptide
  XENP018485 vlCDR3
QQDYSNPRT

SEQ ID NO: 20161 - protein, 451 aa, Artificial Sequence; identical to SEQ ID NO: 16221
  Description of Artificial Sequence: Synthetic polypeptide
  XENP018486 1G6_H1_L1.139_IgG1_PVA_/S267K Heavy Chain

SEQ ID NO: 20162 - protein, 122 aa, Artificial Sequence; identical to SEQ ID NO: 10922
  Description of Artificial Sequence: Synthetic polypeptide
  VH of XENP018486

SEQ ID NO: 20163 - protein, 5 aa, Artificial Sequence
  Description of Artificial Sequence: Synthetic peptide
  XENP018486 vhCDR1
NYWMN

SEQ ID NO: 20164 - protein, 19 aa, Artificial Sequence
  Description of Artificial Sequence: Synthetic peptide
  XENP018486 vhCDR2
EIRLKSNNYATHYAEPVKG

SEQ ID NO: 20165 - protein, 11 aa, Artificial Sequence
  Description of Artificial Sequence: Synthetic peptide
  XENP018486 vhCDR3
YYGNYGGYFDV

SEQ ID NO: 20166 - protein, 214 aa, Artificial Sequence
  Description of Artificial Sequence: Synthetic polypeptide
  XENP018486 1G6_H1_L1.139_IgG1_PVA_/S267K Light Chain
SIVMTQSPATLSVSPGERATLSCRASQSVSNDVAWYQQKPGQSPRLLINYASHRYTGVPDRFTGSGYGTEFTLTISSLQSEDFAVYFCQQDYSGPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 20167 - protein, 107 aa, Artificial Sequence; identical to SEQ ID NO: 14421
  Description of Artificial Sequence: Synthetic polypeptide
  VL of XENP018486

SEQ ID NO: 20168 - protein, 11 aa, Artificial Sequence
  Description of Artificial Sequence: Synthetic peptide
  XENP018486 vlCDR1
RASQSVSNDVA

SEQ ID NO: 20169 - protein, 7 aa, Artificial Sequence
  Description of Artificial Sequence: Synthetic peptide
  XENP018486 vlCDR2
YASHRYT

SEQ ID NO: 20170 - protein, 9 aa, Artificial Sequence
  Description of Artificial Sequence: Synthetic peptide
  XENP018486 vlCDR3
QQDYSGPRT

SEQ ID NO: 20171 - protein, 451 aa, Artificial Sequence; identical to SEQ ID NO: 16221
  Description of Artificial Sequence: Synthetic polypeptide
  XENP018487 1G6_H1_L1.140_IgG1_PVA_/S267K Heavy Chain

SEQ ID NO: 20172 - protein, 122 aa, Artificial Sequence; identical to SEQ ID NO: 10922
  Description of Artificial Sequence: Synthetic polypeptide
  VH of XENP018487

SEQ ID NO: 20173 - protein, 5 aa, Artificial Sequence
  Description of Artificial Sequence: Synthetic peptide
  XENP018487 vhCDR1
NYWMN

SEQ ID NO: 20174 - protein, 19 aa, Artificial Sequence
  Description of Artificial Sequence: Synthetic peptide
  XENP018487 vhCDR2
EIRLKSNNYATHYAEPVKG

SEQ ID NO: 20175 - protein, 11 aa, Artificial Sequence
  Description of Artificial Sequence: Synthetic peptide
  XENP018487 vhCDR3
YYGNYGGYFDV

SEQ ID NO: 20176 - protein, 214 aa, Artificial Sequence
  Description of Artificial Sequence: Synthetic polypeptide
  XENP018487 1G6_H1_L1.140_IgG1_PVA_/S267K Light Chain
SIVMTQSPATLSVSPGERATLSCRASQSVSNDVAWYQQKPGQSPRLLINYASHRYTGVPDRFTGSGYGTEFTLTISSLQSEDFAVYFCQQDYSVPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 20177 - protein, 107 aa, Artificial Sequence; identical to SEQ ID NO: 14430
  Description of Artificial Sequence: Synthetic polypeptide
  VL of XENP018487

SEQ ID NO: 20178 - protein, 11 aa, Artificial Sequence
  Description of Artificial Sequence: Synthetic peptide
  XENP018487 vlCDR1
RASQSVSNDVA

SEQ ID NO: 20179 - protein, 7 aa, Artificial Sequence
  Description of Artificial Sequence: Synthetic peptide
  XENP018487 vlCDR2
YASHRYT

SEQ ID NO: 20180 - protein, 9 aa, Artificial Sequence
  Description of Artificial Sequence: Synthetic peptide
  XENP018487 vlCDR3
QQDYSVPRT

SEQ ID NO: 20181 - protein, 451 aa, Artificial Sequence; identical to SEQ ID NO: 16221
  Description of Artificial Sequence: Synthetic polypeptide
  XENP018488 1G6_H1_L1.141_IgG1_PVA_/S267K Heavy Chain

SEQ ID NO: 20182 - protein, 122 aa, Artificial Sequence; identical to SEQ ID NO: 10922
  Description of Artificial Sequence: Synthetic polypeptide
  VH of XENP018488

SEQ ID NO: 20183 - protein, 5 aa, Artificial Sequence
  Description of Artificial Sequence: Synthetic peptide
  XENP018488 vhCDR1
NYWMN

SEQ ID NO: 20184 - protein, 19 aa, Artificial Sequence
  Description of Artificial Sequence: Synthetic peptide
  XENP018488 vhCDR2
EIRLKSNNYATHYAEPVKG

SEQ ID NO: 20185 - protein, 11 aa, Artificial Sequence
  Description of Artificial Sequence: Synthetic peptide
  XENP018488 vhCDR3
YYGNYGGYFDV

SEQ ID NO: 20186 - protein, 214 aa, Artificial Sequence
  Description of Artificial Sequence: Synthetic polypeptide
  XENP018488 1G6_H1_L1.141_IgG1_PVA_/S267K Light Chain
SIVMTQSPATLSVSPGERATLSCRASQSVSNDVAWYQQKPGQSPRLLINYASHRYTGVPDRFTGSGYGTEFTLTISSLQSEDFAVYFCQQDYSHPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 20187 - protein, 107 aa, Artificial Sequence; identical to SEQ ID NO: 14439
  Description of Artificial Sequence: Synthetic polypeptide
  VL of XENP018488

SEQ ID NO: 20188 - protein, 11 aa, Artificial Sequence
  Description of Artificial Sequence: Synthetic peptide
  XENP018488 vlCDR1
RASQSVSNDVA

SEQ ID NO: 20189 - protein, 7 aa, Artificial Sequence
  Description of Artificial Sequence: Synthetic peptide
  XENP018488 vlCDR2
YASHRYT

SEQ ID NO: 20190 - protein, 9 aa, Artificial Sequence
  Description of Artificial Sequence: Synthetic peptide
  XENP018488 vlCDR3
QQDYSHPRT

SEQ ID NO: 20191 - protein, 451 aa, Artificial Sequence; identical to SEQ ID NO: 16221
  Description of Artificial Sequence: Synthetic polypeptide
  XENP018489 1G6_H1_L1.142_IgG1_PVA_/S267K Heavy Chain

SEQ ID NO: 20192 - protein, 122 aa, Artificial Sequence; identical to SEQ ID NO: 10922
  Description of Artificial Sequence: Synthetic polypeptide
  VH of XENP018489

SEQ ID NO: 20193 - protein, 5 aa, Artificial Sequence
  Description of Artificial Sequence: Synthetic peptide
  XENP018489 vhCDR1
NYWMN

SEQ ID NO: 20194 - protein, 19 aa, Artificial Sequence
  Description of Artificial Sequence: Synthetic peptide
  XENP018489 vhCDR2
EIRLKSNNYATHYAEPVKG

SEQ ID NO: 20195 - protein, 11 aa, Artificial Sequence
  Description of Artificial Sequence: Synthetic peptide
  XENP018489 vhCDR3
YYGNYGGYFDV

SEQ ID NO: 20196 - protein, 214 aa, Artificial Sequence
  Description of Artificial Sequence: Synthetic polypeptide
  XENP018489 1G6_H1_L1.142_IgG1_PVA_/S267K Light Chain
SIVMTQSPATLSVSPGERATLSCRASQSVSNDVAWYQQKPGQSPRLLINYASHRYTGVPDRFTGSGYGTEFTLTISSLQSEDFAVYFCQQDYSDPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 20197 - protein, 107 aa, Artificial Sequence; identical to SEQ ID NO: 14448
  Description of Artificial Sequence: Synthetic polypeptide
  VL of XENP018489

SEQ ID NO: 20198 - protein, 11 aa, Artificial Sequence
  Description of Artificial Sequence: Synthetic peptide
  XENP018489 vlCDR1
RASQSVSNDVA

SEQ ID NO: 20199 - protein, 7 aa, Artificial Sequence
  Description of Artificial Sequence: Synthetic peptide
  XENP018489 vlCDR2
YASHRYT

SEQ ID NO: 20200 - protein, 9 aa, Artificial Sequence
  Description of Artificial Sequence: Synthetic peptide
  XENP018489 vlCDR3
QQDYSDPRT

SEQ ID NO: 20201 - protein, 451 aa, Artificial Sequence; identical to SEQ ID NO: 16221
  Description of Artificial Sequence: Synthetic polypeptide
  XENP018490 1G6_H1_L1.143_IgG1_PVA_/S267K Heavy Chain

SEQ ID NO: 20202 - protein, 122 aa, Artificial Sequence; identical to SEQ ID NO: 10922
  Description of Artificial Sequence: Synthetic polypeptide
  VH of XENP018490

SEQ ID NO: 20203 - protein, 5 aa, Artificial Sequence
  Description of Artificial Sequence: Synthetic peptide
  XENP018490 vhCDR1
NYWMN

SEQ ID NO: 20204 - protein, 19 aa, Artificial Sequence
  Description of Artificial Sequence: Synthetic peptide
  XENP018490 vhCDR2
EIRLKSNNYATHYAEPVKG

SEQ ID NO: 20205 - protein, 11 aa, Artificial Sequence
  Description of Artificial Sequence: Synthetic peptide
  XENP018490 vhCDR3
YYGNYGGYFDV

SEQ ID NO: 20206 - protein, 214 aa, Artificial Sequence
  Description of Artificial Sequence: Synthetic polypeptide
  XENP018490 1G6_H1_L1.143_IgG1_PVA_/S267K Light Chain
SIVMTQSPATLSVSPGERATLSCRASQSVSNDVAWYQQKPGQSPRLLINYASHRYTGVPDRFTGSGYGTEFTLTISSLQSEDFAVYFCQQDYSKPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 20207 - protein, 107 aa, Artificial Sequence; identical to SEQ ID NO: 14457
  Description of Artificial Sequence: Synthetic polypeptide
  VL of XENP018490

SEQ ID NO: 20208 - protein, 11 aa, Artificial Sequence
  Description of Artificial Sequence: Synthetic peptide
  XENP018490 vlCDR1
RASQSVSNDVA

SEQ ID NO: 20209 - protein, 7 aa, Artificial Sequence
  Description of Artificial Sequence: Synthetic peptide
  XENP018490 vlCDR2
YASHRYT

SEQ ID NO: 20210 - protein, 9 aa, Artificial Sequence
  Description of Artificial Sequence: Synthetic peptide
  XENP018490 vlCDR3
QQDYSKPRT

SEQ ID NO: 20211 - protein, 451 aa, Artificial Sequence; identical to SEQ ID NO: 16221
  Description of Artificial Sequence: Synthetic polypeptide
  XENP018491 1G6_H1_L1.144_IgG1_PVA_/S267K Heavy Chain

SEQ ID NO: 20212 - protein, 122 aa, Artificial Sequence; identical to SEQ ID NO: 10922
  Description of Artificial Sequence: Synthetic polypeptide
  VH of XENP018491

SEQ ID NO: 20213 - protein, 5 aa, Artificial Sequence
  Description of Artificial Sequence: Synthetic peptide
  XENP018491 vhCDR1
NYWMN

SEQ ID NO: 20214 - protein, 19 aa, Artificial Sequence
  Description of Artificial Sequence: Synthetic peptide
  XENP018491 vhCDR2
EIRLKSNNYATHYAEPVKG

SEQ ID NO: 20215 - protein, 11 aa, Artificial Sequence
  Description of Artificial Sequence: Synthetic peptide
  XENP018491 vhCDR3
YYGNYGGYFDV

SEQ ID NO: 20216 - protein, 214 aa, Artificial Sequence
  Description of Artificial Sequence: Synthetic polypeptide
  XENP018491 1G6_H1_L1.144_IgG1_PVA_/S267K Light Chain
SIVMTQSPATLSVSPGERATLSCRASQSVSNDVAWYQQKPGQSPRLLINYASHRYTGVPDRFTGSGYGTEFTLTISSLQSEDFAVYFCQQDYSFPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 20217 - protein, 107 aa, Artificial Sequence; identical to SEQ ID NO: 14466
  Description of Artificial Sequence: Synthetic polypeptide
  VL of XENP018491

SEQ ID NO: 20218 - protein, 11 aa, Artificial Sequence
  Description of Artificial Sequence: Synthetic peptide
  XENP018491 vlCDR1
RASQSVSNDVA

SEQ ID NO: 20219 - protein, 7 aa, Artificial Sequence
  Description of Artificial Sequence: Synthetic peptide
  XENP018491 vlCDR2
YASHRYT

SEQ ID NO: 20220 - protein, 9 aa, Artificial Sequence
  Description of Artificial Sequence: Synthetic peptide
  XENP018491 vlCDR3
QQDYSFPRT

SEQ ID NO: 20221 - protein, 451 aa, Artificial Sequence; identical to SEQ ID NO: 16221
  Description of Artificial Sequence: Synthetic polypeptide
  XENP018492 1G6_H1_L1.145_IgG1_PVA_/S267K Heavy Chain

SEQ ID NO: 20222 - protein, 122 aa, Artificial Sequence; identical to SEQ ID NO: 10922
  Description of Artificial Sequence: Synthetic polypeptide
  VH of XENP018492

SEQ ID NO: 20223 - protein, 5 aa, Artificial Sequence
  Description of Artificial Sequence: Synthetic peptide
  XENP018492 vhCDR1
NYWMN

SEQ ID NO: 20224 - protein, 19 aa, Artificial Sequence
  Description of Artificial Sequence: Synthetic peptide
  XENP018492 vhCDR2
EIRLKSNNYATHYAEPVKG

SEQ ID NO: 20225 - protein, 11 aa, Artificial Sequence
  Description of Artificial Sequence: Synthetic peptide
  XENP018492 vhCDR3
YYGNYGGYFDV

SEQ ID NO: 20226 - protein, 214 aa, Artificial Sequence
  Description of Artificial Sequence: Synthetic polypeptide
  XENP018492 1G6_H1_L1.145_IgG1_PVA_/S267K Light Chain
SIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 20227 - protein, 107 aa, Artificial Sequence; identical to SEQ ID NO: 14475
  Description of Artificial Sequence: Synthetic polypeptide
  VL of XENP018492

SEQ ID NO: 20228 - protein, 11 aa, Artificial Sequence
  Description of Artificial Sequence: Synthetic peptide
  XENP018492 vlCDR1
RASQSVSNDVA

SEQ ID NO: 20229 - protein, 7 aa, Artificial Sequence
  Description of Artificial Sequence: Synthetic peptide
  XENP018492 vlCDR2
YASHRYT

SEQ ID NO: 20230 - protein, 9 aa, Artificial Sequence
  Description of Artificial Sequence: Synthetic peptide
  XENP018492 vlCDR3
QQDYSSPRT

SEQ ID NO: 20231 - protein, 451 aa, Artificial Sequence
  Description of Artificial Sequence: Synthetic polypeptide
  XENP018892 1G6_H0L0_IgG1_PVA_/S267K Heavy Chain
EVKLEESGGGLVQPGGSMKLSCVASGFTFSNYWMNWVRQSPEKGLEWVAEIRLKSNNYATHYAESVKGRFTISRDDSKSSVYLQMNNLRAEDTGIYYCTRYYGNYGGYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 20232 - protein, 122 aa, Artificial Sequence; identical to SEQ ID NO: 14483
  Description of Artificial Sequence: Synthetic polypeptide
  VH of XENP018892

SEQ ID NO: 20233 - protein, 5 aa, Artificial Sequence
  Description of Artificial Sequence: Synthetic peptide
  XENP018892 vhCDR1
NYWMN

SEQ ID NO: 20234 - protein, 19 aa, Artificial Sequence
  Description of Artificial Sequence: Synthetic peptide
  XENP018892 vhCDR2
EIRLKSNNYATHYAESVKG

SEQ ID NO: 20235 - protein, 11 aa, Artificial Sequence
  Description of Artificial Sequence: Synthetic peptide
  XENP018892 vhCDR3
YYGNYGGYFDV

SEQ ID NO: 20236 - protein, 214 aa, Artificial Sequence
  Description of Artificial Sequence: Synthetic polypeptide
  XENP018892 1G6_H0L0_IgG1_PVA_/S267K Light Chain
SIVMTQTPKFLLVSAGDRVTITCKASQSVSNDVAWYQQKPGQSPKLLINYASHRYTGVPDRFTGSGYGTDFTFTISTVQAEDLAVYFCQQDYSSPRTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 20237 - protein, 107 aa, Artificial Sequence; identical to SEQ ID NO: 14484
  Description of Artificial Sequence: Synthetic polypeptide
  VL of XENP018892

SEQ ID NO: 20238 - protein, 11 aa, Artificial Sequence
  Description of Artificial Sequence: Synthetic peptide
  XENP018892 vlCDR1
KASQSVSNDVA

SEQ ID NO: 20239 - protein, 7 aa, Artificial Sequence
  Description of Artificial Sequence: Synthetic peptide
  XENP018892 vlCDR2
YASHRYT

SEQ ID NO: 20240 - protein, 9 aa, Artificial Sequence
  Description of Artificial Sequence: Synthetic peptide
  XENP018892 vlCDR3
QQDYSSPRT

SEQ ID NO: 20241 - protein, 449 aa, Artificial Sequence
  Description of Artificial Sequence: Synthetic polypeptide
  XENP018893 4C11_H0L0_IgG1_PVA_/S267K Heavy Chain
EIHLQQSGTVLAKPGASVKMSCTASGYTFTSYWMHWVKQRPGQGLEWIGAIYPGNSDTSYNQKFKGKAKLTAVTSASTAYMELSSLTNEDSAVYYCTNLYYGSSFAMDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 20242 - protein, 120 aa, Artificial Sequence
  Description of Artificial Sequence: Synthetic polypeptide
  VH of XENP018893
EIHLQQSGTVLAKPGASVKMSCTASGYTFTSYWMHWVKQRPGQGLEWIGAIYPGNSDTSYNQKFKGKAKLTAVTSASTAYMELSSLTNEDSAVYYCTNLYYGSSFAMDYWGQGTSVTVSS

SEQ ID NO: 20243 - protein, 5 aa, Artificial Sequence
  Description of Artificial Sequence: Synthetic peptide
  XENP018893 vhCDR1
SYWMH

SEQ ID NO: 20244 - protein, 17 aa, Artificial Sequence
  Description of Artificial Sequence: Synthetic peptide
  XENP018893 vhCDR2
AIYPGNSDTSYNQKFKG

SEQ ID NO: 20245 - protein, 11 aa, Artificial Sequence
  Description of Artificial Sequence: Synthetic peptide
  XENP018893 vhCDR3
LYYGSSFAMDY

SEQ ID NO: 20246 - protein, 214 aa, Artificial Sequence
  Description of Artificial Sequence: Synthetic polypeptide
  XENP018893 4C11_H0L0_IgG1_PVA_/S267K Light Chain
DIKMTQSPSSIYASLGERVTVTCRASQDINTYLSWFQQLPGKSPKTLIYRANRLVDGVPSRFSGSGSGQDYSLTISSLEYEDMGIYYCLHYDDFPYTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 20247 - protein, 107 aa, Artificial Sequence
  Description of Artificial Sequence: Synthetic polypeptide
  VL of XENP018893
DIKMTQSPSSIYASLGERVTVTCRASQDINTYLSWFQQLPGKSPKTLIYRANRLVDGVPSRFSGSGSGQDYSLTISSLEYEDMGIYYCLHYDDFPYTFGGGTKLEIK

SEQ ID NO: 20248 - protein, 11 aa, Artificial Sequence
  Description of Artificial Sequence: Synthetic peptide
  XENP018893 vlCDR1
RASQDINTYLS

SEQ ID NO: 20249 - protein, 7 aa, Artificial Sequence
  Description of Artificial Sequence: Synthetic peptide
  XENP018893 vlCDR2
RANRLVD

SEQ ID NO: 20250 - protein, 9 aa, Artificial Sequence
  Description of Artificial Sequence: Synthetic peptide
  XENP018893 vlCDR3
LHYDDFPYT

SEQ ID NO: 20251 - protein, 446 aa, Artificial Sequence
  Description of Artificial Sequence: Synthetic polypeptide
  XENP018894 6A3_H0L0_IgG1_PVA_/S267K Heavy Chain
EVKLVESGGGLVKPGGSLKLSCAASGFTFSSYGMSWVRQTPEKRLEWVATISGGGRYTYYPDSVKGRFTISRDNAKNNLYLQMSSLRSEDTALYYCASYYDSSFDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 20252 - protein, 117 aa, Artificial Sequence; identical to SEQ ID NO: 14501
  Description of Artificial Sequence: Synthetic polypeptide
  VH of XENP018894

SEQ ID NO: 20253 - protein, 5 aa, Artificial Sequence
  Description of Artificial Sequence: Synthetic peptide
  XENP018894 vhCDR1
SYGMS

SEQ ID NO: 20254 - protein, 17 aa, Artificial Sequence
  Description of Artificial Sequence: Synthetic peptide
  XENP018894 vhCDR2
TISGGGRYTYYPDSVKG

SEQ ID NO: 20255 - protein, 8 aa, Artificial Sequence
  Description of Artificial Sequence: Synthetic peptide
  XENP018894 vhCDR3
YYDSSFDY

SEQ ID NO: 20256 - protein, 214 aa, Artificial Sequence
  Description of Artificial Sequence: Synthetic polypeptide
  XENP018894 6A3_H0L0_IgG1_PVA_/S267K Light Chain
DIVMTQSHKFMSTSVGDRVSITCKASQDVGTAVAWYQQKPGQSPKLLIYWASTRHTGVPDRFTGSGSGTDFTLTISNVQSEDLADYFCQHYSIYPWTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 20257 - protein, 107 aa, Artificial Sequence; identical to SEQ ID NO: 14502
  Description of Artificial Sequence: Synthetic polypeptide
  VL of XENP018894

SEQ ID NO: 20258 - protein, 11 aa, Artificial Sequence
  Description of Artificial Sequence: Synthetic peptide
  XENP018894 vlCDR1
KASQDVGTAVA

SEQ ID NO: 20259 - protein, 7 aa, Artificial Sequence
  Description of Artificial Sequence: Synthetic peptide
  XENP018894 vlCDR2
WASTRHT

SEQ ID NO: 20260 - protein, 9 aa, Artificial Sequence
  Description of Artificial Sequence: Synthetic peptide
  XENP018894 vlCDR3
QHYSIYPWT

SEQ ID NO: 20261 - protein, 451 aa, Artificial Sequence; identical to SEQ ID NO: 17291
  Description of Artificial Sequence: Synthetic polypeptide
  XENP018910 1G6_H1.90_L1.119_IgG1_PVA_/S267K Heavy Chain

SEQ ID NO: 20262 - protein, 122 aa, Artificial Sequence; identical to SEQ ID NO: 11837
  Description of Artificial Sequence: Synthetic polypeptide
  VH of XENP018910

SEQ ID NO: 20263 - protein, 5 aa, Artificial Sequence
  Description of Artificial Sequence: Synthetic peptide
  XENP018910 vhCDR1
NYWMN

SEQ ID NO: 20264 - protein, 19 aa, Artificial Sequence
  Description of Artificial Sequence: Synthetic peptide
  XENP018910 vhCDR2
EIRLYSNNYATHYAEPVKG

SEQ ID NO: 20265 - protein, 11 aa, Artificial Sequence
  Description of Artificial Sequence: Synthetic peptide
  XENP018910 vhCDR3
YYGNYGGYFDV

SEQ ID NO: 20266 - protein, 214 aa, Artificial Sequence; identical to SEQ ID NO: 19966
  Description of Artificial Sequence: Synthetic polypeptide
  XENP018910 1G6_H1.90_L1.119_IgG1_PVA_/S267K Light Chain

SEQ ID NO: 20267 - protein, 107 aa, Artificial Sequence; identical to SEQ ID NO: 14241
  Description of Artificial Sequence: Synthetic polypeptide
  VL of XENP018910

SEQ ID NO: 20268 - protein, 11 aa, Artificial Sequence
  Description of Artificial Sequence: Synthetic peptide
  XENP018910 vlCDR1
RASQSVSNDVA

SEQ ID NO: 20269 - protein, 7 aa, Artificial Sequence
  Description of Artificial Sequence: Synthetic peptide
  XENP018910 vlCDR2
YASHRYT

SEQ ID NO: 20270 - protein, 9 aa, Artificial Sequence
  Description of Artificial Sequence: Synthetic peptide
  XENP018910 vlCDR3
QQDWSSPRT

SEQ ID NO: 20271 - protein, 451 aa, Artificial Sequence; identical to SEQ ID NO: 17291
  Description of Artificial Sequence: Synthetic polypeptide
  XENP018911 1G6_H1.90_L1.23_IgG1_PVA_/S267K Heavy Chain

SEQ ID NO: 20272 - protein, 122 aa, Artificial Sequence; identical to SEQ ID NO: 11837
  Description of Artificial Sequence: Synthetic polypeptide
  VH of XENP018911

SEQ ID NO: 20273 - protein, 5 aa, Artificial Sequence
  Description of Artificial Sequence: Synthetic peptide
  XENP018911 vhCDR1
NYWMN

SEQ ID NO: 20274 - protein, 19 aa, Artificial Sequence
  Description of Artificial Sequence: Synthetic peptide
  XENP018911 vhCDR2
EIRLYSNNYATHYAEPVKG

SEQ ID NO: 20275 - protein, 11 aa, Artificial Sequence
  Description of Artificial Sequence: Synthetic peptide
  XENP018911 vhCDR3
YYGNYGGYFDV

SEQ ID NO: 20276 - protein, 214 aa, Artificial Sequence; identical to SEQ ID NO: 19006
  Description of Artificial Sequence: Synthetic polypeptide
  XENP018911 1G6_H1.90_L1.23_IgG1_PVA_/S267K Light Chain

SEQ ID NO: 20277 - protein, 107 aa, Artificial Sequence; identical to SEQ ID NO: 13377
  Description of Artificial Sequence: Synthetic polypeptide
  VL of XENP018911

SEQ ID NO: 20278 - protein, 11 aa, Artificial Sequence
  Description of Artificial Sequence: Synthetic peptide
  XENP018911 vlCDR1
RASQSVGNDVA

SEQ ID NO: 20279 - protein, 7 aa, Artificial Sequence
  Description of Artificial Sequence: Synthetic peptide
  XENP018911 vlCDR2
YASHRYT

SEQ ID NO: 20280 - protein, 9 aa, Artificial Sequence
  Description of Artificial Sequence: Synthetic peptide
  XENP018911 vlCDR3
QQDYSSPRT

SEQ ID NO: 20281 - protein, 451 aa, Artificial Sequence; identical to SEQ ID NO: 17291
  Description of Artificial Sequence: Synthetic polypeptide
  XENP018912 1G6_H1.90_L1.67_IgG1_PVA_/S267K Heavy Chain

SEQ ID NO: 20282 - protein, 122 aa, Artificial Sequence; identical to SEQ ID NO: 11837
  Description of Artificial Sequence: Synthetic polypeptide
  VH of XENP018912

SEQ ID NO: 20283 - protein, 5 aa, Artificial Sequence
  Description of Artificial Sequence: Synthetic peptide
  XENP018912 vhCDR1
NYWMN

SEQ ID NO: 20284 - protein, 19 aa, Artificial Sequence
  Description of Artificial Sequence: Synthetic peptide
  XENP018912 vhCDR2
EIRLYSNNYATHYAEPVKG

SEQ ID NO: 20285 - protein, 11 aa, Artificial Sequence
  Description of Artificial Sequence: Synthetic peptide
  XENP018912 vhCDR3
YYGNYGGYFDV

SEQ ID NO: 20286 - protein, 214 aa, Artificial Sequence; identical to SEQ ID NO: 19446
  Description of Artificial Sequence: Synthetic polypeptide
  XENP018912 1G6_H1.90_L1.67_IgG1_PVA_/S267K Light Chain

SEQ ID NO: 20287 - protein, 107 aa, Artificial Sequence; identical to SEQ ID NO: 13773
  Description of Artificial Sequence: Synthetic polypeptide
  VL of XENP018912

SEQ ID NO: 20288 - protein, 11 aa, Artificial Sequence
  Description of Artificial Sequence: Synthetic peptide
  XENP018912 vlCDR1
RASQSVSNDVA

SEQ ID NO: 20289 - protein, 7 aa, Artificial Sequence
  Description of Artificial Sequence: Synthetic peptide
  XENP018912 vlCDR2
YASWRYT

SEQ ID NO: 20290 - protein, 9 aa, Artificial Sequence
  Description of Artificial Sequence: Synthetic peptide
  XENP018912 vlCDR3
QQDYSSPRT

SEQ ID NO: 20291 - protein, 451 aa, Artificial Sequence; identical to SEQ ID NO: 17291
  Description of Artificial Sequence: Synthetic polypeptide
  XENP018913 1G6_H1.90_L1.94_IgG1_PVA_/S267K Heavy Chain

SEQ ID NO: 20292 - protein, 122 aa, Artificial Sequence; identical to SEQ ID NO: 11837
  Description of Artificial Sequence: Synthetic polypeptide
  VH of XENP018913

SEQ ID NO: 20293 - protein, 5 aa, Artificial Sequence
  Description of Artificial Sequence: Synthetic peptide
  XENP018913 vhCDR1
NYWMN

SEQ ID NO: 20294 - protein, 19 aa, Artificial Sequence
  Description of Artificial Sequence: Synthetic peptide
  XENP018913 vhCDR2
EIRLYSNNYATHYAEPVKG

SEQ ID NO: 20295 - protein, 11 aa, Artificial Sequence
  Description of Artificial Sequence: Synthetic peptide
  XENP018913 vhCDR3
YYGNYGGYFDV

SEQ ID NO: 20296 - protein, 214 aa, Artificial Sequence; identical to SEQ ID NO: 19716
  Description of Artificial Sequence: Synthetic polypeptide
  XENP018913 1G6_H1.90_L1.94_IgG1_PVA_/S267K Light Chain

SEQ ID NO: 20297 - protein, 107 aa, Artificial Sequence; identical to SEQ ID NO: 14016
  Description of Artificial Sequence: Synthetic polypeptide
  VL of XENP018913

SEQ ID NO: 20298 - protein, 11 aa, Artificial Sequence
  Description of Artificial Sequence: Synthetic peptide
  XENP018913 vlCDR1
RASQSVSNDVA

SEQ ID NO: 20299 - protein, 7 aa, Artificial Sequence
  Description of Artificial Sequence: Synthetic peptide
  XENP018913 vlCDR2
YASHRYT

SEQ ID NO: 20300 - protein, 9 aa, Artificial Sequence
  Description of Artificial Sequence: Synthetic peptide
  XENP018913 vlCDR3
QQDYSSPRT

SEQ ID NO: 20301 - protein, 451 aa, Artificial Sequence; identical to SEQ ID NO: 17291
  Description of Artificial Sequence: Synthetic polypeptide
  XENP018914 1G6_H1.90_L1.116_IgG1_PVA_/S267K Heavy Chain

SEQ ID NO: 20302 - protein, 122 aa, Artificial Sequence; identical to SEQ ID NO: 11837
  Description of Artificial Sequence: Synthetic polypeptide
  VH of XENP018914

SEQ ID NO: 20303 - protein, 5 aa, Artificial Sequence
  Description of Artificial Sequence: Synthetic peptide
  XENP018914 vhCDR1
NYWMN

SEQ ID NO: 20304 - protein, 19 aa, Artificial Sequence
  Description of Artificial Sequence: Synthetic peptide
  XENP018914 vhCDR2
EIRLYSNNYATHYAEPVKG

SEQ ID NO: 20305 - protein, 11 aa, Artificial Sequence
  Description of Artificial Sequence: Synthetic peptide
  XENP018914 vhCDR3
YYGNYGGYFDV

SEQ ID NO: 20306 - protein, 214 aa, Artificial Sequence; identical to SEQ ID NO: 19936
  Description of Artificial Sequence: Synthetic polypeptide
  XENP018914 1G6_H1.90_L1.116_IgG1_PVA_/S267K Light Chain

SEQ ID NO: 20307 - protein, 107 aa, Artificial Sequence; identical to SEQ ID NO: 14214
  Description of Artificial Sequence: Synthetic polypeptide
  VL of XENP018914

SEQ ID NO: 20308 - protein, 11 aa, Artificial Sequence
  Description of Artificial Sequence: Synthetic peptide
  XENP018914 vlCDR1
RASQSVSNDVA

SEQ ID NO: 20309 - protein, 7 aa, Artificial Sequence
  Description of Artificial Sequence: Synthetic peptide
  XENP018914 vlCDR2
YASHRYT

SEQ ID NO: 20310 - protein, 9 aa, Artificial Sequence
  Description of Artificial Sequence: Synthetic peptide
  XENP018914 vlCDR3
QQDFSSPRT

SEQ ID NO: 20311 - protein, 451 aa, Artificial Sequence; identical to SEQ ID NO: 17941
  Description of Artificial Sequence: Synthetic polypeptide
  XENP018915 1G6_H1.155_L1.119_IgG1_PVA_/S267K Heavy Chain

SEQ ID NO: 20312 - protein, 122 aa, Artificial Sequence; identical to SEQ ID NO: 12422
  Description of Artificial Sequence: Synthetic polypeptide
  VH of XENP018915

SEQ ID NO: 20313 - protein, 5 aa, Artificial Sequence
  Description of Artificial Sequence: Synthetic peptide
  XENP018915 vhCDR1
NYWMN

SEQ ID NO: 20314 - protein, 19 aa, Artificial Sequence
  Description of Artificial Sequence: Synthetic peptide
  XENP018915 vhCDR2
EIRLKSNNYATHYAEPVKG

SEQ ID NO: 20315 - protein, 11 aa, Artificial Sequence
  Description of Artificial Sequence: Synthetic peptide
  XENP018915 vhCDR3
YYGNYGGYFDV

SEQ ID NO: 20316 - protein, 214 aa, Artificial Sequence; identical to SEQ ID NO: 19966
  Description of Artificial Sequence: Synthetic polypeptide
  XENP018915 1G6_H1.155_L1.119_IgG1_PVA_/S267K Light Chain

SEQ ID NO: 20317 - protein, 107 aa, Artificial Sequence; identical to SEQ ID NO: 14241
  Description of Artificial Sequence: Synthetic polypeptide
  VL of XENP018915

SEQ ID NO: 20318 - protein, 11 aa, Artificial Sequence
  Description of Artificial Sequence: Synthetic peptide
  XENP018915 vlCDR1
RASQSVSNDVA

SEQ ID NO: 20319 - protein, 7 aa, Artificial Sequence
  Description of Artificial Sequence: Synthetic peptide
  XENP018915 vlCDR2
YASHRYT

SEQ ID NO: 20320 - protein, 9 aa, Artificial Sequence
  Description of Artificial Sequence: Synthetic peptide
  XENP018915 vlCDR3
QQDWSSPRT

SEQ ID NO: 20321 - protein, 451 aa, Artificial Sequence
  Description of Artificial Sequence: Synthetic polypeptide
  XENP018980 1G6_H1.239_L1_IgG1_PVA_/S267K Heavy Chain
EVQLKESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 20322 - protein, 122 aa, Artificial Sequence; identical to SEQ ID NO: 14681
  Description of Artificial Sequence: Synthetic polypeptide
  VH of XENP018980

SEQ ID NO: 20323 - protein, 5 aa, Artificial Sequence
  Description of Artificial Sequence: Synthetic peptide
  XENP018980 vhCDR1
NYWMN

SEQ ID NO: 20324 - protein, 19 aa, Artificial Sequence
  Description of Artificial Sequence: Synthetic peptide
  XENP018980 vhCDR2
EIRLKSNNYATHYAEPVKG

SEQ ID NO: 20325 - protein, 11 aa, Artificial Sequence
  Description of Artificial Sequence: Synthetic peptide
  XENP018980 vhCDR3
YYGNYGGYFDV

SEQ ID NO: 20326 - protein, 214 aa, Artificial Sequence; identical to SEQ ID NO: 16226
  Description of Artificial Sequence: Synthetic polypeptide
  XENP018980 1G6_H1.239_L1_IgG1_PVA_/S267K Light Chain

SEQ ID NO: 20327 - protein, 107 aa, Artificial Sequence; identical to SEQ ID NO: 10923
  Description of Artificial Sequence: Synthetic polypeptide
  VL of XENP018980

SEQ ID NO: 20328 - protein, 11 aa, Artificial Sequence
  Description of Artificial Sequence: Synthetic peptide
  XENP018980 vlCDR1
RASQSVSNDVA

SEQ ID NO: 20329 - protein, 7 aa, Artificial Sequence
  Description of Artificial Sequence: Synthetic peptide
  XENP018980 vlCDR2
YASHRYT

SEQ ID NO: 20330 - protein, 9 aa, Artificial Sequence
  Description of Artificial Sequence: Synthetic peptide
  XENP018980 vlCDR3
QQDYSSPRT

SEQ ID NO: 20331 - protein, 451 aa, Artificial Sequence
  Description of Artificial Sequence: Synthetic polypeptide
  XENP018981 1G6_H1.240_L1_IgG1_PVA_/S267K Heavy Chain
EVQLVESGGGLVKPGESLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 20332 - protein, 122 aa, Artificial Sequence; identical to SEQ ID NO: 14690
  Description of Artificial Sequence: Synthetic polypeptide
  VH of XENP018981

SEQ ID NO: 20333 - protein, 5 aa, Artificial Sequence
  Description of Artificial Sequence: Synthetic peptide
  XENP018981 vhCDR1
NYWMN

SEQ ID NO: 20334 - protein, 19 aa, Artificial Sequence
  Description of Artificial Sequence: Synthetic peptide
  XENP018981 vhCDR2
EIRLKSNNYATHYAEPVKG

SEQ ID NO: 20335 - protein, 11 aa, Artificial Sequence
  Description of Artificial Sequence: Synthetic peptide
  XENP018981 vhCDR3
YYGNYGGYFDV

SEQ ID NO: 20336 - protein, 214 aa, Artificial Sequence; identical to SEQ ID NO: 16226
  Description of Artificial Sequence: Synthetic polypeptide
  XENP018981 1G6_H1.240_L1_IgG1_PVA_/S267K Light Chain

SEQ ID NO: 20337 - protein, 107 aa, Artificial Sequence; identical to SEQ ID NO: 10923
  Description of Artificial Sequence: Synthetic polypeptide
  VL of XENP018981

SEQ ID NO: 20338 - protein, 11 aa, Artificial Sequence
  Description of Artificial Sequence: Synthetic peptide
  XENP018981 vlCDR1
RASQSVSNDVA

SEQ ID NO: 20339 - protein, 7 aa, Artificial Sequence
  Description of Artificial Sequence: Synthetic peptide
  XENP018981 vlCDR2
YASHRYT

SEQ ID NO: 20340 - protein, 9 aa, Artificial Sequence
  Description of Artificial Sequence: Synthetic peptide
  XENP018981 vlCDR3
QQDYSSPRT

SEQ ID NO: 20341 - protein, 451 aa, Artificial Sequence
  Description of Artificial Sequence: Synthetic polypeptide
  XENP018982 1G6_H1.241_L1_IgG1_PVA_/S267K Heavy Chain
EVQLVESGGGLVKPGGSLRLTCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 20342 - protein, 122 aa, Artificial Sequence; identical to SEQ ID NO: 14699
  Description of Artificial Sequence: Synthetic polypeptide
  VH of XENP018982

SEQ ID NO: 20343 - protein, 5 aa, Artificial Sequence
  Description of Artificial Sequence: Synthetic peptide
  XENP018982 vhCDR1
NYWMN

SEQ ID NO: 20344 - protein, 19 aa, Artificial Sequence
  Description of Artificial Sequence: Synthetic peptide
  XENP018982 vhCDR2
EIRLKSNNYATHYAEPVKG

SEQ ID NO: 20345 - protein, 11 aa, Artificial Sequence
  Description of Artificial Sequence: Synthetic peptide
  XENP018982 vhCDR3
YYGNYGGYFDV

SEQ ID NO: 20346 - protein, 214 aa, Artificial Sequence; identical to SEQ ID NO: 16226
  Description of Artificial Sequence: Synthetic polypeptide
  XENP018982 1G6_H1.241_L1_IgG1_PVA_/S267K Light Chain

SEQ ID NO: 20347 - protein, 107 aa, Artificial Sequence; identical to SEQ ID NO: 10923
  Description of Artificial Sequence: Synthetic polypeptide
  VL of XENP018982

SEQ ID NO: 20348 - protein, 11 aa, Artificial Sequence
  Description of Artificial Sequence: Synthetic peptide
  XENP018982 vlCDR1
RASQSVSNDVA

SEQ ID NO: 20349 - protein, 7 aa, Artificial Sequence
  Description of Artificial Sequence: Synthetic peptide
  XENP018982 vlCDR2
YASHRYT

SEQ ID NO: 20350 - protein, 9 aa, Artificial Sequence
  Description of Artificial Sequence: Synthetic peptide
  XENP018982 vlCDR3
QQDYSSPRT

SEQ ID NO: 20351 - protein, 451 aa, Artificial Sequence
  Description of Artificial Sequence: Synthetic polypeptide
  XENP018983 1G6_H1.242_L1_IgG1_PVA_/S267K Heavy Chain
EVQLVESGGGLVKPGGSLRLVCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 20352 - protein, 122 aa, Artificial Sequence; identical to SEQ ID NO: 14708
  Description of Artificial Sequence: Synthetic polypeptide
  VH of XENP018983

SEQ ID NO: 20353 - protein, 5 aa, Artificial Sequence
  Description of Artificial Sequence: Synthetic peptide
  XENP018983 vhCDR1
NYWMN

SEQ ID NO: 20354 - protein, 19 aa, Artificial Sequence
  Description of Artificial Sequence: Synthetic peptide
  XENP018983 vhCDR2
EIRLKSNNYATHYAEPVKG

SEQ ID NO: 20355 - protein, 11 aa, Artificial Sequence
  Description of Artificial Sequence: Synthetic peptide
  XENP018983 vhCDR3
YYGNYGGYFDV

SEQ ID NO: 20356 - protein, 214 aa, Artificial Sequence; identical to SEQ ID NO: 16226
  Description of Artificial Sequence: Synthetic polypeptide
  XENP018983 1G6_H1.242_L1_IgG1_PVA_/S267K Light Chain

SEQ ID NO: 20357 - protein, 107 aa, Artificial Sequence; identical to SEQ ID NO: 10923
  Description of Artificial Sequence: Synthetic polypeptide
  VL of XENP018983

SEQ ID NO: 20358 - protein, 11 aa, Artificial Sequence
  Description of Artificial Sequence: Synthetic peptide
  XENP018983 vlCDR1
RASQSVSNDVA

SEQ ID NO: 20359 - protein, 7 aa, Artificial Sequence
  Description of Artificial Sequence: Synthetic peptide
  XENP018983 vlCDR2
YASHRYT

SEQ ID NO: 20360 - protein, 9 aa, Artificial Sequence
  Description of Artificial Sequence: Synthetic peptide
  XENP018983 vlCDR3
QQDYSSPRT

SEQ ID NO: 20361 - protein, 451 aa, Artificial Sequence
  Description of Artificial Sequence: Synthetic polypeptide
  XENP018984 1G6_H1.243_L1_IgG1_PVA_/S267K Heavy Chain
EVQLVESGGGLVKPGGSLRLSCAASGFTLSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 20362 - protein, 122 aa, Artificial Sequence; identical to SEQ ID NO: 14717
  Description of Artificial Sequence: Synthetic polypeptide
  VH of XENP018984

SEQ ID NO: 20363 - protein, 5 aa, Artificial Sequence
  Description of Artificial Sequence: Synthetic peptide
  XENP018984 vhCDR1
NYWMN

SEQ ID NO: 20364 - protein, 19 aa, Artificial Sequence
  Description of Artificial Sequence: Synthetic peptide
  XENP018984 vhCDR2
EIRLKSNNYATHYAEPVKG

SEQ ID NO: 20365 - protein, 11 aa, Artificial Sequence
  Description of Artificial Sequence: Synthetic peptide
  XENP018984 vhCDR3
YYGNYGGYFDV

SEQ ID NO: 20366 - protein, 214 aa, Artificial Sequence; identical to SEQ ID NO: 16226
  Description of Artificial Sequence: Synthetic polypeptide
  XENP018984 1G6_H1.243_L1_IgG1_PVA_/S267K Light Chain

SEQ ID NO: 20367 - protein, 107 aa, Artificial Sequence; identical to SEQ ID NO: 10923
  Description of Artificial Sequence: Synthetic polypeptide
  VL of XENP018984

SEQ ID NO: 20368 - protein, 11 aa, Artificial Sequence
  Description of Artificial Sequence: Synthetic peptide
  XENP018984 vlCDR1
RASQSVSNDVA

SEQ ID NO: 20369 - protein, 7 aa, Artificial Sequence
  Description of Artificial Sequence: Synthetic peptide
  XENP018984 vlCDR2
YASHRYT

SEQ ID NO: 20370 - protein, 9 aa, Artificial Sequence
  Description of Artificial Sequence: Synthetic peptide
  XENP018984 vlCDR3
QQDYSSPRT

SEQ ID NO: 20371 - protein, 451 aa, Artificial Sequence
  Description of Artificial Sequence: Synthetic polypeptide
  XENP018985 1G6_H1.244_L1_IgG1_PVA_/S267K Heavy Chain
EVQLVESGGGLVKPGGSLRLSCAASGFTFSNYWMNWVRQAPGKGLQWVGEIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 20372 - protein, 122 aa, Artificial Sequence; identical to SEQ ID NO: 14726
  Description of Artificial Sequence: Synthetic polypeptide
  VH of XENP018985

SEQ ID NO: 20373 - protein, 5 aa, Artificial Sequence
  Description of Artificial Sequence: Synthetic peptide
  XENP018985 vhCDR1
NYWMN

SEQ ID NO: 20374 - protein, 19 aa, Artificial Sequence
  Description of Artificial Sequence: Synthetic peptide
  XENP018985 vhCDR2
EIRLKSNNYATHYAEPVKG

SEQ ID NO: 20375 - protein, 11 aa, Artificial Sequence
  Description of Artificial Sequence: Synthetic peptide
  XENP018985 vhCDR3
YYGNYGGYFDV

SEQ ID NO: 20376 - protein, 214 aa, Artificial Sequence; identical to SEQ ID NO: 16226
  Description of Artificial Sequence: Synthetic polypeptide
  XENP018985 1G6_H1.244_L1_IgG1_PVA_/S267K Light Chain

SEQ ID NO: 20377 - protein, 107 aa, Artificial Sequence; identical to SEQ ID NO: 10923
  Description of Artificial Sequence: Synthetic polypeptide
  VL of XENP018985

SEQ ID NO: 20378 - protein, 11 aa, Artificial Sequence
  Description of Artificial Sequence: Synthetic peptide
  XENP018985 vlCDR1
RASQSVSNDVA

SEQ ID NO: 20379 - protein, 7 aa, Artificial Sequence
  Description of Artificial Sequence: Synthetic peptide
  XENP018985 vlCDR2
YASHRYT

SEQ ID NO: 20380 - protein, 9 aa, Artificial Sequence
  Description of Artificial Sequence: Synthetic peptide
  XENP018985 vlCDR3
QQDYSSPRT

SEQ ID NO: 20381 - protein, 451 aa, Artificial Sequence
  Description of Artificial Sequence: Synthetic polypeptide
  XENP018986 1G6_H1.245_L1_IgG1_PVA_/S267K Heavy Chain
EVQLVESGGGLVKPGGSLRLSCAASGFTFSNYWMNWVRQAPGKGLEWIGEIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 20382 - protein, 122 aa, Artificial Sequence; identical to SEQ ID NO: 14735
  Description of Artificial Sequence: Synthetic polypeptide
  VH of XENP018986

SEQ ID NO: 20383 - protein, 5 aa, Artificial Sequence
  Description of Artificial Sequence: Synthetic peptide
  XENP018986 vhCDR1
NYWMN

SEQ ID NO: 20384 - protein, 19 aa, Artificial Sequence
  Description of Artificial Sequence: Synthetic peptide
  XENP018986 vhCDR2
EIRLKSNNYATHYAEPVKG

SEQ ID NO: 20385 - protein, 11 aa, Artificial Sequence
  Description of Artificial Sequence: Synthetic peptide
  XENP018986 vhCDR3
YYGNYGGYFDV

SEQ ID NO: 20386 - protein, 214 aa, Artificial Sequence; identical to SEQ ID NO: 16226
  Description of Artificial Sequence: Synthetic polypeptide
  XENP018986 1G6_H1.245_L1_IgG1_PVA_/S267K Light Chain

SEQ ID NO: 20387 - protein, 107 aa, Artificial Sequence; identical to SEQ ID NO: 10923
  Description of Artificial Sequence: Synthetic polypeptide
  VL of XENP018986

SEQ ID NO: 20388 - protein, 11 aa, Artificial Sequence
  Description of Artificial Sequence: Synthetic peptide
  XENP018986 vlCDR1
RASQSVSNDVA

SEQ ID NO: 20389 - protein, 7 aa, Artificial Sequence
  Description of Artificial Sequence: Synthetic peptide
  XENP018986 vlCDR2
YASHRYT

SEQ ID NO: 20390 - protein, 9 aa, Artificial Sequence
  Description of Artificial Sequence: Synthetic peptide
  XENP018986 vlCDR3
QQDYSSPRT

SEQ ID NO: 20391 - protein, 451 aa, Artificial Sequence
  Description of Artificial Sequence: Synthetic polypeptide
  XENP018987 1G6_H1.246_L1_IgG1_PVA_/S267K Heavy Chain
EVQLVESGGGLVKPGGSLRLSCAASGFTFSNYWMNWVRQAPGKGLEWMGEIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 20392 - protein, 122 aa, Artificial Sequence; identical to SEQ ID NO: 14744
  Description of Artificial Sequence: Synthetic polypeptide
  VH of XENP018987

SEQ ID NO: 20393 - protein, 5 aa, Artificial Sequence
  Description of Artificial Sequence: Synthetic peptide
  XENP018987 vhCDR1
NYWMN

SEQ ID NO: 20394 - protein, 19 aa, Artificial Sequence
  Description of Artificial Sequence: Synthetic peptide
  XENP018987 vhCDR2
EIRLKSNNYATHYAEPVKG

SEQ ID NO: 20395 - protein, 11 aa, Artificial Sequence
  Description of Artificial Sequence: Synthetic peptide
  XENP018987 vhCDR3
YYGNYGGYFDV

SEQ ID NO: 20396 - protein, 214 aa, Artificial Sequence; identical to SEQ ID NO: 16226
  Description of Artificial Sequence: Synthetic polypeptide
  XENP018987 1G6_H1.246_L1_IgG1_PVA_/S267K Light Chain

SEQ ID NO: 20397 - protein, 107 aa, Artificial Sequence; identical to SEQ ID NO: 10923
  Description of Artificial Sequence: Synthetic polypeptide
  VL of XENP018987

SEQ ID NO: 20398 - protein, 11 aa, Artificial Sequence
  Description of Artificial Sequence: Synthetic peptide
  XENP018987 vlCDR1
RASQSVSNDVA

SEQ ID NO: 20399 - protein, 7 aa, Artificial Sequence
  Description of Artificial Sequence: Synthetic peptide
  XENP018987 vlCDR2
YASHRYT

SEQ ID NO: 20400 - protein, 9 aa, Artificial Sequence
  Description of Artificial Sequence: Synthetic peptide
  XENP018987 vlCDR3
QQDYSSPRT

SEQ ID NO: 20401 - protein, 451 aa, Artificial Sequence
  Description of Artificial Sequence: Synthetic polypeptide
  XENP018988 1G6_H1.247_L1_IgG1_PVA_/S267K Heavy Chain
EVQLVESGGGLVKPGGSLRLSCAASGFTFSNYWMNWVRQAPGKGLEWVGEIRLKSNNYATHYAEPFKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 20402 - protein, 122 aa, Artificial Sequence; identical to SEQ ID NO: 14753
  Description of Artificial Sequence: Synthetic polypeptide
  VH of XENP018988

SEQ ID NO: 20403 - protein, 5 aa, Artificial Sequence
  Description of Artificial Sequence: Synthetic peptide
  XENP018988 vhCDR1
NYWMN

SEQ ID NO: 20404 - protein, 19 aa, Artificial Sequence
  Description of Artificial Sequence: Synthetic peptide
  XENP018988 vhCDR2
EIRLKSNNYATHYAEPFKG

SEQ ID NO: 20405 - protein, 11 aa, Artificial Sequence
  Description of Artificial Sequence: Synthetic peptide
  XENP018988 vhCDR3
YYGNYGGYFDV

SEQ ID NO: 20406 - protein, 214 aa, Artificial Sequence; identical to SEQ ID NO: 16226
  Description of Artificial Sequence: Synthetic polypeptide
  XENP018988 1G6_H1.247_L1_IgG1_PVA_/S267K Light Chain

SEQ ID NO: 20407 - protein, 107 aa, Artificial Sequence; identical to SEQ ID NO: 10923
  Description of Artificial Sequence: Synthetic polypeptide
  VL of XENP018988

SEQ ID NO: 20408 - protein, 11 aa, Artificial Sequence
  Description of Artificial Sequence: Synthetic peptide
  XENP018988 vlCDR1
RASQSVSNDVA

SEQ ID NO: 20409 - protein, 7 aa, Artificial Sequence
  Description of Artificial Sequence: Synthetic peptide
  XENP018988 vlCDR2
YASHRYT

SEQ ID NO: 20410 - protein, 9 aa, Artificial Sequence
  Description of Artificial Sequence: Synthetic peptide
  XENP018988 vlCDR3
QQDYSSPRT

SEQ ID NO: 20411 - protein, 451 aa, Artificial Sequence
  Description of Artificial Sequence: Synthetic polypeptide
  XENP018989 1G6_H1.248_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRATISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 20412 - protein, 122 aa, Artificial Sequence; identical to SEQ ID NO: 14762
  Description of Artificial Sequence: Synthetic polypeptide
  VH of XENP018989

SEQ ID NO: 20413 - protein, 5 aa, Artificial Sequence
  Description of Artificial Sequence: Synthetic peptide
  XENP018989 vhCDR1
NYWMN

SEQ ID NO: 20414 - protein, 19 aa, Artificial Sequence
  Description of Artificial Sequence: Synthetic peptide
  XENP018989 vhCDR2
EIRLKSNNYATHYAEPVKG

SEQ ID NO: 20415 - protein, 11 aa, Artificial Sequence
  Description of Artificial Sequence: Synthetic peptide
  XENP018989 vhCDR3
YYGNYGGYFDV

SEQ ID NO: 20416 - protein, 214 aa, Artificial Sequence; identical to SEQ ID NO: 16226
  Description of Artificial Sequence: Synthetic polypeptide
  XENP018989 1G6_H1.248_L1_IgG1_PVA_/S267K Light Chain

SEQ ID NO: 20417 - protein, 107 aa, Artificial Sequence; identical to SEQ ID NO: 10923
  Description of Artificial Sequence: Synthetic polypeptide
  VL of XENP018989

SEQ ID NO: 20418 - protein, 11 aa, Artificial Sequence
  Description of Artificial Sequence: Synthetic peptide
  XENP018989 vlCDR1
RASQSVSNDVA

SEQ ID NO: 20419 - protein, 7 aa, Artificial Sequence
  Description of Artificial Sequence: Synthetic peptide
  XENP018989 vlCDR2
YASHRYT

SEQ ID NO: 20420 - protein, 9 aa, Artificial Sequence
  Description of Artificial Sequence: Synthetic peptide
  XENP018989 vlCDR3
QQDYSSPRT

SEQ ID NO: 20421 - protein, 451 aa, Artificial Sequence
  Description of Artificial Sequence: Synthetic polypeptide
  XENP018990 1G6_H1.249_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRVTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 20422 - protein, 122 aa, Artificial Sequence; identical to SEQ ID NO: 14771
  Description of Artificial Sequence: Synthetic polypeptide
  VH of XENP018990

SEQ ID NO: 20423 - protein, 5 aa, Artificial Sequence
  Description of Artificial Sequence: Synthetic peptide
  XENP018990 vhCDR1
NYWMN

SEQ ID NO: 20424 - protein, 19 aa, Artificial Sequence
  Description of Artificial Sequence: Synthetic peptide
  XENP018990 vhCDR2
EIRLKSNNYATHYAEPVKG

SEQ ID NO: 20425 - protein, 11 aa, Artificial Sequence
  Description of Artificial Sequence: Synthetic peptide
  XENP018990 vhCDR3
YYGNYGGYFDV

SEQ ID NO: 20426 - protein, 214 aa, Artificial Sequence; identical to SEQ ID NO: 16226
  Description of Artificial Sequence: Synthetic polypeptide
  XENP018990 1G6_H1.249_L1_IgG1_PVA_/S267K Light Chain

SEQ ID NO: 20427 - protein, 107 aa, Artificial Sequence; identical to SEQ ID NO: 10923
  Description of Artificial Sequence: Synthetic polypeptide
  VL of XENP018990

SEQ ID NO: 20428 - protein, 11 aa, Artificial Sequence
  Description of Artificial Sequence: Synthetic peptide
  XENP018990 vlCDR1
RASQSVSNDVA

SEQ ID NO: 20429 - protein, 7 aa, Artificial Sequence
  Description of Artificial Sequence: Synthetic peptide
  XENP018990 vlCDR2
YASHRYT

SEQ ID NO: 20430 - protein, 9 aa, Artificial Sequence
  Description of Artificial Sequence: Synthetic peptide
  XENP018990 vlCDR3
QQDYSSPRT

SEQ ID NO: 20431 - protein, 451 aa, Artificial Sequence
  Description of Artificial Sequence: Synthetic polypeptide
  XENP018991 1G6_H1.250_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSSSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 20432 - protein, 122 aa, Artificial Sequence; identical to SEQ ID NO: 14780
  Description of Artificial Sequence: Synthetic polypeptide
  VH of XENP018991

SEQ ID NO: 20433 - protein, 5 aa, Artificial Sequence
  Description of Artificial Sequence: Synthetic peptide
  XENP018991 vhCDR1
NYWMN

SEQ ID NO: 20434 - protein, 19 aa, Artificial Sequence
  Description of Artificial Sequence: Synthetic peptide
  XENP018991 vhCDR2
EIRLKSNNYATHYAEPVKG

SEQ ID NO: 20435 - protein, 11 aa, Artificial Sequence
  Description of Artificial Sequence: Synthetic peptide
  XENP018991 vhCDR3
YYGNYGGYFDV

SEQ ID NO: 20436 - protein, 214 aa, Artificial Sequence; identical to SEQ ID NO: 16226
  Description of Artificial Sequence: Synthetic polypeptide
  XENP018991 1G6_H1.250_L1_IgG1_PVA_/S267K Light Chain

SEQ ID NO: 20437 - protein, 107 aa, Artificial Sequence; identical to SEQ ID NO: 10923
  Description of Artificial Sequence: Synthetic polypeptide
  VL of XENP018991

SEQ ID NO: 20438 - protein, 11 aa, Artificial Sequence
  Description of Artificial Sequence: Synthetic peptide
  XENP018991 vlCDR1
RASQSVSNDVA

SEQ ID NO: 20439 - protein, 7 aa, Artificial Sequence
  Description of Artificial Sequence: Synthetic peptide
  XENP018991 vlCDR2
YASHRYT

SEQ ID NO: 20440 - protein, 9 aa, Artificial Sequence
  Description of Artificial Sequence: Synthetic peptide
  XENP018991 vlCDR3
QQDYSSPRT

SEQ ID NO: 20441 - protein, 451 aa, Artificial Sequence
  Description of Artificial Sequence: Synthetic polypeptide
  XENP018992 1G6_H1.251_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSMVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 20442 - protein, 122 aa, Artificial Sequence; identical to SEQ ID NO: 14789
  Description of Artificial Sequence: Synthetic polypeptide
  VH of XENP018992

SEQ ID NO: 20443 - protein, 5 aa, Artificial Sequence
  Description of Artificial Sequence: Synthetic peptide
  XENP018992 vhCDR1
NYWMN

SEQ ID NO: 20444 - protein, 19 aa, Artificial Sequence
  Description of Artificial Sequence: Synthetic peptide
  XENP018992 vhCDR2
EIRLKSNNYATHYAEPVKG

SEQ ID NO: 20445 - protein, 11 aa, Artificial Sequence
  Description of Artificial Sequence: Synthetic peptide
  XENP018992 vhCDR3
YYGNYGGYFDV

SEQ ID NO: 20446 - protein, 214 aa, Artificial Sequence; identical to SEQ ID NO: 16226
  Description of Artificial Sequence: Synthetic polypeptide
  XENP018992 1G6_H1.251_L1_IgG1_PVA_/S267K Light Chain

SEQ ID NO: 20447 - protein, 107 aa, Artificial Sequence; identical to SEQ ID NO: 10923
  Description of Artificial Sequence: Synthetic polypeptide
  VL of XENP018992

SEQ ID NO: 20448 - protein, 11 aa, Artificial Sequence
  Description of Artificial Sequence: Synthetic peptide
  XENP018992 vlCDR1
RASQSVSNDVA

SEQ ID NO: 20449 - protein, 7 aa, Artificial Sequence
  Description of Artificial Sequence: Synthetic peptide
  XENP018992 vlCDR2
YASHRYT

SEQ ID NO: 20450 - protein, 9 aa, Artificial Sequence
  Description of Artificial Sequence: Synthetic peptide
  XENP018992 vlCDR3
QQDYSSPRT

SEQ ID NO: 20451 - protein, 451 aa, Artificial Sequence
  Description of Artificial Sequence: Synthetic polypeptide
  XENP018993 1G6_H1.252_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSQVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 20452 - protein, 122 aa, Artificial Sequence; identical to SEQ ID NO: 14798
  Description of Artificial Sequence: Synthetic polypeptide
  VH of XENP018993

SEQ ID NO: 20453 - protein, 5 aa, Artificial Sequence
  Description of Artificial Sequence: Synthetic peptide
  XENP018993 vhCDR1
NYWMN

SEQ ID NO: 20454 - protein, 19 aa, Artificial Sequence
  Description of Artificial Sequence: Synthetic peptide
  XENP018993 vhCDR2
EIRLKSNNYATHYAEPVKG

SEQ ID NO: 20455 - protein, 11 aa, Artificial Sequence
  Description of Artificial Sequence: Synthetic peptide
  XENP018993 vhCDR3
YYGNYGGYFDV

SEQ ID NO: 20456 - protein, 214 aa, Artificial Sequence; identical to SEQ ID NO: 16226
  Description of Artificial Sequence: Synthetic polypeptide
  XENP018993 1G6_H1.252_L1_IgG1_PVA_/S267K Light Chain

SEQ ID NO: 20457 - protein, 107 aa, Artificial Sequence; identical to SEQ ID NO: 10923
  Description of Artificial Sequence: Synthetic polypeptide
  VL of XENP018993

SEQ ID NO: 20458 - protein, 11 aa, Artificial Sequence
  Description of Artificial Sequence: Synthetic peptide
  XENP018993 vlCDR1
RASQSVSNDVA

SEQ ID NO: 20459 - protein, 7 aa, Artificial Sequence
  Description of Artificial Sequence: Synthetic peptide
  XENP018993 vlCDR2
YASHRYT

SEQ ID NO: 20460 - protein, 9 aa, Artificial Sequence
  Description of Artificial Sequence: Synthetic peptide
  XENP018993 vlCDR3
QQDYSSPRT

SEQ ID NO: 20461 - protein, 451 aa, Artificial Sequence
  Description of Artificial Sequence: Synthetic polypeptide
  XENP018994 1G6_H1.253_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSTVVLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 20462 - protein, 122 aa, Artificial Sequence; identical to SEQ ID NO: 14807
  Description of Artificial Sequence: Synthetic polypeptide
  VH of XENP018994

SEQ ID NO: 20463 - protein, 5 aa, Artificial Sequence
  Description of Artificial Sequence: Synthetic peptide
  XENP018994 vhCDR1
NYWMN

SEQ ID NO: 20464 - protein, 19 aa, Artificial Sequence
  Description of Artificial Sequence: Synthetic peptide
  XENP018994 vhCDR2
EIRLKSNNYATHYAEPVKG

SEQ ID NO: 20465 - protein, 11 aa, Artificial Sequence
  Description of Artificial Sequence: Synthetic peptide
  XENP018994 vhCDR3
YYGNYGGYFDV

SEQ ID NO: 20466 - protein, 214 aa, Artificial Sequence; identical to SEQ ID NO: 16226
  Description of Artificial Sequence: Synthetic polypeptide
  XENP018994 1G6_H1.253_L1_IgG1_PVA_/S267K Light Chain

SEQ ID NO: 20467 - protein, 107 aa, Artificial Sequence; identical to SEQ ID NO: 10923
  Description of Artificial Sequence: Synthetic polypeptide
  VL of XENP018994

SEQ ID NO: 20468 - protein, 11 aa, Artificial Sequence
  Description of Artificial Sequence: Synthetic peptide
  XENP018994 vlCDR1
RASQSVSNDVA

SEQ ID NO: 20469 - protein, 7 aa, Artificial Sequence
  Description of Artificial Sequence: Synthetic peptide
  XENP018994 vlCDR2
YASHRYT

SEQ ID NO: 20470 - protein, 9 aa, Artificial Sequence
  Description of Artificial Sequence: Synthetic peptide
  XENP018994 vlCDR3
QQDYSSPRT

SEQ ID NO: 20471 - protein, 451 aa, Artificial Sequence
  Description of Artificial Sequence: Synthetic polypeptide
  XENP018995 1G6_H1.254_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSTVYLEMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 20472 - protein, 122 aa, Artificial Sequence; identical to SEQ ID NO: 14816
  Description of Artificial Sequence: Synthetic polypeptide
  VH of XENP018995

SEQ ID NO: 20473 - protein, 5 aa, Artificial Sequence
  Description of Artificial Sequence: Synthetic peptide
  XENP018995 vhCDR1
NYWMN

SEQ ID NO: 20474 - protein, 19 aa, Artificial Sequence
  Description of Artificial Sequence: Synthetic peptide
  XENP018995 vhCDR2
EIRLKSNNYATHYAEPVKG

SEQ ID NO: 20475 - protein, 11 aa, Artificial Sequence
  Description of Artificial Sequence: Synthetic peptide
  XENP018995 vhCDR3
YYGNYGGYFDV

SEQ ID NO: 20476 - protein, 214 aa, Artificial Sequence; identical to SEQ ID NO: 16226
  Description of Artificial Sequence: Synthetic polypeptide
  XENP018995 1G6_H1.254_L1_IgG1_PVA_/S267K Light Chain

SEQ ID NO: 20477 - protein, 107 aa, Artificial Sequence; identical to SEQ ID NO: 10923
  Description of Artificial Sequence: Synthetic polypeptide
  VL of XENP018995

SEQ ID NO: 20478 - protein, 11 aa, Artificial Sequence
  Description of Artificial Sequence: Synthetic peptide
  XENP018995 vlCDR1
RASQSVSNDVA

SEQ ID NO: 20479 - protein, 7 aa, Artificial Sequence
  Description of Artificial Sequence: Synthetic peptide
  XENP018995 vlCDR2
YASHRYT

SEQ ID NO: 20480 - protein, 9 aa, Artificial Sequence
  Description of Artificial Sequence: Synthetic peptide
  XENP018995 vlCDR3
QQDYSSPRT

SEQ ID NO: 20481 - protein, 451 aa, Artificial Sequence
  Description of Artificial Sequence: Synthetic polypeptide
  XENP018996 1G6_H1.255_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSTVYLQMNSEKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 20482 - protein, 122 aa, Artificial Sequence; identical to SEQ ID NO: 14825
  Description of Artificial Sequence: Synthetic polypeptide
  VH of XENP018996

SEQ ID NO: 20483 - protein, 5 aa, Artificial Sequence
  Description of Artificial Sequence: Synthetic peptide
  XENP018996 vhCDR1
NYWMN

SEQ ID NO: 20484 - protein, 19 aa, Artificial Sequence
  Description of Artificial Sequence: Synthetic peptide
  XENP018996 vhCDR2
EIRLKSNNYATHYAEPVKG

SEQ ID NO: 20485 - protein, 11 aa, Artificial Sequence
  Description of Artificial Sequence: Synthetic peptide
  XENP018996 vhCDR3
YYGNYGGYFDV

SEQ ID NO: 20486 - protein, 214 aa, Artificial Sequence; identical to SEQ ID NO: 16226
  Description of Artificial Sequence: Synthetic polypeptide
  XENP018996 1G6_H1.255_L1_IgG1_PVA_/S267K Light Chain

SEQ ID NO: 20487 - protein, 107 aa, Artificial Sequence; identical to SEQ ID NO: 10923
  Description of Artificial Sequence: Synthetic polypeptide
  VL of XENP018996

SEQ ID NO: 20488 - protein, 11 aa, Artificial Sequence
  Description of Artificial Sequence: Synthetic peptide
  XENP018996 vlCDR1
RASQSVSNDVA

SEQ ID NO: 20489 - protein, 7 aa, Artificial Sequence
  Description of Artificial Sequence: Synthetic peptide
  XENP018996 vlCDR2
YASHRYT

SEQ ID NO: 20490 - protein, 9 aa, Artificial Sequence
  Description of Artificial Sequence: Synthetic peptide
  XENP018996 vlCDR3
QQDYSSPRT

SEQ ID NO: 20491 - protein, 451 aa, Artificial Sequence
  Description of Artificial Sequence: Synthetic polypeptide
  XENP019001 1G6_H1.256_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSTVYLQMNSVKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 20492 - protein, 122 aa, Artificial Sequence; identical to SEQ ID NO: 14834
  Description of Artificial Sequence: Synthetic polypeptide
  VH of XENP019001

SEQ ID NO: 20493 - protein, 5 aa, Artificial Sequence
  Description of Artificial Sequence: Synthetic peptide
  XENP019001 vhCDR1
NYWMN

SEQ ID NO: 20494 - protein, 19 aa, Artificial Sequence
  Description of Artificial Sequence: Synthetic peptide
  XENP019001 vhCDR2
EIRLKSNNYATHYAEPVKG

SEQ ID NO: 20495 - protein, 11 aa, Artificial Sequence
  Description of Artificial Sequence: Synthetic peptide
  XENP019001 vhCDR3
YYGNYGGYFDV

SEQ ID NO: 20496 - protein, 214 aa, Artificial Sequence; identical to SEQ ID NO: 16226
  Description of Artificial Sequence: Synthetic polypeptide
  XENP019001 1G6_H1.256_L1_IgG1_PVA_/S267K Light Chain

SEQ ID NO: 20497 - protein, 107 aa, Artificial Sequence; identical to SEQ ID NO: 10923
  Description of Artificial Sequence: Synthetic polypeptide
  VL of XENP019001

SEQ ID NO: 20498 - protein, 11 aa, Artificial Sequence
  Description of Artificial Sequence: Synthetic peptide
  XENP019001 vlCDR1
RASQSVSNDVA

SEQ ID NO: 20499 - protein, 7 aa, Artificial Sequence
  Description of Artificial Sequence: Synthetic peptide
  XENP019001 vlCDR2
YASHRYT

SEQ ID NO: 20500 - protein, 9 aa, Artificial Sequence
  Description of Artificial Sequence: Synthetic peptide
  XENP019001 vlCDR3
QQDYSSPRT

SEQ ID NO: 20501 - protein, 451 aa, Artificial Sequence
  Description of Artificial Sequence: Synthetic polypeptide
  XENP019002 1G6_H1.257_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 20502 - protein, 122 aa, Artificial Sequence; identical to SEQ ID NO: 14843
  Description of Artificial Sequence: Synthetic polypeptide
  VH of XENP019002

SEQ ID NO: 20503 - protein, 5 aa, Artificial Sequence
  Description of Artificial Sequence: Synthetic peptide
  XENP019002 vhCDR1
NYWMN

SEQ ID NO: 20504 - protein, 19 aa, Artificial Sequence
  Description of Artificial Sequence: Synthetic peptide
  XENP019002 vhCDR2
EIRLKSNNYATHYAEPVKG

SEQ ID NO: 20505 - protein, 11 aa, Artificial Sequence
  Description of Artificial Sequence: Synthetic peptide
  XENP019002 vhCDR3
YYGNYGGYFDV

SEQ ID NO: 20506 - protein, 214 aa, Artificial Sequence; identical to SEQ ID NO: 16226
  Description of Artificial Sequence: Synthetic polypeptide
  XENP019002 1G6_H1.257_L1_IgG1_PVA_/S267K Light Chain

SEQ ID NO: 20507 - protein, 107 aa, Artificial Sequence; identical to SEQ ID NO: 10923
  Description of Artificial Sequence: Synthetic polypeptide
  VL of XENP019002

SEQ ID NO: 20508 - protein, 11 aa, Artificial Sequence
  Description of Artificial Sequence: Synthetic peptide
  XENP019002 vlCDR1
RASQSVSNDVA

SEQ ID NO: 20509 - protein, 7 aa, Artificial Sequence
  Description of Artificial Sequence: Synthetic peptide
  XENP019002 vlCDR2
YASHRYT

SEQ ID NO: 20510 - protein, 9 aa, Artificial Sequence
  Description of Artificial Sequence: Synthetic peptide
  XENP019002 vlCDR3
QQDYSSPRT

SEQ ID NO: 20511 - protein, 451 aa, Artificial Sequence
  Description of Artificial Sequence: Synthetic polypeptide
  XENP019003 1G6_H1.258_L1_IgG1_PVA_/S267K Heavy Chain
EVQLVESGGGLKKPGESLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 20512 - protein, 122 aa, Artificial Sequence; identical to SEQ ID NO: 14852
  Description of Artificial Sequence: Synthetic polypeptide
  VH of XENP019003

SEQ ID NO: 20513 - protein, 5 aa, Artificial Sequence
  Description of Artificial Sequence: Synthetic peptide
  XENP019003 vhCDR1
NYWMN

SEQ ID NO: 20514 - protein, 19 aa, Artificial Sequence
  Description of Artificial Sequence: Synthetic peptide
  XENP019003 vhCDR2
EIRLKSNNYATHYAEPVKG

SEQ ID NO: 20515 - protein, 11 aa, Artificial Sequence
  Description of Artificial Sequence: Synthetic peptide
  XENP019003 vhCDR3
YYGNYGGYFDV

SEQ ID NO: 20516 - protein, 214 aa, Artificial Sequence; identical to SEQ ID NO: 16226
  Description of Artificial Sequence: Synthetic polypeptide
  XENP019003 1G6_H1.258_L1_IgG1_PVA_/S267K Light Chain

SEQ ID NO: 20517 - protein, 107 aa, Artificial Sequence; identical to SEQ ID NO: 10923
  Description of Artificial Sequence: Synthetic polypeptide
  VL of XENP019003

SEQ ID NO: 20518 - protein, 11 aa, Artificial Sequence
  Description of Artificial Sequence: Synthetic peptide
  XENP019003 vlCDR1
RASQSVSNDVA

SEQ ID NO: 20519 - protein, 7 aa, Artificial Sequence
  Description of Artificial Sequence: Synthetic peptide
  XENP019003 vlCDR2
YASHRYT

SEQ ID NO: 20520 - protein, 9 aa, Artificial Sequence
  Description of Artificial Sequence: Synthetic peptide
  XENP019003 vlCDR3
QQDYSSPRT

SEQ ID NO: 20521 - protein, 451 aa, Artificial Sequence
  Description of Artificial Sequence: Synthetic polypeptide
  XENP019004 1G6_H1.259_L1_IgG1_PVA_/S267K Heavy Chain
EVQLVESGGGLVKPGGSLRLSCAASGFTFSNYWMDWVRQAPGKGLEWVGEIRLKSNNYATHYAEPVKGRFTISRDDSKSTVYLQMNSLKTEDTAVYYCKRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 20522 - protein, 122 aa, Artificial Sequence; identical to SEQ ID NO: 14861
  Description of Artificial Sequence: Synthetic polypeptide
  VH of XENP019004

SEQ ID NO: 20523 - protein, 5 aa, Artificial Sequence
  Description of Artificial Sequence: Synthetic peptide
  XENP019004 vhCDR1
NYWMD

SEQ ID NO: 20524 - protein, 19 aa, Artificial Sequence
  Description of Artificial Sequence: Synthetic peptide
  XENP019004 vhCDR2
EIRLKSNNYATHYAEPVKG

SEQ ID NO: 20525 - protein, 11 aa, Artificial Sequence
  Description of Artificial Sequence: Synthetic peptide
  XENP019004 vhCDR3
YYGNYGGYFDV

SEQ ID NO: 20526 - protein, 214 aa, Artificial Sequence; identical to SEQ ID NO: 16226
  Description of Artificial Sequence: Synthetic polypeptide
  XENP019004 1G6_H1.259_L1_IgG1_PVA_/S267K Light Chain

SEQ ID NO: 20527 - protein, 107 aa, Artificial Sequence; identical to SEQ ID NO: 10923
  Description of Artificial Sequence: Synthetic polypeptide
  VL of XENP019004

SEQ ID NO: 20528 - protein, 11 aa, Artificial Sequence
  Description of Artificial Sequence: Synthetic peptide
  XENP019004 vlCDR1
RASQSVSNDVA

SEQ ID NO: 20529 - protein, 7 aa, Artificial Sequence
  Description of Artificial Sequence: Synthetic peptide
  XENP019004 vlCDR2
YASHRYT

SEQ ID NO: 20530 - protein, 9 aa, Artificial Sequence
  Description of Artificial Sequence: Synthetic peptide
  XENP019004 vlCDR3
QQDYSSPRT

SEQ ID NO: 20531 - protein, 451 aa, Artificial Sequence
  Description of Artificial Sequence: Synthetic polypeptide
  XENP019005 1G6_H1.260_L1_IgG1_PVA_/S267K Heavy Chain
EVQLVESGGGLVKPGESLRLSCAASGFTFSNYWMNWVRQAPGKGLEWVGEIRLKSNNYATHYAEPVKGRFTISRDDSKSTVYLQMNSRKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 20532 - protein, 122 aa, Artificial Sequence; identical to SEQ ID NO: 14870
  Description of Artificial Sequence: Synthetic polypeptide
  VH of XENP019005

SEQ ID NO: 20533 - protein, 5 aa, Artificial Sequence
  Description of Artificial Sequence: Synthetic peptide
  XENP019005 vhCDR1
NYWMN

SEQ ID NO: 20534 - protein, 19 aa, Artificial Sequence
  Description of Artificial Sequence: Synthetic peptide
  XENP019005 vhCDR2
EIRLKSNNYATHYAEPVKG

SEQ ID NO: 20535 - protein, 11 aa, Artificial Sequence
  Description of Artificial Sequence: Synthetic peptide
  XENP019005 vhCDR3
YYGNYGGYFDV

SEQ ID NO: 20536 - protein, 214 aa, Artificial Sequence; identical to SEQ ID NO: 16226
  Description of Artificial Sequence: Synthetic polypeptide
  XENP019005 1G6_H1.260_L1_IgG1_PVA_/S267K Light Chain

SEQ ID NO: 20537 - protein, 107 aa, Artificial Sequence; identical to SEQ ID NO: 10923
  Description of Artificial Sequence: Synthetic polypeptide
  VL of XENP019005

SEQ ID NO: 20538 - protein, 11 aa, Artificial Sequence
  Description of Artificial Sequence: Synthetic peptide
  XENP019005 vlCDR1
RASQSVSNDVA

SEQ ID NO: 20539 - protein, 7 aa, Artificial Sequence
  Description of Artificial Sequence: Synthetic peptide
  XENP019005 vlCDR2
YASHRYT

SEQ ID NO: 20540 - protein, 9 aa, Artificial Sequence
  Description of Artificial Sequence: Synthetic peptide
  XENP019005 vlCDR3
QQDYSSPRT

SEQ ID NO: 20541 - protein, 451 aa, Artificial Sequence
  Description of Artificial Sequence: Synthetic polypeptide
  XENP019006 1G6_H1.261_L1_IgG1_PVA_/S267K Heavy Chain
EVQLVESGGGLVKPGGSLRLSCKASGFTFSNYWMNWVRQAPGKGLEWVGEIRLKSNNYATHYAEPVKGRFTISRDDSKDTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 20542 - protein, 122 aa, Artificial Sequence; identical to SEQ ID NO: 14879
  Description of Artificial Sequence: Synthetic polypeptide
  VH of XENP019006

SEQ ID NO: 20543 - protein, 5 aa, Artificial Sequence
  Description of Artificial Sequence: Synthetic peptide
  XENP019006 vhCDR1
NYWMN

SEQ ID NO: 20544 - protein, 19 aa, Artificial Sequence
  Description of Artificial Sequence: Synthetic peptide
  XENP019006 vhCDR2
EIRLKSNNYATHYAEPVKG

SEQ ID NO: 20545 - protein, 11 aa, Artificial Sequence
  Description of Artificial Sequence: Synthetic peptide
  XENP019006 vhCDR3
YYGNYGGYFDV

SEQ ID NO: 20546 - protein, 214 aa, Artificial Sequence; identical to SEQ ID NO: 16226
  Description of Artificial Sequence: Synthetic polypeptide
  XENP019006 1G6_H1.261_L1_IgG1_PVA_/S267K Light Chain

SEQ ID NO: 20547 - protein, 107 aa, Artificial Sequence; identical to SEQ ID NO: 10923
  Description of Artificial Sequence: Synthetic polypeptide
  VL of XENP019006

SEQ ID NO: 20548 - protein, 11 aa, Artificial Sequence
  Description of Artificial Sequence: Synthetic peptide
  XENP019006 vlCDR1
RASQSVSNDVA

SEQ ID NO: 20549 - protein, 7 aa, Artificial Sequence
  Description of Artificial Sequence: Synthetic peptide
  XENP019006 vlCDR2
YASHRYT

SEQ ID NO: 20550 - protein, 9 aa, Artificial Sequence
  Description of Artificial Sequence: Synthetic peptide
  XENP019006 vlCDR3
QQDYSSPRT

SEQ ID NO: 20551 - protein, 451 aa, Artificial Sequence
  Description of Artificial Sequence: Synthetic polypeptide
  XENP019007 1G6_H1.262_L1_IgG1_PVA_/S267K Heavy Chain
EVQLVESGGGLVKPGESLRLSCAASGFTFSNYWMNWVRQAPGKGLEWVGEIRLKSNNYATHYAEPVKGRFTISRDDSKSTVYLQMNRLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 20552 - protein, 122 aa, Artificial Sequence; identical to SEQ ID NO: 14888
  Description of Artificial Sequence: Synthetic polypeptide
  VH of XENP019007

SEQ ID NO: 20553 - protein, 5 aa, Artificial Sequence
  Description of Artificial Sequence: Synthetic peptide
  XENP019007 vhCDR1
NYWMN

SEQ ID NO: 20554 - protein, 19 aa, Artificial Sequence
  Description of Artificial Sequence: Synthetic peptide
  XENP019007 vhCDR2
EIRLKSNNYATHYAEPVKG

SEQ ID NO: 20555 - protein, 11 aa, Artificial Sequence
  Description of Artificial Sequence: Synthetic peptide
  XENP019007 vhCDR3
YYGNYGGYFDV

SEQ ID NO: 20556 - protein, 214 aa, Artificial Sequence; identical to SEQ ID NO: 16226
  Description of Artificial Sequence: Synthetic polypeptide
  XENP019007 1G6_H1.262_L1_IgG1_PVA_/S267K Light Chain

SEQ ID NO: 20557 - protein, 107 aa, Artificial Sequence; identical to SEQ ID NO: 10923
  Description of Artificial Sequence: Synthetic polypeptide
  VL of XENP019007

SEQ ID NO: 20558 - protein, 11 aa, Artificial Sequence
  Description of Artificial Sequence: Synthetic peptide
  XENP019007 vlCDR1
RASQSVSNDVA

SEQ ID NO: 20559 - protein, 7 aa, Artificial Sequence
  Description of Artificial Sequence: Synthetic peptide
  XENP019007 vlCDR2
YASHRYT

SEQ ID NO: 20560 - protein, 9 aa, Artificial Sequence
  Description of Artificial Sequence: Synthetic peptide
  XENP019007 vlCDR3
QQDYSSPRT

SEQ ID NO: 20561 - protein, 451 aa, Artificial Sequence
  Description of Artificial Sequence: Synthetic polypeptide
  XENP019008 1G6_H1.263_L1_IgG1_PVA_/S267K Heavy Chain
EVQLVESGGGLVKPGGSLRLSCAASGFTFSNYWMNWVRQAPGKGLEWVGEIRLKSNNYATHYAEKVKGLFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 20562 - protein, 122 aa, Artificial Sequence; identical to SEQ ID NO: 14897
  Description of Artificial Sequence: Synthetic polypeptide
  VH of XENP019008

SEQ ID NO: 20563 - protein, 5 aa, Artificial Sequence
  Description of Artificial Sequence: Synthetic peptide
  XENP019008 vhCDR1
NYWMN

SEQ ID NO: 20564 - protein, 19 aa, Artificial Sequence
  Description of Artificial Sequence: Synthetic peptide
  XENP019008 vhCDR2
EIRLKSNNYATHYAEKVKG

SEQ ID NO: 20565 - protein, 11 aa, Artificial Sequence
  Description of Artificial Sequence: Synthetic peptide
  XENP019008 vhCDR3
YYGNYGGYFDV

SEQ ID NO: 20566 - protein, 214 aa, Artificial Sequence; identical to SEQ ID NO: 16226
  Description of Artificial Sequence: Synthetic polypeptide
  XENP019008 1G6_H1.263_L1_IgG1_PVA_/S267K Light Chain

SEQ ID NO: 20567 - protein, 107 aa, Artificial Sequence; identical to SEQ ID NO: 10923
  Description of Artificial Sequence: Synthetic polypeptide
  VL of XENP019008

SEQ ID NO: 20568 - protein, 11 aa, Artificial Sequence
  Description of Artificial Sequence: Synthetic peptide
  XENP019008 vlCDR1
RASQSVSNDVA

SEQ ID NO: 20569 - protein, 7 aa, Artificial Sequence
  Description of Artificial Sequence: Synthetic peptide
  XENP019008 vlCDR2
YASHRYT

SEQ ID NO: 20570 - protein, 9 aa, Artificial Sequence
  Description of Artificial Sequence: Synthetic peptide
  XENP019008 vlCDR3
QQDYSSPRT

SEQ ID NO: 20571 - protein, 451 aa, Artificial Sequence
  Description of Artificial Sequence: Synthetic polypeptide
  XENP019009 1G6_H1.264_L1_IgG1_PVA_/S267K Heavy Chain
EVQLVESGGGLVKPGGSLRLSCKASGDTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 20572 - protein, 122 aa, Artificial Sequence; identical to SEQ ID NO: 14906
  Description of Artificial Sequence: Synthetic polypeptide
  VH of XENP019009

SEQ ID NO: 20573 - protein, 5 aa, Artificial Sequence
  Description of Artificial Sequence: Synthetic peptide
  XENP019009 vhCDR1
NYWMN

SEQ ID NO: 20574 - protein, 19 aa, Artificial Sequence
  Description of Artificial Sequence: Synthetic peptide
  XENP019009 vhCDR2
EIRLKSNNYATHYAEPVKG

SEQ ID NO: 20575 - protein, 11 aa, Artificial Sequence
  Description of Artificial Sequence: Synthetic peptide
  XENP019009 vhCDR3
YYGNYGGYFDV

SEQ ID NO: 20576 - protein, 214 aa, Artificial Sequence; identical to SEQ ID NO: 16226
  Description of Artificial Sequence: Synthetic polypeptide
  XENP019009 1G6_H1.264_L1_IgG1_PVA_/S267K Light Chain

SEQ ID NO: 20577 - protein, 107 aa, Artificial Sequence; identical to SEQ ID NO: 10923
  Description of Artificial Sequence: Synthetic polypeptide
  VL of XENP019009

SEQ ID NO: 20578 - protein, 11 aa, Artificial Sequence
  Description of Artificial Sequence: Synthetic peptide
  XENP019009 vlCDR1
RASQSVSNDVA

SEQ ID NO: 20579 - protein, 7 aa, Artificial Sequence
  Description of Artificial Sequence: Synthetic peptide
  XENP019009 vlCDR2
YASHRYT

SEQ ID NO: 20580 - protein, 9 aa, Artificial Sequence
  Description of Artificial Sequence: Synthetic peptide
  XENP019009 vlCDR3
QQDYSSPRT

SEQ ID NO: 20581 - protein, 451 aa, Artificial Sequence
  Description of Artificial Sequence: Synthetic polypeptide
  XENP019010 1G6_H1.265_L1_IgG1_PVA_/S267K Heavy Chain
EVQLVESGGGLVKPGESLRLSCAASGFTFSNYWMNWVRQAPGKGLEWVGEIRLKSNNYATHYAEPVKGRFTISRDDSKSTVYLKMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 20582 - protein, 122 aa, Artificial Sequence; identical to SEQ ID NO: 14915
  Description of Artificial Sequence: Synthetic polypeptide
  VH of XENP019010

SEQ ID NO: 20583 - protein, 5 aa, Artificial Sequence
  Description of Artificial Sequence: Synthetic peptide
  XENP019010 vhCDR1
NYWMN

SEQ ID NO: 20584 - protein, 19 aa, Artificial Sequence
  Description of Artificial Sequence: Synthetic peptide
  XENP019010 vhCDR2
EIRLKSNNYATHYAEPVKG

SEQ ID NO: 20585 - protein, 11 aa, Artificial Sequence
  Description of Artificial Sequence: Synthetic peptide
  XENP019010 vhCDR3
YYGNYGGYFDV

SEQ ID NO: 20586 - protein, 214 aa, Artificial Sequence; identical to SEQ ID NO: 16226
  Description of Artificial Sequence: Synthetic polypeptide
  XENP019010 1G6_H1.265_L1_IgG1_PVA_/S267K Light Chain

SEQ ID NO: 20587 - protein, 107 aa, Artificial Sequence; identical to SEQ ID NO: 10923
  Description of Artificial Sequence: Synthetic polypeptide
  VL of XENP019010

SEQ ID NO: 20588 - protein, 11 aa, Artificial Sequence
  Description of Artificial Sequence: Synthetic peptide
  XENP019010 vlCDR1
RASQSVSNDVA

SEQ ID NO: 20589 - protein, 7 aa, Artificial Sequence
  Description of Artificial Sequence: Synthetic peptide
  XENP019010 vlCDR2
YASHRYT

SEQ ID NO: 20590 - protein, 9 aa, Artificial Sequence
  Description of Artificial Sequence: Synthetic peptide
  XENP019010 vlCDR3
QQDYSSPRT

SEQ ID NO: 20591 - protein, 451 aa, Artificial Sequence
  Description of Artificial Sequence: Synthetic polypeptide
  XENP019011 1G6_H1.266_L1_IgG1_PVA_/S267K Heavy Chain
EVQLVESGGGLVKPGGSLRLSCAASGFTFSNYWMNWVRQAPGKGLEWVGEIRLKSNNYATHYAQPVKDRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 20592 - protein, 122 aa, Artificial Sequence; identical to SEQ ID NO: 14924
  Description of Artificial Sequence: Synthetic polypeptide
  VH of XENP019011

SEQ ID NO: 20593 - protein, 5 aa, Artificial Sequence
  Description of Artificial Sequence: Synthetic peptide
  XENP019011 vhCDR1
NYWMN

SEQ ID NO: 20594 - protein, 19 aa, Artificial Sequence
  Description of Artificial Sequence: Synthetic peptide
  XENP019011 vhCDR2
EIRLKSNNYATHYAQPVKD

SEQ ID NO: 20595 - protein, 11 aa, Artificial Sequence
  Description of Artificial Sequence: Synthetic peptide
  XENP019011 vhCDR3
YYGNYGGYFDV

SEQ ID NO: 20596 - protein, 214 aa, Artificial Sequence; identical to SEQ ID NO: 16226
  Description of Artificial Sequence: Synthetic polypeptide
  XENP019011 1G6_H1.266_L1_IgG1_PVA_/S267K Light Chain

SEQ ID NO: 20597 - protein, 107 aa, Artificial Sequence; identical to SEQ ID NO: 10923
  Description of Artificial Sequence: Synthetic polypeptide
  VL of XENP019011

SEQ ID NO: 20598 - protein, 11 aa, Artificial Sequence
  Description of Artificial Sequence: Synthetic peptide
  XENP019011 vlCDR1
RASQSVSNDVA

SEQ ID NO: 20599 - protein, 7 aa, Artificial Sequence
  Description of Artificial Sequence: Synthetic peptide
  XENP019011 vlCDR2
YASHRYT

SEQ ID NO: 20600 - protein, 9 aa, Artificial Sequence
  Description of Artificial Sequence: Synthetic peptide
  XENP019011 vlCDR3
QQDYSSPRT

SEQ ID NO: 20601 - protein, 451 aa, Artificial Sequence
  Description of Artificial Sequence: Synthetic polypeptide
  XENP019012 1G6_H1.267_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSTVYLEMNSRKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 20602 - protein, 122 aa, Artificial Sequence; identical to SEQ ID NO: 14933
  Description of Artificial Sequence: Synthetic polypeptide
  VH of XENP019012

SEQ ID NO: 20603 - protein, 5 aa, Artificial Sequence
  Description of Artificial Sequence: Synthetic peptide
  XENP019012 vhCDR1
NYWMN

SEQ ID NO: 20604 - protein, 19 aa, Artificial Sequence
  Description of Artificial Sequence: Synthetic peptide
  XENP019012 vhCDR2
EIRLKSNNYATHYAEPVKG

SEQ ID NO: 20605 - protein, 11 aa, Artificial Sequence
  Description of Artificial Sequence: Synthetic peptide
  XENP019012 vhCDR3
YYGNYGGYFDV

SEQ ID NO: 20606 - protein, 214 aa, Artificial Sequence; identical to SEQ ID NO: 16226
  Description of Artificial Sequence: Synthetic polypeptide
  XENP019012 1G6_H1.267_L1_IgG1_PVA_/S267K Light Chain

SEQ ID NO: 20607 - protein, 107 aa, Artificial Sequence; identical to SEQ ID NO: 10923
  Description of Artificial Sequence: Synthetic polypeptide
  VL of XENP019012

SEQ ID NO: 20608 - protein, 11 aa, Artificial Sequence
  Description of Artificial Sequence: Synthetic peptide
  XENP019012 vlCDR1
RASQSVSNDVA

SEQ ID NO: 20609 - protein, 7 aa, Artificial Sequence
  Description of Artificial Sequence: Synthetic peptide
  XENP019012 vlCDR2
YASHRYT

SEQ ID NO: 20610 - protein, 9 aa, Artificial Sequence
  Description of Artificial Sequence: Synthetic peptide
  XENP019012 vlCDR3
QQDYSSPRT

SEQ ID NO: 20611 - protein, 451 aa, Artificial Sequence
  Description of Artificial Sequence: Synthetic polypeptide
  XENP019013 1G6_H1.268_L1_IgG1_PVA_/S267K Heavy Chain
EVQLVESGGGLVKPGESLRLSCAASGFTFSNYWMNWVRQAPGKGLEWVGEIRLKSNNYATHYAEPVKGRFTISRDDSKSTVYLQMRSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 20612 - protein, 122 aa, Artificial Sequence; identical to SEQ ID NO: 14942
  Description of Artificial Sequence: Synthetic polypeptide
  VH of XENP019013

SEQ ID NO: 20613 - protein, 5 aa, Artificial Sequence
  Description of Artificial Sequence: Synthetic peptide
  XENP019013 vhCDR1
NYWMN

SEQ ID NO: 20614 - protein, 19 aa, Artificial Sequence
  Description of Artificial Sequence: Synthetic peptide
  XENP019013 vhCDR2
EIRLKSNNYATHYAEPVKG

SEQ ID NO: 20615 - protein, 11 aa, Artificial Sequence
  Description of Artificial Sequence: Synthetic peptide
  XENP019013 vhCDR3
YYGNYGGYFDV

SEQ ID NO: 20616 - protein, 214 aa, Artificial Sequence; identical to SEQ ID NO: 16226
  Description of Artificial Sequence: Synthetic polypeptide
  XENP019013 1G6_H1.268_L1_IgG1_PVA_/S267K Light Chain

SEQ ID NO: 20617 - protein, 107 aa, Artificial Sequence; identical to SEQ ID NO: 10923
  Description of Artificial Sequence: Synthetic polypeptide
  VL of XENP019013

SEQ ID NO: 20618 - protein, 11 aa, Artificial Sequence
  Description of Artificial Sequence: Synthetic peptide
  XENP019013 vlCDR1
RASQSVSNDVA

SEQ ID NO: 20619 - protein, 7 aa, Artificial Sequence
  Description of Artificial Sequence: Synthetic peptide
  XENP019013 vlCDR2
YASHRYT

SEQ ID NO: 20620 - protein, 9 aa, Artificial Sequence
  Description of Artificial Sequence: Synthetic peptide
  XENP019013 vlCDR3
QQDYSSPRT

SEQ ID NO: 20621 - protein, 451 aa, Artificial Sequence
  Description of Artificial Sequence: Synthetic polypeptide
  XENP019014 1G6_H1.269_L1_IgG1_PVA_/S267K Heavy Chain
EVQLVESGGGLVKPGGSLRLSCAASGFTFSNFWMNWVRQAPGKGLEWVGEIRLYSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 20622 - protein, 122 aa, Artificial Sequence; identical to SEQ ID NO: 14951
  Description of Artificial Sequence: Synthetic polypeptide
  VH of XENP019014

SEQ ID NO: 20623 - protein, 5 aa, Artificial Sequence
  Description of Artificial Sequence: Synthetic peptide
  XENP019014 vhCDR1
NFWMN

SEQ ID NO: 20624 - protein, 19 aa, Artificial Sequence
  Description of Artificial Sequence: Synthetic peptide
  XENP019014 vhCDR2
EIRLYSNNYATHYAEPVKG

SEQ ID NO: 20625 - protein, 11 aa, Artificial Sequence
  Description of Artificial Sequence: Synthetic peptide
  XENP019014 vhCDR3
YYGNYGGYFDV

SEQ ID NO: 20626 - protein, 214 aa, Artificial Sequence; identical to SEQ ID NO: 16226
  Description of Artificial Sequence: Synthetic polypeptide
  XENP019014 1G6_H1.269_L1_IgG1_PVA_/S267K Light Chain

SEQ ID NO: 20627 - protein, 107 aa, Artificial Sequence; identical to SEQ ID NO: 10923
  Description of Artificial Sequence: Synthetic polypeptide
  VL of XENP019014

SEQ ID NO: 20628 - protein, 11 aa, Artificial Sequence
  Description of Artificial Sequence: Synthetic peptide
  XENP019014 vlCDR1
RASQSVSNDVA

SEQ ID NO: 20629 - protein, 7 aa, Artificial Sequence
  Description of Artificial Sequence: Synthetic peptide
  XENP019014 vlCDR2
YASHRYT

SEQ ID NO: 20630 - protein, 9 aa, Artificial Sequence
  Description of Artificial Sequence: Synthetic peptide
  XENP019014 vlCDR3
QQDYSSPRT

SEQ ID NO: 20631 - protein, 451 aa, Artificial Sequence
  Description of Artificial Sequence: Synthetic polypeptide
  XENP019015 1G6_H1.270_L1_IgG1_PVA_/S267K Heavy Chain
EVQLVESGGGLVKPGGSLRLSCAASGFTFSNYWMNWVRQAPGKGLEWVGEIRWYSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 20632 - protein, 122 aa, Artificial Sequence; identical to SEQ ID NO: 14960
  Description of Artificial Sequence: Synthetic polypeptide
  VH of XENP019015

SEQ ID NO: 20633 - protein, 5 aa, Artificial Sequence
  Description of Artificial Sequence: Synthetic peptide
  XENP019015 vhCDR1
NYWMN

SEQ ID NO: 20634 - protein, 19 aa, Artificial Sequence
  Description of Artificial Sequence: Synthetic peptide
  XENP019015 vhCDR2
EIRWYSNNYATHYAEPVKG

SEQ ID NO: 20635 - protein, 11 aa, Artificial Sequence
  Description of Artificial Sequence: Synthetic peptide
  XENP019015 vhCDR3
YYGNYGGYFDV

SEQ ID NO: 20636 - protein, 214 aa, Artificial Sequence; identical to SEQ ID NO: 16226
  Description of Artificial Sequence: Synthetic polypeptide
  XENP019015 1G6_H1.270_L1_IgG1_PVA_/S267K Light Chain

SEQ ID NO: 20637 - protein, 107 aa, Artificial Sequence; identical to SEQ ID NO: 10923
  Description of Artificial Sequence: Synthetic polypeptide
  VL of XENP019015

SEQ ID NO: 20638 - protein, 11 aa, Artificial Sequence
  Description of Artificial Sequence: Synthetic peptide
  XENP019015 vlCDR1
RASQSVSNDVA

SEQ ID NO: 20639 - protein, 7 aa, Artificial Sequence
  Description of Artificial Sequence: Synthetic peptide
  XENP019015 vlCDR2
YASHRYT

SEQ ID NO: 20640 - protein, 9 aa, Artificial Sequence
  Description of Artificial Sequence: Synthetic peptide
  XENP019015 vlCDR3
QQDYSSPRT

SEQ ID NO: 20641 - protein, 451 aa, Artificial Sequence
  Description of Artificial Sequence: Synthetic polypeptide
  XENP019016 1G6_H1.271_L1_IgG1_PVA_/S267K Heavy Chain
EVQLVESGGGLVKPGGSLRLSCAASGFTFSNYWMNWVRQAPGKGLEWVGEIRLYSNNYATHYAEPVKGRFTISRDDSKSTLYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 20642 - protein, 122 aa, Artificial Sequence; identical to SEQ ID NO: 14969
  Description of Artificial Sequence: Synthetic polypeptide
  VH of XENP019016

SEQ ID NO: 20643 - protein, 5 aa, Artificial Sequence
  Description of Artificial Sequence: Synthetic peptide
  XENP019016 vhCDR1
NYWMN

SEQ ID NO: 20644 - protein, 19 aa, Artificial Sequence
  Description of Artificial Sequence: Synthetic peptide
  XENP019016 vhCDR2
EIRLYSNNYATHYAEPVKG

SEQ ID NO: 20645 - protein, 11 aa, Artificial Sequence
  Description of Artificial Sequence: Synthetic peptide
  XENP019016 vhCDR3
YYGNYGGYFDV

SEQ ID NO: 20646 - protein, 214 aa, Artificial Sequence; identical to SEQ ID NO: 16226
  Description of Artificial Sequence: Synthetic polypeptide
  XENP019016 1G6_H1.271_L1_IgG1_PVA_/S267K Light Chain

SEQ ID NO: 20647 - protein, 107 aa, Artificial Sequence; identical to SEQ ID NO: 10923
  Description of Artificial Sequence: Synthetic polypeptide
  VL of XENP019016

SEQ ID NO: 20648 - protein, 11 aa, Artificial Sequence
  Description of Artificial Sequence: Synthetic peptide
  XENP019016 vlCDR1
RASQSVSNDVA

SEQ ID NO: 20649 - protein, 7 aa, Artificial Sequence
  Description of Artificial Sequence: Synthetic peptide
  XENP019016 vlCDR2
YASHRYT

SEQ ID NO: 20650 - protein, 9 aa, Artificial Sequence
  Description of Artificial Sequence: Synthetic peptide
  XENP019016 vlCDR3
QQDYSSPRT

SEQ ID NO: 20651 - protein, 451 aa, Artificial Sequence
  Description of Artificial Sequence: Synthetic polypeptide
  XENP019017 1G6_H1.272_L1_IgG1_PVA_/S267K Heavy Chain
EVQLVESGGGLVKPGGSLRLSCAASGFTFSNFWMNWVRQAPGKGLEWVGEIRLYSNNYATHYAEPVKGRFTISRDDSKSTLYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 20652 - protein, 122 aa, Artificial Sequence; identical to SEQ ID NO: 14978
  Description of Artificial Sequence: Synthetic polypeptide
  VH of XENP019017

SEQ ID NO: 20653 - protein, 5 aa, Artificial Sequence
  Description of Artificial Sequence: Synthetic peptide
  XENP019017 vhCDR1
NFWMN

SEQ ID NO: 20654 - protein, 19 aa, Artificial Sequence
  Description of Artificial Sequence: Synthetic peptide
  XENP019017 vhCDR2
EIRLYSNNYATHYAEPVKG

SEQ ID NO: 20655 - protein, 11 aa, Artificial Sequence
  Description of Artificial Sequence: Synthetic peptide
  XENP019017 vhCDR3
YYGNYGGYFDV

SEQ ID NO: 20656 - protein, 214 aa, Artificial Sequence; identical to SEQ ID NO: 16226
  Description of Artificial Sequence: Synthetic polypeptide
  XENP019017 1G6_H1.272_L1_IgG1_PVA_/S267K Light Chain

SEQ ID NO: 20657 - protein, 107 aa, Artificial Sequence; identical to SEQ ID NO: 10923
  Description of Artificial Sequence: Synthetic polypeptide
  VL of XENP019017

SEQ ID NO: 20658 - protein, 11 aa, Artificial Sequence
  Description of Artificial Sequence: Synthetic peptide
  XENP019017 vlCDR1
RASQSVSNDVA

SEQ ID NO: 20659 - protein, 7 aa, Artificial Sequence
  Description of Artificial Sequence: Synthetic peptide
  XENP019017 vlCDR2
YASHRYT

SEQ ID NO: 20660 - protein, 9 aa, Artificial Sequence
  Description of Artificial Sequence: Synthetic peptide
  XENP019017 vlCDR3
QQDYSSPRT

SEQ ID NO: 20661 - protein, 451 aa, Artificial Sequence
  Description of Artificial Sequence: Synthetic polypeptide
  XENP019018 1G6_H1.273_L1_IgG1_PVA_/S267K Heavy Chain
EVQLVESGGGLVKPGGSLRLSCAASGFTFSNFWMNWVRQAPGKGLEWVGEIRWKSNNYATHYAEPVKGRFTISRDDSKSTLYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 20662 - protein, 122 aa, Artificial Sequence; identical to SEQ ID NO: 14987
  Description of Artificial Sequence: Synthetic polypeptide
  VH of XENP019018

SEQ ID NO: 20663 - protein, 5 aa, Artificial Sequence
  Description of Artificial Sequence: Synthetic peptide
  XENP019018 vhCDR1
NFWMN

SEQ ID NO: 20664 - protein, 19 aa, Artificial Sequence
  Description of Artificial Sequence: Synthetic peptide
  XENP019018 vhCDR2
EIRWKSNNYATHYAEPVKG

SEQ ID NO: 20665 - protein, 11 aa, Artificial Sequence
  Description of Artificial Sequence: Synthetic peptide
  XENP019018 vhCDR3
YYGNYGGYFDV

SEQ ID NO: 20666 - protein, 214 aa, Artificial Sequence; identical to SEQ ID NO: 16226
  Description of Artificial Sequence: Synthetic polypeptide
  XENP019018 1G6_H1.273_L1_IgG1_PVA_/S267K Light Chain

SEQ ID NO: 20667 - protein, 107 aa, Artificial Sequence; identical to SEQ ID NO: 10923
  Description of Artificial Sequence: Synthetic polypeptide
  VL of XENP019018

SEQ ID NO: 20668 - protein, 11 aa, Artificial Sequence
  Description of Artificial Sequence: Synthetic peptide
  XENP019018 vlCDR1
RASQSVSNDVA

SEQ ID NO: 20669 - protein, 7 aa, Artificial Sequence
  Description of Artificial Sequence: Synthetic peptide
  XENP019018 vlCDR2
YASHRYT

SEQ ID NO: 20670 - protein, 9 aa, Artificial Sequence
  Description of Artificial Sequence: Synthetic peptide
  XENP019018 vlCDR3
QQDYSSPRT

SEQ ID NO: 20671 - protein, 451 aa, Artificial Sequence
  Description of Artificial Sequence: Synthetic polypeptide
  XENP019019 1G6_H1.274_L1_IgG1_PVA_/S267K Heavy Chain
EVQLVESGGGLVKPGGSLRLSCAASGFTFSNFWMNWVRQAPGKGLEWVGEIRLKKNNYATHYAEPVKGRFTISRDDSKSTLYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 20672 - protein, 122 aa, Artificial Sequence; identical to SEQ ID NO: 14996
  Description of Artificial Sequence: Synthetic polypeptide
  VH of XENP019019

SEQ ID NO: 20673 - protein, 5 aa, Artificial Sequence
  Description of Artificial Sequence: Synthetic peptide
  XENP019019 vhCDR1
NFWMN

SEQ ID NO: 20674 - protein, 19 aa, Artificial Sequence
  Description of Artificial Sequence: Synthetic peptide
  XENP019019 vhCDR2
EIRLKKNNYATHYAEPVKG

SEQ ID NO: 20675 - protein, 11 aa, Artificial Sequence
  Description of Artificial Sequence: Synthetic peptide
  XENP019019 vhCDR3
YYGNYGGYFDV

SEQ ID NO: 20676 - protein, 214 aa, Artificial Sequence; identical to SEQ ID NO: 16226
  Description of Artificial Sequence: Synthetic polypeptide
  XENP019019 1G6_H1.274_L1_IgG1_PVA_/S267K Light Chain

SEQ ID NO: 20677 - protein, 107 aa, Artificial Sequence; identical to SEQ ID NO: 10923
  Description of Artificial Sequence: Synthetic polypeptide
  VL of XENP019019

SEQ ID NO: 20678 - protein, 11 aa, Artificial Sequence
  Description of Artificial Sequence: Synthetic peptide
  XENP019019 vlCDR1
RASQSVSNDVA

SEQ ID NO: 20679 - protein, 7 aa, Artificial Sequence
  Description of Artificial Sequence: Synthetic peptide
  XENP019019 vlCDR2
YASHRYT

SEQ ID NO: 20680 - protein, 9 aa, Artificial Sequence
  Description of Artificial Sequence: Synthetic peptide
  XENP019019 vlCDR3
QQDYSSPRT

SEQ ID NO: 20681 - protein, 451 aa, Artificial Sequence
  Description of Artificial Sequence: Synthetic polypeptide
  XENP019020 1G6_H1.275_L1_IgG1_PVA_/S267K Heavy Chain
EVQLVESGGGLVKPGGSLRLSCAASGFTFSNFWMNWVRQAPGKGLEWVGEIRWYSNNYATHYAEPVKGRFTISRDDSKSTLYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 20682 - protein, 122 aa, Artificial Sequence; identical to SEQ ID NO: 15005
  Description of Artificial Sequence: Synthetic polypeptide
  VH of XENP019020

SEQ ID NO: 20683 - protein, 5 aa, Artificial Sequence
  Description of Artificial Sequence: Synthetic peptide
  XENP019020 vhCDR1
NFWMN

SEQ ID NO: 20684 - protein, 19 aa, Artificial Sequence
  Description of Artificial Sequence: Synthetic peptide
  XENP019020 vhCDR2
EIRWYSNNYATHYAEPVKG

SEQ ID NO: 20685 - protein, 11 aa, Artificial Sequence
  Description of Artificial Sequence: Synthetic peptide
  XENP019020 vhCDR3
YYGNYGGYFDV

SEQ ID NO: 20686 - protein, 214 aa, Artificial Sequence; identical to SEQ ID NO: 16226
  Description of Artificial Sequence: Synthetic polypeptide
  XENP019020 1G6_H1.275_L1_IgG1_PVA_/S267K Light Chain

SEQ ID NO: 20687 - protein, 107 aa, Artificial Sequence; identical to SEQ ID NO: 10923
  Description of Artificial Sequence: Synthetic polypeptide
  VL of XENP019020

SEQ ID NO: 20688 - protein, 11 aa, Artificial Sequence
  Description of Artificial Sequence: Synthetic peptide
  XENP019020 vlCDR1
RASQSVSNDVA

SEQ ID NO: 20689 - protein, 7 aa, Artificial Sequence
  Description of Artificial Sequence: Synthetic peptide
  XENP019020 vlCDR2
YASHRYT

SEQ ID NO: 20690 - protein, 9 aa, Artificial Sequence
  Description of Artificial Sequence: Synthetic peptide
  XENP019020 vlCDR3
QQDYSSPRT

SEQ ID NO: 20691 - protein, 451 aa, Artificial Sequence
  Description of Artificial Sequence: Synthetic polypeptide
  XENP019021 1G6_H1.276_L1_IgG1_PVA_/S267K Heavy Chain
EVQLVESGGGLVQPGGSLKLSCAASGFTFSNYWMNWVRQAPGKGLEWVGEIRLKSNNYATHYAASVKGRFTISRDDSKSTLYLQMNSLKTEDTAVYYCTRYYGNYGGYFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 20692 - protein, 122 aa, Artificial Sequence; identical to SEQ ID NO: 15014
  Description of Artificial Sequence: Synthetic polypeptide
  VH of XENP019021

SEQ ID NO: 20693 - protein, 5 aa, Artificial Sequence
  Description of Artificial Sequence: Synthetic peptide
  XENP019021 vhCDR1
NYWMN

SEQ ID NO: 20694 - protein, 19 aa, Artificial Sequence
  Description of Artificial Sequence: Synthetic peptide
  XENP019021 vhCDR2
EIRLKSNNYATHYAASVKG

SEQ ID NO: 20695 - protein, 11 aa, Artificial Sequence
  Description of Artificial Sequence: Synthetic peptide
  XENP019021 vhCDR3
YYGNYGGYFDV

SEQ ID NO: 20696 - protein, 214 aa, Artificial Sequence; identical to SEQ ID NO: 16226
  Description of Artificial Sequence: Synthetic polypeptide
  XENP019021 1G6_H1.276_L1_IgG1_PVA_/S267K Light Chain

SEQ ID NO: 20697 - protein, 107 aa, Artificial Sequence; identical to SEQ ID NO: 10923
  Description of Artificial Sequence: Synthetic polypeptide
  VL of XENP019021

SEQ ID NO: 20698 - protein, 11 aa, Artificial Sequence
  Description of Artificial Sequence: Synthetic peptide
  XENP019021 vlCDR1
RASQSVSNDVA

SEQ ID NO: 20699 - protein, 7 aa, Artificial Sequence
  Description of Artificial Sequence: Synthetic peptide
  XENP019021 vlCDR2
YASHRYT

SEQ ID NO: 20700 - protein, 9 aa, Artificial Sequence
  Description of Artificial Sequence: Synthetic peptide
  XENP019021 vlCDR3
QQDYSSPRT

SEQ ID NO: 20701 - protein, 451 aa, Artificial Sequence
  Description of Artificial Sequence: Synthetic polypeptide
  XENP019022 1G6_H1.277_L1_IgG1_PVA_/S267K Heavy Chain
EVQLVESGGGLVKPGGSLKLSCAASGFTFSNYWMNWVRQAPGKGLEWVGEIRLKSNNYATHYADSVKGRFTISRDDSKSTLYLQMNSLKTEDTAVYYCTRYYGNYGGYFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 20702 - protein, 122 aa, Artificial Sequence; identical to SEQ ID NO: 15023
  Description of Artificial Sequence: Synthetic polypeptide
  VH of XENP019022

SEQ ID NO: 20703 - protein, 5 aa, Artificial Sequence
  Description of Artificial Sequence: Synthetic peptide
  XENP019022 vhCDR1
NYWMN

SEQ ID NO: 20704 - protein, 19 aa, Artificial Sequence
  Description of Artificial Sequence: Synthetic peptide
  XENP019022 vhCDR2
EIRLKSNNYATHYADSVKG

SEQ ID NO: 20705 - protein, 11 aa, Artificial Sequence
  Description of Artificial Sequence: Synthetic peptide
  XENP019022 vhCDR3
YYGNYGGYFDV

SEQ ID NO: 20706 - protein, 214 aa, Artificial Sequence; identical to SEQ ID NO: 16226
  Description of Artificial Sequence: Synthetic polypeptide
  XENP019022 1G6_H1.277_L1_IgG1_PVA_/S267K Light Chain

SEQ ID NO: 20707 - protein, 107 aa, Artificial Sequence; identical to SEQ ID NO: 10923
  Description of Artificial Sequence: Synthetic polypeptide
  VL of XENP019022

SEQ ID NO: 20708 - protein, 11 aa, Artificial Sequence
  Description of Artificial Sequence: Synthetic peptide
  XENP019022 vlCDR1
RASQSVSNDVA

SEQ ID NO: 20709 - protein, 7 aa, Artificial Sequence
  Description of Artificial Sequence: Synthetic peptide
  XENP019022 vlCDR2
YASHRYT

SEQ ID NO: 20710 - protein, 9 aa, Artificial Sequence
  Description of Artificial Sequence: Synthetic peptide
  XENP019022 vlCDR3
QQDYSSPRT

SEQ ID NO: 20711 - protein, 451 aa, Artificial Sequence; identical to SEQ ID NO: 16221
  Description of Artificial Sequence: Synthetic polypeptide
  XENP019023 1G6_H1_L1.146_IgG1_PVA_/S267K Heavy Chain

SEQ ID NO: 20712 - protein, 122 aa, Artificial Sequence; identical to SEQ ID NO: 10922
  Description of Artificial Sequence: Synthetic polypeptide
  VH of XENP019023

SEQ ID NO: 20713 - protein, 5 aa, Artificial Sequence
  Description of Artificial Sequence: Synthetic peptide
  XENP019023 vhCDR1
NYWMN

SEQ ID NO: 20714 - protein, 19 aa, Artificial Sequence
  Description of Artificial Sequence: Synthetic peptide
  XENP019023 vhCDR2
EIRLKSNNYATHYAEPVKG

SEQ ID NO: 20715 - protein, 11 aa, Artificial Sequence
  Description of Artificial Sequence: Synthetic peptide
  XENP019023 vhCDR3
YYGNYGGYFDV

SEQ ID NO: 20716 - protein, 214 aa, Artificial Sequence
  Description of Artificial Sequence: Synthetic polypeptide
  XENP019023 1G6_H1_L1.146_IgG1_PVA_/S267K Light Chain
SIVMTQSPATLAVSPGERATLSCRASQSVSNDVAWYQQKPGQSPRLLINYASHRYTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 20717 - protein, 107 aa, Artificial Sequence; identical to SEQ ID NO: 15033
  Description of Artificial Sequence: Synthetic polypeptide
  VL of XENP019023

SEQ ID NO: 20718 - protein, 11 aa, Artificial Sequence
  Description of Artificial Sequence: Synthetic peptide
  XENP019023 vlCDR1
RASQSVSNDVA

SEQ ID NO: 20719 - protein, 7 aa, Artificial Sequence
  Description of Artificial Sequence: Synthetic peptide
  XENP019023 vlCDR2
YASHRYT

SEQ ID NO: 20720 - protein, 9 aa, Artificial Sequence
  Description of Artificial Sequence: Synthetic peptide
  XENP019023 vlCDR3
QQDYSSPRT

SEQ ID NO: 20721 - protein, 451 aa, Artificial Sequence; identical to SEQ ID NO: 16221
  Description of Artificial Sequence: Synthetic polypeptide
  XENP019024 1G6_H1_L1.147_IgG1_PVA_/S267K Heavy Chain

SEQ ID NO: 20722 - protein, 122 aa, Artificial Sequence; identical to SEQ ID NO: 10922
  Description of Artificial Sequence: Synthetic polypeptide
  VH of XENP019024

SEQ ID NO: 20723 - protein, 5 aa, Artificial Sequence
  Description of Artificial Sequence: Synthetic peptide
  XENP019024 vhCDR1
NYWMN

SEQ ID NO: 20724 - protein, 19 aa, Artificial Sequence
  Description of Artificial Sequence: Synthetic peptide
  XENP019024 vhCDR2
EIRLKSNNYATHYAEPVKG

SEQ ID NO: 20725 - protein, 11 aa, Artificial Sequence
  Description of Artificial Sequence: Synthetic peptide
  XENP019024 vhCDR3
YYGNYGGYFDV

SEQ ID NO: 20726 - protein, 214 aa, Artificial Sequence
  Description of Artificial Sequence: Synthetic polypeptide
  XENP019024 1G6_H1_L1.147_IgG1_PVA_/S267K Light Chain
SIVMTQSPATLPVSPGERATLSCRASQSVSNDVAWYQQKPGQSPRLLINYASHRYTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 20727 - protein, 107 aa, Artificial Sequence; identical to SEQ ID NO: 15042
  Description of Artificial Sequence: Synthetic polypeptide
  VL of XENP019024

SEQ ID NO: 20728 - protein, 11 aa, Artificial Sequence
  Description of Artificial Sequence: Synthetic peptide
  XENP019024 vlCDR1
RASQSVSNDVA

SEQ ID NO: 20729 - protein, 7 aa, Artificial Sequence
  Description of Artificial Sequence: Synthetic peptide
  XENP019024 vlCDR2
YASHRYT

SEQ ID NO: 20730 - protein, 9 aa, Artificial Sequence
  Description of Artificial Sequence: Synthetic peptide
  XENP019024 vlCDR3
QQDYSSPRT

SEQ ID NO: 20731 - protein, 451 aa, Artificial Sequence; identical to SEQ ID NO: 16221
  Description of Artificial Sequence: Synthetic polypeptide
  XENP019025 1G6_H1_L1.148_IgG1_PVA_/S267K Heavy Chain

SEQ ID NO: 20732 - protein, 122 aa, Artificial Sequence; identical to SEQ ID NO: 10922
  Description of Artificial Sequence: Synthetic polypeptide
  VH of XENP019025

SEQ ID NO: 20733 - protein, 5 aa, Artificial Sequence
  Description of Artificial Sequence: Synthetic peptide
  XENP019025 vhCDR1
NYWMN

SEQ ID NO: 20734 - protein, 19 aa, Artificial Sequence
  Description of Artificial Sequence: Synthetic peptide
  XENP019025 vhCDR2
EIRLKSNNYATHYAEPVKG

SEQ ID NO: 20735 - protein, 11 aa, Artificial Sequence
  Description of Artificial Sequence: Synthetic peptide
  XENP019025 vhCDR3
YYGNYGGYFDV

SEQ ID NO: 20736 - protein, 214 aa, Artificial Sequence
  Description of Artificial Sequence: Synthetic polypeptide
  XENP019025 1G6_H1_L1.148_IgG1_PVA_/S267K Light Chain
SIVMTQSPATLSASPGERATLSCRASQSVSNDVAWYQQKPGQSPRLLINYASHRYTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 20737 - protein, 107 aa, Artificial Sequence; identical to SEQ ID NO: 15051
  Description of Artificial Sequence: Synthetic polypeptide
  VL of XENP019025

SEQ ID NO: 20738 - protein, 11 aa, Artificial Sequence
  Description of Artificial Sequence: Synthetic peptide
  XENP019025 vlCDR1
RASQSVSNDVA

SEQ ID NO: 20739 - protein, 7 aa, Artificial Sequence
  Description of Artificial Sequence: Synthetic peptide
  XENP019025 vlCDR2
YASHRYT

SEQ ID NO: 20740 - protein, 9 aa, Artificial Sequence
  Description of Artificial Sequence: Synthetic peptide
  XENP019025 vlCDR3
QQDYSSPRT

SEQ ID NO: 20741 - protein, 451 aa, Artificial Sequence; identical to SEQ ID NO: 16221
  Description of Artificial Sequence: Synthetic polypeptide
  XENP019026 1G6_H1_L1.149_IgG1_PVA_/S267K Heavy Chain

SEQ ID NO: 20742 - protein, 122 aa, Artificial Sequence; identical to SEQ ID NO: 10922
  Description of Artificial Sequence: Synthetic polypeptide
  VH of XENP019026

SEQ ID NO: 20743 - protein, 5 aa, Artificial Sequence
  Description of Artificial Sequence: Synthetic peptide
  XENP019026 vhCDR1
NYWMN

SEQ ID NO: 20744 - protein, 19 aa, Artificial Sequence
  Description of Artificial Sequence: Synthetic peptide
  XENP019026 vhCDR2
EIRLKSNNYATHYAEPVKG

SEQ ID NO: 20745 - protein, 11 aa, Artificial Sequence
  Description of Artificial Sequence: Synthetic peptide
  XENP019026 vhCDR3
YYGNYGGYFDV

SEQ ID NO: 20746 - protein, 214 aa, Artificial Sequence
  Description of Artificial Sequence: Synthetic polypeptide
  XENP019026 1G6_H1_L1.149_IgG1_PVA_/S267K Light Chain
SIVMTQSPATLSVSPGERASLSCRASQSVSNDVAWYQQKPGQSPRLLINYASHRYTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 20747 - protein, 107 aa, Artificial Sequence; identical to SEQ ID NO: 15060
  Description of Artificial Sequence: Synthetic polypeptide
  VL of XENP019026

SEQ ID NO: 20748 - protein, 11 aa, Artificial Sequence
  Description of Artificial Sequence: Synthetic peptide
  XENP019026 vlCDR1
RASQSVSNDVA

SEQ ID NO: 20749 - protein, 7 aa, Artificial Sequence
  Description of Artificial Sequence: Synthetic peptide
  XENP019026 vlCDR2
YASHRYT

SEQ ID NO: 20750 - protein, 9 aa, Artificial Sequence
  Description of Artificial Sequence: Synthetic peptide
  XENP019026 vlCDR3
QQDYSSPRT

SEQ ID NO: 20751 - protein, 451 aa, Artificial Sequence; identical to SEQ ID NO: 16221
  Description of Artificial Sequence: Synthetic polypeptide
  XENP019027 1G6_H1_L1.150_IgG1_PVA_/S267K Heavy Chain

SEQ ID NO: 20752 - protein, 122 aa, Artificial Sequence; identical to SEQ ID NO: 10922
  Description of Artificial Sequence: Synthetic polypeptide
  VH of XENP019027

SEQ ID NO: 20753 - protein, 5 aa, Artificial Sequence
  Description of Artificial Sequence: Synthetic peptide
  XENP019027 vhCDR1
NYWMN

SEQ ID NO: 20754 - protein, 19 aa, Artificial Sequence
  Description of Artificial Sequence: Synthetic peptide
  XENP019027 vhCDR2
EIRLKSNNYATHYAEPVKG

SEQ ID NO: 20755 - protein, 11 aa, Artificial Sequence
  Description of Artificial Sequence: Synthetic peptide
  XENP019027 vhCDR3
YYGNYGGYFDV

SEQ ID NO: 20756 - protein, 214 aa, Artificial Sequence
  Description of Artificial Sequence: Synthetic polypeptide
  XENP019027 1G6_H1_L1.150_IgG1_PVA_/S267K Light Chain
SIVMTQSPATLSVSPGERATLKCRASQSVSNDVAWYQQKPGQSPRLLINYASHRYTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 20757 - protein, 107 aa, Artificial Sequence; identical to SEQ ID NO: 15069
  Description of Artificial Sequence: Synthetic polypeptide
  VL of XENP019027

SEQ ID NO: 20758 - protein, 11 aa, Artificial Sequence
  Description of Artificial Sequence: Synthetic peptide
  XENP019027 vlCDR1
RASQSVSNDVA

SEQ ID NO: 20759 - protein, 7 aa, Artificial Sequence
  Description of Artificial Sequence: Synthetic peptide
  XENP019027 vlCDR2
YASHRYT

SEQ ID NO: 20760 - protein, 9 aa, Artificial Sequence
  Description of Artificial Sequence: Synthetic peptide
  XENP019027 vlCDR3
QQDYSSPRT

SEQ ID NO: 20761 - protein, 451 aa, Artificial Sequence; identical to SEQ ID NO: 16221
  Description of Artificial Sequence: Synthetic polypeptide
  XENP019028 1G6_H1_L1.151_IgG1_PVA_/S267K Heavy Chain

SEQ ID NO: 20762 - protein, 122 aa, Artificial Sequence; identical to SEQ ID NO: 10922
  Description of Artificial Sequence: Synthetic polypeptide
  VH of XENP019028

SEQ ID NO: 20763 - protein, 5 aa, Artificial Sequence
  Description of Artificial Sequence: Synthetic peptide
  XENP019028 vhCDR1
NYWMN

SEQ ID NO: 20764 - protein, 19 aa, Artificial Sequence
  Description of Artificial Sequence: Synthetic peptide
  XENP019028 vhCDR2
EIRLKSNNYATHYAEPVKG

SEQ ID NO: 20765 - protein, 11 aa, Artificial Sequence
  Description of Artificial Sequence: Synthetic peptide
  XENP019028 vhCDR3
YYGNYGGYFDV

SEQ ID NO: 20766 - protein, 214 aa, Artificial Sequence
  Description of Artificial Sequence: Synthetic polypeptide
  XENP019028 1G6_H1_L1.151_IgG1_PVA_/S267K Light Chain
SIVMTQSPATLSVSPGERATLSCRASQSVSNDVAWYQQKPEQSPRLLINYASHRYTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 20767 - protein, 107 aa, Artificial Sequence; identical to SEQ ID NO: 15078
  Description of Artificial Sequence: Synthetic polypeptide
  VL of XENP019028

SEQ ID NO: 20768 - protein, 11 aa, Artificial Sequence
  Description of Artificial Sequence: Synthetic peptide
  XENP019028 vlCDR1
RASQSVSNDVA

SEQ ID NO: 20769 - protein, 7 aa, Artificial Sequence
  Description of Artificial Sequence: Synthetic peptide
  XENP019028 vlCDR2
YASHRYT

SEQ ID NO: 20770 - protein, 9 aa, Artificial Sequence
  Description of Artificial Sequence: Synthetic peptide
  XENP019028 vlCDR3
QQDYSSPRT

SEQ ID NO: 20771 - protein, 451 aa, Artificial Sequence; identical to SEQ ID NO: 16221
  Description of Artificial Sequence: Synthetic polypeptide
  XENP019029 1G6_H1_L1.152_IgG1_PVA_/S267K Heavy Chain

SEQ ID NO: 20772 - protein, 122 aa, Artificial Sequence; identical to SEQ ID NO: 10922
  Description of Artificial Sequence: Synthetic polypeptide
  VH of XENP019029

SEQ ID NO: 20773 - protein, 5 aa, Artificial Sequence
  Description of Artificial Sequence: Synthetic peptide
  XENP019029 vhCDR1
NYWMN

SEQ ID NO: 20774 - protein, 19 aa, Artificial Sequence
  Description of Artificial Sequence: Synthetic peptide
  XENP019029 vhCDR2
EIRLKSNNYATHYAEPVKG

SEQ ID NO: 20775 - protein, 11 aa, Artificial Sequence
  Description of Artificial Sequence: Synthetic peptide
  XENP019029 vhCDR3
YYGNYGGYFDV

SEQ ID NO: 20776 - protein, 214 aa, Artificial Sequence
  Description of Artificial Sequence: Synthetic polypeptide
  XENP019029 1G6_H1_L1.152_IgG1_PVA_/S267K Light Chain
SIVMTQSPATLSVSPGERATLSCRASQSVSNDVAWYQQKPGESPRLLINYASHRYTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 20777 - protein, 107 aa, Artificial Sequence; identical to SEQ ID NO: 15087
  Description of Artificial Sequence: Synthetic polypeptide
  VL of XENP019029

SEQ ID NO: 20778 - protein, 11 aa, Artificial Sequence
  Description of Artificial Sequence: Synthetic peptide
  XENP019029 vlCDR1
RASQSVSNDVA

SEQ ID NO: 20779 - protein, 7 aa, Artificial Sequence
  Description of Artificial Sequence: Synthetic peptide
  XENP019029 vlCDR2
YASHRYT

SEQ ID NO: 20780 - protein, 9 aa, Artificial Sequence
  Description of Artificial Sequence: Synthetic peptide
  XENP019029 vlCDR3
QQDYSSPRT

SEQ ID NO: 20781 - protein, 451 aa, Artificial Sequence; identical to SEQ ID NO: 16221
  Description of Artificial Sequence: Synthetic polypeptide
  XENP019030 1G6_H1_L1.153_IgG1_PVA_/S267K Heavy Chain

SEQ ID NO: 20782 - protein, 122 aa, Artificial Sequence; identical to SEQ ID NO: 10922
  Description of Artificial Sequence: Synthetic polypeptide
  VH of XENP019030

SEQ ID NO: 20783 - protein, 5 aa, Artificial Sequence
  Description of Artificial Sequence: Synthetic peptide
  XENP019030 vhCDR1
NYWMN

SEQ ID NO: 20784 - protein, 19 aa, Artificial Sequence
  Description of Artificial Sequence: Synthetic peptide
  XENP019030 vhCDR2
EIRLKSNNYATHYAEPVKG

SEQ ID NO: 20785 - protein, 11 aa, Artificial Sequence
  Description of Artificial Sequence: Synthetic peptide
  XENP019030 vhCDR3
YYGNYGGYFDV

SEQ ID NO: 20786 - protein, 214 aa, Artificial Sequence
  Description of Artificial Sequence: Synthetic polypeptide
  XENP019030 1G6_H1_L1.153_IgG1_PVA_/S267K Light Chain
SIVMTQSPATLSVSPGERATLSCRASQSVSNDVAWYQQKPGQSPRVLINYASHRYTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 20787 - protein, 107 aa, Artificial Sequence; identical to SEQ ID NO: 15096
  Description of Artificial Sequence: Synthetic polypeptide
  VL of XENP019030

SEQ ID NO: 20788 - protein, 11 aa, Artificial Sequence
  Description of Artificial Sequence: Synthetic peptide
  XENP019030 vlCDR1
RASQSVSNDVA

SEQ ID NO: 20789 - protein, 7 aa, Artificial Sequence
  Description of Artificial Sequence: Synthetic peptide
  XENP019030 vlCDR2
YASHRYT

SEQ ID NO: 20790 - protein, 9 aa, Artificial Sequence
  Description of Artificial Sequence: Synthetic peptide
  XENP019030 vlCDR3
QQDYSSPRT

SEQ ID NO: 20791 - protein, 451 aa, Artificial Sequence; identical to SEQ ID NO: 16221
  Description of Artificial Sequence: Synthetic polypeptide
  XENP019031 1G6_H1_L1.154_IgG1_PVA_/S267K Heavy Chain

SEQ ID NO: 20792 - protein, 122 aa, Artificial Sequence; identical to SEQ ID NO: 10922
  Description of Artificial Sequence: Synthetic polypeptide
  VH of XENP019031

SEQ ID NO: 20793 - protein, 5 aa, Artificial Sequence
  Description of Artificial Sequence: Synthetic peptide
  XENP019031 vhCDR1
NYWMN

SEQ ID NO: 20794 - protein, 19 aa, Artificial Sequence
  Description of Artificial Sequence: Synthetic peptide
  XENP019031 vhCDR2
EIRLKSNNYATHYAEPVKG

SEQ ID NO: 20795 - protein, 11 aa, Artificial Sequence
  Description of Artificial Sequence: Synthetic peptide
  XENP019031 vhCDR3
YYGNYGGYFDV

SEQ ID NO: 20796 - protein, 214 aa, Artificial Sequence
  Description of Artificial Sequence: Synthetic polypeptide
  XENP019031 1G6_H1_L1.154_IgG1_PVA_/S267K Light Chain
SIVMTQSPATLSVSPGERATLSCRASQSVSNDVAWYQQKPGQSPRLLVNYASHRYTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 20797 - protein, 107 aa, Artificial Sequence; identical to SEQ ID NO: 15105
  Description of Artificial Sequence: Synthetic polypeptide
  VL of XENP019031

SEQ ID NO: 20798 - protein, 11 aa, Artificial Sequence
  Description of Artificial Sequence: Synthetic peptide
  XENP019031 vlCDR1
RASQSVSNDVA

SEQ ID NO: 20799 - protein, 7 aa, Artificial Sequence
  Description of Artificial Sequence: Synthetic peptide
  XENP019031 vlCDR2
YASHRYT

SEQ ID NO: 20800 - protein, 9 aa, Artificial Sequence
  Description of Artificial Sequence: Synthetic peptide
  XENP019031 vlCDR3
QQDYSSPRT

SEQ ID NO: 20801 - protein, 451 aa, Artificial Sequence; identical to SEQ ID NO: 16221
  Description of Artificial Sequence: Synthetic polypeptide
  XENP019032 1G6_H1_L1.155_IgG1_PVA_/S267K Heavy Chain

SEQ ID NO: 20802 - protein, 122 aa, Artificial Sequence; identical to SEQ ID NO: 10922
  Description of Artificial Sequence: Synthetic polypeptide
  VH of XENP019032

SEQ ID NO: 20803 - protein, 5 aa, Artificial Sequence
  Description of Artificial Sequence: Synthetic peptide
  XENP019032 vhCDR1
NYWMN

SEQ ID NO: 20804 - protein, 19 aa, Artificial Sequence
  Description of Artificial Sequence: Synthetic peptide
  XENP019032 vhCDR2
EIRLKSNNYATHYAEPVKG

SEQ ID NO: 20805 - protein, 11 aa, Artificial Sequence
  Description of Artificial Sequence: Synthetic peptide
  XENP019032 vhCDR3
YYGNYGGYFDV

SEQ ID NO: 20806 - protein, 214 aa, Artificial Sequence
  Description of Artificial Sequence: Synthetic polypeptide
  XENP019032 1G6_H1_L1.155_IgG1_PVA_/S267K Light Chain
SIVMTQSPATLSVSPGERATLSCRASQSVSNDVAWYQQKPGQSPRLLINYANHRYTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 20807 - protein, 107 aa, Artificial Sequence; identical to SEQ ID NO: 15114
  Description of Artificial Sequence: Synthetic polypeptide
  VL of XENP019032

SEQ ID NO: 20808 - protein, 11 aa, Artificial Sequence
  Description of Artificial Sequence: Synthetic peptide
  XENP019032 vlCDR1
RASQSVSNDVA

SEQ ID NO: 20809 - protein, 7 aa, Artificial Sequence
  Description of Artificial Sequence: Synthetic peptide
  XENP019032 vlCDR2
YANHRYT

SEQ ID NO: 20810 - protein, 9 aa, Artificial Sequence
  Description of Artificial Sequence: Synthetic peptide
  XENP019032 vlCDR3
QQDYSSPRT

SEQ ID NO: 20811 - protein, 451 aa, Artificial Sequence; identical to SEQ ID NO: 16221
  Description of Artificial Sequence: Synthetic polypeptide
  XENP019033 1G6_H1_L1.156_IgG1_PVA_/S267K Heavy Chain

SEQ ID NO: 20812 - protein, 122 aa, Artificial Sequence; identical to SEQ ID NO: 10922
  Description of Artificial Sequence: Synthetic polypeptide
  VH of XENP019033

SEQ ID NO: 20813 - protein, 5 aa, Artificial Sequence
  Description of Artificial Sequence: Synthetic peptide
  XENP019033 vhCDR1
NYWMN

SEQ ID NO: 20814 - protein, 19 aa, Artificial Sequence
  Description of Artificial Sequence: Synthetic peptide
  XENP019033 vhCDR2
EIRLKSNNYATHYAEPVKG

SEQ ID NO: 20815 - protein, 11 aa, Artificial Sequence
  Description of Artificial Sequence: Synthetic peptide
  XENP019033 vhCDR3
YYGNYGGYFDV

SEQ ID NO: 20816 - protein, 214 aa, Artificial Sequence
  Description of Artificial Sequence: Synthetic polypeptide
  XENP019033 1G6_H1_L1.156_IgG1_PVA_/S267K Light Chain
SIVMTQSPATLSVSPGERATLSCRASQSVSNDVAWYQQKPGQSPRLLINYASHRYTGVPDRFTGSGYGTEFTLTISSLESEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 20817 - protein, 107 aa, Artificial Sequence; identical to SEQ ID NO: 15123
  Description of Artificial Sequence: Synthetic polypeptide
  VL of XENP019033

SEQ ID NO: 20818 - protein, 11 aa, Artificial Sequence
  Description of Artificial Sequence: Synthetic peptide
  XENP019033 vlCDR1
RASQSVSNDVA

SEQ ID NO: 20819 - protein, 7 aa, Artificial Sequence
  Description of Artificial Sequence: Synthetic peptide
  XENP019033 vlCDR2
YASHRYT

SEQ ID NO: 20820 - protein, 9 aa, Artificial Sequence
  Description of Artificial Sequence: Synthetic peptide
  XENP019033 vlCDR3
QQDYSSPRT

SEQ ID NO: 20821 - protein, 451 aa, Artificial Sequence; identical to SEQ ID NO: 16221
  Description of Artificial Sequence: Synthetic polypeptide
  XENP019034 1G6_H1_L1.157_IgG1_PVA_/S267K Heavy Chain

SEQ ID NO: 20822 - protein, 122 aa, Artificial Sequence; identical to SEQ ID NO: 10922
  Description of Artificial Sequence: Synthetic polypeptide
  VH of XENP019034

SEQ ID NO: 20823 - protein, 5 aa, Artificial Sequence
  Description of Artificial Sequence: Synthetic peptide
  XENP019034 vhCDR1
NYWMN

SEQ ID NO: 20824 - protein, 19 aa, Artificial Sequence
  Description of Artificial Sequence: Synthetic peptide
  XENP019034 vhCDR2
EIRLKSNNYATHYAEPVKG

SEQ ID NO: 20825 - protein, 11 aa, Artificial Sequence
  Description of Artificial Sequence: Synthetic peptide
  XENP019034 vhCDR3
YYGNYGGYFDV

SEQ ID NO: 20826 - protein, 214 aa, Artificial Sequence
  Description of Artificial Sequence: Synthetic polypeptide
  XENP019034 1G6_H1_L1.157_IgG1_PVA_/S267K Light Chain
SIVMTQSPATLSVSPGERATLSCRASQSVSNDVAWYQQKPGQSPRLLINYASHRYTGVPDRFTGSGYGTEFTLTISSLKSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 20827 - protein, 107 aa, Artificial Sequence; identical to SEQ ID NO: 15132
  Description of Artificial Sequence: Synthetic polypeptide
  VL of XENP019034

SEQ ID NO: 20828 - protein, 11 aa, Artificial Sequence
  Description of Artificial Sequence: Synthetic peptide
  XENP019034 vlCDR1
RASQSVSNDVA

SEQ ID NO: 20829 - protein, 7 aa, Artificial Sequence
  Description of Artificial Sequence: Synthetic peptide
  XENP019034 vlCDR2
YASHRYT

SEQ ID NO: 20830 - protein, 9 aa, Artificial Sequence
  Description of Artificial Sequence: Synthetic peptide
  XENP019034 vlCDR3
QQDYSSPRT

SEQ ID NO: 20831 - protein, 451 aa, Artificial Sequence; identical to SEQ ID NO: 16221
  Description of Artificial Sequence: Synthetic polypeptide
  XENP019035 1G6_H1_L1.158_IgG1_PVA_/S267K Heavy Chain

SEQ ID NO: 20832 - protein, 122 aa, Artificial Sequence; identical to SEQ ID NO: 10922
  Description of Artificial Sequence: Synthetic polypeptide
  VH of XENP019035

SEQ ID NO: 20833 - protein, 5 aa, Artificial Sequence
  Description of Artificial Sequence: Synthetic peptide
  XENP019035 vhCDR1
NYWMN

SEQ ID NO: 20834 - protein, 19 aa, Artificial Sequence
  Description of Artificial Sequence: Synthetic peptide
  XENP019035 vhCDR2
EIRLKSNNYATHYAEPVKG

SEQ ID NO: 20835 - protein, 11 aa, Artificial Sequence
  Description of Artificial Sequence: Synthetic peptide
  XENP019035 vhCDR3
YYGNYGGYFDV

SEQ ID NO: 20836 - protein, 214 aa, Artificial Sequence
  Description of Artificial Sequence: Synthetic polypeptide
  XENP019035 1G6_H1_L1.158_IgG1_PVA_/S267K Light Chain
SIVMTQSPATLSVSPGERATLSCRASQSVSNDVAWYQQKPGQSPRLLINYASHRYTGVPDRFTGSGYGTEFTLTISSLQSEDFGVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 20837 - protein, 107 aa, Artificial Sequence; identical to SEQ ID NO: 15141
  Description of Artificial Sequence: Synthetic polypeptide
  VL of XENP019035

SEQ ID NO: 20838 - protein, 11 aa, Artificial Sequence
  Description of Artificial Sequence: Synthetic peptide
  XENP019035 vlCDR1
RASQSVSNDVA

SEQ ID NO: 20839 - protein, 7 aa, Artificial Sequence
  Description of Artificial Sequence: Synthetic peptide
  XENP019035 vlCDR2
YASHRYT

SEQ ID NO: 20840 - protein, 9 aa, Artificial Sequence
  Description of Artificial Sequence: Synthetic peptide
  XENP019035 vlCDR3
QQDYSSPRT

SEQ ID NO: 20841 - protein, 451 aa, Artificial Sequence; identical to SEQ ID NO: 16221
  Description of Artificial Sequence: Synthetic polypeptide
  XENP019036 1G6_H1_L1.159_IgG1_PVA_/S267K Heavy Chain

SEQ ID NO: 20842 - protein, 122 aa, Artificial Sequence; identical to SEQ ID NO: 10922
  Description of Artificial Sequence: Synthetic polypeptide
  VH of XENP019036

SEQ ID NO: 20843 - protein, 5 aa, Artificial Sequence
  Description of Artificial Sequence: Synthetic peptide
  XENP019036 vhCDR1
NYWMN

SEQ ID NO: 20844 - protein, 19 aa, Artificial Sequence
  Description of Artificial Sequence: Synthetic peptide
  XENP019036 vhCDR2
EIRLKSNNYATHYAEPVKG

SEQ ID NO: 20845 - protein, 11 aa, Artificial Sequence
  Description of Artificial Sequence: Synthetic peptide
  XENP019036 vhCDR3
YYGNYGGYFDV

SEQ ID NO: 20846 - protein, 214 aa, Artificial Sequence
  Description of Artificial Sequence: Synthetic polypeptide
  XENP019036 1G6_H1_L1.159_IgG1_PVA_/S267K Light Chain
SIVMTQSPATLSVSPGERATLSCRASQSVSNDVAWYQQKPGQSPRLLINYASHRYTGVPDRFTGSGYGTEFTLTISSLQSEDFAVYFCKQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 20847 - protein, 107 aa, Artificial Sequence; identical to SEQ ID NO: 15150
  Description of Artificial Sequence: Synthetic polypeptide
  VL of XENP019036

SEQ ID NO: 20848 - protein, 11 aa, Artificial Sequence
  Description of Artificial Sequence: Synthetic peptide
  XENP019036 vlCDR1
RASQSVSNDVA

SEQ ID NO: 20849 - protein, 7 aa, Artificial Sequence
  Description of Artificial Sequence: Synthetic peptide
  XENP019036 vlCDR2
YASHRYT

SEQ ID NO: 20850 - protein, 9 aa, Artificial Sequence
  Description of Artificial Sequence: Synthetic peptide
  XENP019036 vlCDR3
KQDYSSPRT

SEQ ID NO: 20851 - protein, 451 aa, Artificial Sequence; identical to SEQ ID NO: 16221
  Description of Artificial Sequence: Synthetic polypeptide
  XENP019037 1G6_H1_L1.160_IgG1_PVA_/S267K Heavy Chain

SEQ ID NO: 20852 - protein, 122 aa, Artificial Sequence; identical to SEQ ID NO: 10922
  Description of Artificial Sequence: Synthetic polypeptide
  VH of XENP019037

SEQ ID NO: 20853 - protein, 5 aa, Artificial Sequence
  Description of Artificial Sequence: Synthetic peptide
  XENP019037 vhCDR1
NYWMN

SEQ ID NO: 20854 - protein, 19 aa, Artificial Sequence
  Description of Artificial Sequence: Synthetic peptide
  XENP019037 vhCDR2
EIRLKSNNYATHYAEPVKG

SEQ ID NO: 20855 - protein, 11 aa, Artificial Sequence
  Description of Artificial Sequence: Synthetic peptide
  XENP019037 vhCDR3
YYGNYGGYFDV

SEQ ID NO: 20856 - protein, 214 aa, Artificial Sequence
  Description of Artificial Sequence: Synthetic polypeptide
  XENP019037 1G6_H1_L1.160_IgG1_PVA_/S267K Light Chain
SIVMTQSPATLSVSPGERATLSCRASQSVSNDVAWYQQKPGQSPRLLINYASHRYTGVPDRFTGSGYGTEFTLTISSLQSEDFAVYFCQKDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 20857 - protein, 107 aa, Artificial Sequence; identical to SEQ ID NO: 15159
  Description of Artificial Sequence: Synthetic polypeptide
  VL of XENP019037

SEQ ID NO: 20858 - protein, 11 aa, Artificial Sequence
  Description of Artificial Sequence: Synthetic peptide
  XENP019037 vlCDR1
RASQSVSNDVA

SEQ ID NO: 20859 - protein, 7 aa, Artificial Sequence
  Description of Artificial Sequence: Synthetic peptide
  XENP019037 vlCDR2
YASHRYT

SEQ ID NO: 20860 - protein, 9 aa, Artificial Sequence
  Description of Artificial Sequence: Synthetic peptide
  XENP019037 vlCDR3
QKDYSSPRT

SEQ ID NO: 20861 - protein, 451 aa, Artificial Sequence; identical to SEQ ID NO: 16221
  Description of Artificial Sequence: Synthetic polypeptide
  XENP019038 1G6_H1_L1.161_IgG1_PVA_/S267K Heavy Chain

SEQ ID NO: 20862 - protein, 122 aa, Artificial Sequence; identical to SEQ ID NO: 10922
  Description of Artificial Sequence: Synthetic polypeptide
  VH of XENP019038

SEQ ID NO: 20863 - protein, 5 aa, Artificial Sequence
  Description of Artificial Sequence: Synthetic peptide
  XENP019038 vhCDR1
NYWMN

SEQ ID NO: 20864 - protein, 19 aa, Artificial Sequence
  Description of Artificial Sequence: Synthetic peptide
  XENP019038 vhCDR2
EIRLKSNNYATHYAEPVKG

SEQ ID NO: 20865 - protein, 11 aa, Artificial Sequence
  Description of Artificial Sequence: Synthetic peptide
  XENP019038 vhCDR3
YYGNYGGYFDV

SEQ ID NO: 20866 - protein, 214 aa, Artificial Sequence
  Description of Artificial Sequence: Synthetic polypeptide
  XENP019038 1G6_H1_L1.161_IgG1_PVA_/S267K Light Chain
SIVMTQSPATLSVSPGERATLSCRASQSVSNDVAWYQQKPGQSPRLLINYASHRYTGVPDRFTGSGYGTEFTLTISSLQSEDFAVYFCQNDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 20867 - protein, 107 aa, Artificial Sequence; identical to SEQ ID NO: 15168
  Description of Artificial Sequence: Synthetic polypeptide
  VL of XENP019038

SEQ ID NO: 20868 - protein, 11 aa, Artificial Sequence
  Description of Artificial Sequence: Synthetic peptide
  XENP019038 vlCDR1
RASQSVSNDVA

SEQ ID NO: 20869 - protein, 7 aa, Artificial Sequence
  Description of Artificial Sequence: Synthetic peptide
  XENP019038 vlCDR2
YASHRYT

SEQ ID NO: 20870 - protein, 9 aa, Artificial Sequence
  Description of Artificial Sequence: Synthetic peptide
  XENP019038 vlCDR3
QNDYSSPRT

SEQ ID NO: 20871 - protein, 451 aa, Artificial Sequence; identical to SEQ ID NO: 16221
  Description of Artificial Sequence: Synthetic polypeptide
  XENP019039 1G6_H1_L1.162_IgG1_PVA_/S267K Heavy Chain

SEQ ID NO: 20872 - protein, 122 aa, Artificial Sequence; identical to SEQ ID NO: 10922
  Description of Artificial Sequence: Synthetic polypeptide
  VH of XENP019039

SEQ ID NO: 20873 - protein, 5 aa, Artificial Sequence
  Description of Artificial Sequence: Synthetic peptide
  XENP019039 vhCDR1
NYWMN

SEQ ID NO: 20874 - protein, 19 aa, Artificial Sequence
  Description of Artificial Sequence: Synthetic peptide
  XENP019039 vhCDR2
EIRLKSNNYATHYAEPVKG

SEQ ID NO: 20875 - protein, 11 aa, Artificial Sequence
  Description of Artificial Sequence: Synthetic peptide
  XENP019039 vhCDR3
YYGNYGGYFDV

SEQ ID NO: 20876 - protein, 214 aa, Artificial Sequence
  Description of Artificial Sequence: Synthetic polypeptide
  XENP019039 1G6_H1_L1.162_IgG1_PVA_/S267K Light Chain
SIVMTQSPATLSVSPGERATLSCRASQSVSNDVAWYQQKPGQSPRLLINYASHRYTGVPDRFTGSGYGTEFTLTISSLQSEDFAVYFCQRDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 20877 - protein, 107 aa, Artificial Sequence; identical to SEQ ID NO: 15177
  Description of Artificial Sequence: Synthetic polypeptide
  VL of XENP019039

SEQ ID NO: 20878 - protein, 11 aa, Artificial Sequence
  Description of Artificial Sequence: Synthetic peptide
  XENP019039 vlCDR1
RASQSVSNDVA

SEQ ID NO: 20879 - protein, 7 aa, Artificial Sequence
  Description of Artificial Sequence: Synthetic peptide
  XENP019039 vlCDR2
YASHRYT

SEQ ID NO: 20880 - protein, 9 aa, Artificial Sequence
  Description of Artificial Sequence: Synthetic peptide
  XENP019039 vlCDR3
QRDYSSPRT

SEQ ID NO: 20881 - protein, 451 aa, Artificial Sequence; identical to SEQ ID NO: 16221
  Description of Artificial Sequence: Synthetic polypeptide
  XENP019040 1G6_H1_L1.163_IgG1_PVA_/S267K Heavy Chain

SEQ ID NO: 20882 - protein, 122 aa, Artificial Sequence; identical to SEQ ID NO: 10922
  Description of Artificial Sequence: Synthetic polypeptide
  VH of XENP019040

SEQ ID NO: 20883 - protein, 5 aa, Artificial Sequence
  Description of Artificial Sequence: Synthetic peptide
  XENP019040 vhCDR1
NYWMN

SEQ ID NO: 20884 - protein, 19 aa, Artificial Sequence
  Description of Artificial Sequence: Synthetic peptide
  XENP019040 vhCDR2
EIRLKSNNYATHYAEPVKG

SEQ ID NO: 20885 - protein, 11 aa, Artificial Sequence
  Description of Artificial Sequence: Synthetic peptide
  XENP019040 vhCDR3
YYGNYGGYFDV

SEQ ID NO: 20886 - protein, 214 aa, Artificial Sequence
  Description of Artificial Sequence: Synthetic polypeptide
  XENP019040 1G6_H1_L1.163_IgG1_PVA_/S267K Light Chain
SIVMTQSPATLSVSPGEPATLSCRASQSVSNDVAWYQQKPGQSPRLLINYASHRYTGVPDRFTGSGYGTEFTLTISRLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 20887 - protein, 107 aa, Artificial Sequence; identical to SEQ ID NO: 15186
  Description of Artificial Sequence: Synthetic polypeptide
  VL of XENP019040

SEQ ID NO: 20888 - protein, 11 aa, Artificial Sequence
  Description of Artificial Sequence: Synthetic peptide
  XENP019040 vlCDR1
RASQSVSNDVA

SEQ ID NO: 20889 - protein, 7 aa, Artificial Sequence
  Description of Artificial Sequence: Synthetic peptide
  XENP019040 vlCDR2
YASHRYT

SEQ ID NO: 20890 - protein, 9 aa, Artificial Sequence
  Description of Artificial Sequence: Synthetic peptide
  XENP019040 vlCDR3
QQDYSSPRT

SEQ ID NO: 20891 - protein, 451 aa, Artificial Sequence; identical to SEQ ID NO: 16221
  Description of Artificial Sequence: Synthetic polypeptide
  XENP019041 1G6_H1_L1.164_IgG1_PVA_/S267K Heavy Chain

SEQ ID NO: 20892 - protein, 122 aa, Artificial Sequence; identical to SEQ ID NO: 10922
  Description of Artificial Sequence: Synthetic polypeptide
  VH of XENP019041

SEQ ID NO: 20893 - protein, 5 aa, Artificial Sequence
  Description of Artificial Sequence: Synthetic peptide
  XENP019041 vhCDR1
NYWMN

SEQ ID NO: 20894 - protein, 19 aa, Artificial Sequence
  Description of Artificial Sequence: Synthetic peptide
  XENP019041 vhCDR2
EIRLKSNNYATHYAEPVKG

SEQ ID NO: 20895 - protein, 11 aa, Artificial Sequence
  Description of Artificial Sequence: Synthetic peptide
  XENP019041 vhCDR3
YYGNYGGYFDV

SEQ ID NO: 20896 - protein, 214 aa, Artificial Sequence
  Description of Artificial Sequence: Synthetic polypeptide
  XENP019041 1G6_H1_L1.164_IgG1_PVA_/S267K Light Chain
SIVMTQSPATLSVSPGERATLSCRASESVSNDVAWYQQKPGQSPRLLINYASHRYTGVPDRFTGSGYGTEFTLTISSLQSEDFAVYFCQKDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 20897 - protein, 107 aa, Artificial Sequence; identical to SEQ ID NO: 15195
  Description of Artificial Sequence: Synthetic polypeptide
  VL of XENP019041

SEQ ID NO: 20898 - protein, 11 aa, Artificial Sequence
  Description of Artificial Sequence: Synthetic peptide
  XENP019041 vlCDR1
RASESVSNDVA

SEQ ID NO: 20899 - protein, 7 aa, Artificial Sequence
  Description of Artificial Sequence: Synthetic peptide
  XENP019041 vlCDR2
YASHRYT

SEQ ID NO: 20900 - protein, 9 aa, Artificial Sequence
  Description of Artificial Sequence: Synthetic peptide
  XENP019041 vlCDR3
QKDYSSPRT

SEQ ID NO: 20901 - protein, 451 aa, Artificial Sequence; identical to SEQ ID NO: 16221
  Description of Artificial Sequence: Synthetic polypeptide
  XENP019042 1G6_H1_L1.165_IgG1_PVA_/S267K Heavy Chain

SEQ ID NO: 20902 - protein, 122 aa, Artificial Sequence; identical to SEQ ID NO: 10922
  Description of Artificial Sequence: Synthetic polypeptide
  VH of XENP019042

SEQ ID NO: 20903 - protein, 5 aa, Artificial Sequence
  Description of Artificial Sequence: Synthetic peptide
  XENP019042 vhCDR1
NYWMN

SEQ ID NO: 20904 - protein, 19 aa, Artificial Sequence
  Description of Artificial Sequence: Synthetic peptide
  XENP019042 vhCDR2
EIRLKSNNYATHYAEPVKG

SEQ ID NO: 20905 - protein, 11 aa, Artificial Sequence
  Description of Artificial Sequence: Synthetic peptide
  XENP019042 vhCDR3
YYGNYGGYFDV

SEQ ID NO: 20906 - protein, 214 aa, Artificial Sequence
  Description of Artificial Sequence: Synthetic polypeptide
  XENP019042 1G6_H1_L1.165_IgG1_PVA_/S267K Light Chain
SIVMTQSPATLSVSPGERATLSCRASESVSNDVAWYQQKPGQSPRLLINYASHRYTGVPDRFTGSGYGTEFTLTISSLQSEDFAVYFCQQDYKSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 20907 - protein, 107 aa, Artificial Sequence; identical to SEQ ID NO: 15204
  Description of Artificial Sequence: Synthetic polypeptide
  VL of XENP019042

SEQ ID NO: 20908 - protein, 11 aa, Artificial Sequence
  Description of Artificial Sequence: Synthetic peptide
  XENP019042 vlCDR1
RASESVSNDVA

SEQ ID NO: 20909 - protein, 7 aa, Artificial Sequence
  Description of Artificial Sequence: Synthetic peptide
  XENP019042 vlCDR2
YASHRYT

SEQ ID NO: 20910 - protein, 9 aa, Artificial Sequence
  Description of Artificial Sequence: Synthetic peptide
  XENP019042 vlCDR3
QQDYKSPRT

SEQ ID NO: 20911 - protein, 451 aa, Artificial Sequence; identical to SEQ ID NO: 16221
  Description of Artificial Sequence: Synthetic polypeptide
  XENP019043 1G6_H1_L1.166_IgG1_PVA_/S267K Heavy Chain

SEQ ID NO: 20912 - protein, 122 aa, Artificial Sequence; identical to SEQ ID NO: 10922
  Description of Artificial Sequence: Synthetic polypeptide
  VH of XENP019043

SEQ ID NO: 20913 - protein, 5 aa, Artificial Sequence
  Description of Artificial Sequence: Synthetic peptide
  XENP019043 vhCDR1
NYWMN

SEQ ID NO: 20914 - protein, 19 aa, Artificial Sequence
  Description of Artificial Sequence: Synthetic peptide
  XENP019043 vhCDR2
EIRLKSNNYATHYAEPVKG

SEQ ID NO: 20915 - protein, 11 aa, Artificial Sequence
  Description of Artificial Sequence: Synthetic peptide
  XENP019043 vhCDR3
YYGNYGGYFDV

SEQ ID NO: 20916 - protein, 214 aa, Artificial Sequence
  Description of Artificial Sequence: Synthetic polypeptide
  XENP019043 1G6_H1_L1.166_IgG1_PVA_/S267K Light Chain
SIVMTQSPATLSVSPGERATLSCRASQSVSNDVAWYRQKPEQSPRLLINYASHRYTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 20917 - protein, 107 aa, Artificial Sequence; identical to SEQ ID NO: 15213
  Description of Artificial Sequence: Synthetic polypeptide
  VL of XENP019043

SEQ ID NO: 20918 - protein, 11 aa, Artificial Sequence
  Description of Artificial Sequence: Synthetic peptide
  XENP019043 vlCDR1
RASQSVSNDVA

SEQ ID NO: 20919 - protein, 7 aa, Artificial Sequence
  Description of Artificial Sequence: Synthetic peptide
  XENP019043 vlCDR2
YASHRYT

SEQ ID NO: 20920 - protein, 9 aa, Artificial Sequence
  Description of Artificial Sequence: Synthetic peptide
  XENP019043 vlCDR3
QQDYSSPRT

SEQ ID NO: 20921 - protein, 451 aa, Artificial Sequence; identical to SEQ ID NO: 16221
  Description of Artificial Sequence: Synthetic polypeptide
  XENP019044 1G6_H1_L1.167_IgG1_PVA_/S267K Heavy Chain

SEQ ID NO: 20922 - protein, 122 aa, Artificial Sequence; identical to SEQ ID NO: 10922
  Description of Artificial Sequence: Synthetic polypeptide
  VH of XENP019044

SEQ ID NO: 20923 - protein, 5 aa, Artificial Sequence
  Description of Artificial Sequence: Synthetic peptide
  XENP019044 vhCDR1
NYWMN

SEQ ID NO: 20924 - protein, 19 aa, Artificial Sequence
  Description of Artificial Sequence: Synthetic peptide
  XENP019044 vhCDR2
EIRLKSNNYATHYAEPVKG

SEQ ID NO: 20925 - protein, 11 aa, Artificial Sequence
  Description of Artificial Sequence: Synthetic peptide
  XENP019044 vhCDR3
YYGNYGGYFDV

SEQ ID NO: 20926 - protein, 214 aa, Artificial Sequence
  Description of Artificial Sequence: Synthetic polypeptide
  XENP019044 1G6_H1_L1.167_IgG1_PVA_/S267K Light Chain
SIVMTQSPATLSVSPGERATLSCRASQSVSNDVAWYRQKPGESPRLLINYASHRYTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 20927 - protein, 107 aa, Artificial Sequence; identical to SEQ ID NO: 15222
  Description of Artificial Sequence: Synthetic polypeptide
  VL of XENP019044

SEQ ID NO: 20928 - protein, 11 aa, Artificial Sequence
  Description of Artificial Sequence: Synthetic peptide
  XENP019044 vlCDR1
RASQSVSNDVA

SEQ ID NO: 20929 - protein, 7 aa, Artificial Sequence
  Description of Artificial Sequence: Synthetic peptide
  XENP019044 vlCDR2
YASHRYT

SEQ ID NO: 20930 - protein, 9 aa, Artificial Sequence
  Description of Artificial Sequence: Synthetic peptide
  XENP019044 vlCDR3
QQDYSSPRT

SEQ ID NO: 20931 - protein, 451 aa, Artificial Sequence; identical to SEQ ID NO: 16221
  Description of Artificial Sequence: Synthetic polypeptide
  XENP019045 1G6_H1_L1.168_IgG1_PVA_/S267K Heavy Chain

SEQ ID NO: 20932 - protein, 122 aa, Artificial Sequence; identical to SEQ ID NO: 10922
  Description of Artificial Sequence: Synthetic polypeptide
  VH of XENP019045

SEQ ID NO: 20933 - protein, 5 aa, Artificial Sequence
  Description of Artificial Sequence: Synthetic peptide
  XENP019045 vhCDR1
NYWMN

SEQ ID NO: 20934 - protein, 19 aa, Artificial Sequence
  Description of Artificial Sequence: Synthetic peptide
  XENP019045 vhCDR2
EIRLKSNNYATHYAEPVKG

SEQ ID NO: 20935 - protein, 11 aa, Artificial Sequence
  Description of Artificial Sequence: Synthetic peptide
  XENP019045 vhCDR3
YYGNYGGYFDV

SEQ ID NO: 20936 - protein, 214 aa, Artificial Sequence
  Description of Artificial Sequence: Synthetic polypeptide
  XENP019045 1G6_H1_L1.168_IgG1_PVA_/S267K Light Chain
SIVMTQSPATLSVSPGERATLSCRASQSVSNDVAWYQQKPGQSPRLLINYASWRYTGVPDRFTGSGYGTEFTLTISSLQSEDFAVYFCQQDFSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 20937 - protein, 107 aa, Artificial Sequence; identical to SEQ ID NO: 15231
  Description of Artificial Sequence: Synthetic polypeptide
  VL of XENP019045

SEQ ID NO: 20938 - protein, 11 aa, Artificial Sequence
  Description of Artificial Sequence: Synthetic peptide
  XENP019045 vlCDR1
RASQSVSNDVA

SEQ ID NO: 20939 - protein, 7 aa, Artificial Sequence
  Description of Artificial Sequence: Synthetic peptide
  XENP019045 vlCDR2
YASWRYT

SEQ ID NO: 20940 - protein, 9 aa, Artificial Sequence
  Description of Artificial Sequence: Synthetic peptide
  XENP019045 vlCDR3
QQDFSSPRT

SEQ ID NO: 20941 - protein, 451 aa, Artificial Sequence; identical to SEQ ID NO: 16221
  Description of Artificial Sequence: Synthetic polypeptide
  XENP019046 1G6_H1_L1.169_IgG1_PVA_/S267K Heavy Chain

SEQ ID NO: 20942 - protein, 122 aa, Artificial Sequence; identical to SEQ ID NO: 10922
  Description of Artificial Sequence: Synthetic polypeptide
  VH of XENP019046

SEQ ID NO: 20943 - protein, 5 aa, Artificial Sequence
  Description of Artificial Sequence: Synthetic peptide
  XENP019046 vhCDR1
NYWMN

SEQ ID NO: 20944 - protein, 19 aa, Artificial Sequence
  Description of Artificial Sequence: Synthetic peptide
  XENP019046 vhCDR2
EIRLKSNNYATHYAEPVKG

SEQ ID NO: 20945 - protein, 11 aa, Artificial Sequence
  Description of Artificial Sequence: Synthetic peptide
  XENP019046 vhCDR3
YYGNYGGYFDV

SEQ ID NO: 20946 - protein, 214 aa, Artificial Sequence
  Description of Artificial Sequence: Synthetic polypeptide
  XENP019046 1G6_H1_L1.169_IgG1_PVA_/S267K Light Chain
SIVMTQSPATLSVSPGERATLSCRASQSVSNDVAWYQQKPGQSPRLLINYASWRYTGVPDRFTGSGYGTEFTLTISSLQSEDFAVYFCQQDWSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 20947 - protein, 107 aa, Artificial Sequence; identical to SEQ ID NO: 15240
  Description of Artificial Sequence: Synthetic polypeptide
  VL of XENP019046

SEQ ID NO: 20948 - protein, 11 aa, Artificial Sequence
  Description of Artificial Sequence: Synthetic peptide
  XENP019046 vlCDR1
RASQSVSNDVA

SEQ ID NO: 20949 - protein, 7 aa, Artificial Sequence
  Description of Artificial Sequence: Synthetic peptide
  XENP019046 vlCDR2
YASWRYT

SEQ ID NO: 20950 - protein, 9 aa, Artificial Sequence
  Description of Artificial Sequence: Synthetic peptide
  XENP019046 vlCDR3
QQDWSSPRT

SEQ ID NO: 20951 - protein, 451 aa, Artificial Sequence; identical to SEQ ID NO: 16221
  Description of Artificial Sequence: Synthetic polypeptide
  XENP019047 1G6_H1_L1.170_IgG1_PVA_/S267K Heavy Chain

SEQ ID NO: 20952 - protein, 122 aa, Artificial Sequence; identical to SEQ ID NO: 10922
  Description of Artificial Sequence: Synthetic polypeptide
  VH of XENP019047

SEQ ID NO: 20953 - protein, 5 aa, Artificial Sequence
  Description of Artificial Sequence: Synthetic peptide
  XENP019047 vhCDR1
NYWMN

SEQ ID NO: 20954 - protein, 19 aa, Artificial Sequence
  Description of Artificial Sequence: Synthetic peptide
  XENP019047 vhCDR2
EIRLKSNNYATHYAEPVKG

SEQ ID NO: 20955 - protein, 11 aa, Artificial Sequence
  Description of Artificial Sequence: Synthetic peptide
  XENP019047 vhCDR3
YYGNYGGYFDV

SEQ ID NO: 20956 - protein, 214 aa, Artificial Sequence
  Description of Artificial Sequence: Synthetic polypeptide
  XENP019047 1G6_H1_L1.170_IgG1_PVA_/S267K Light Chain
SIVMTQSPATLSVSPGERATLSCRASQSVSNDVAWYQQKPGQSPRLLINYASWRYTGVPDRFTGSGYGTEFTLTISSLQSEDFAVYFCQQDGSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 20957 - protein, 107 aa, Artificial Sequence; identical to SEQ ID NO: 15249
  Description of Artificial Sequence: Synthetic polypeptide
  VL of XENP019047

SEQ ID NO: 20958 - protein, 11 aa, Artificial Sequence
  Description of Artificial Sequence: Synthetic peptide
  XENP019047 vlCDR1
RASQSVSNDVA

SEQ ID NO: 20959 - protein, 7 aa, Artificial Sequence
  Description of Artificial Sequence: Synthetic peptide
  XENP019047 vlCDR2
YASWRYT

SEQ ID NO: 20960 - protein, 9 aa, Artificial Sequence
  Description of Artificial Sequence: Synthetic peptide
  XENP019047 vlCDR3
QQDGSSPRT

SEQ ID NO: 20961 - protein, 451 aa, Artificial Sequence; identical to SEQ ID NO: 16221
  Description of Artificial Sequence: Synthetic polypeptide
  XENP019048 1G6_H1_L1.171_IgG1_PVA_/S267K Heavy Chain

SEQ ID NO: 20962 - protein, 122 aa, Artificial Sequence; identical to SEQ ID NO: 10922
  Description of Artificial Sequence: Synthetic polypeptide
  VH of XENP019048

SEQ ID NO: 20963 - protein, 5 aa, Artificial Sequence
  Description of Artificial Sequence: Synthetic peptide
  XENP019048 vhCDR1
NYWMN

SEQ ID NO: 20964 - protein, 19 aa, Artificial Sequence
  Description of Artificial Sequence: Synthetic peptide
  XENP019048 vhCDR2
EIRLKSNNYATHYAEPVKG

SEQ ID NO: 20965 - protein, 11 aa, Artificial Sequence
  Description of Artificial Sequence: Synthetic peptide
  XENP019048 vhCDR3
YYGNYGGYFDV

SEQ ID NO: 20966 - protein, 214 aa, Artificial Sequence
  Description of Artificial Sequence: Synthetic polypeptide
  XENP019048 1G6_H1_L1.171_IgG1_PVA_/S267K Light Chain
SIVMTQSPATLSVSPGERATLSCRASQSVSNDVAWYQQKPGQSPRLLINYASHRYTSVPDRFTGSGYGTEFTLTISSLQSEDFAVYFCQQDWSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 20967 - protein, 107 aa, Artificial Sequence; identical to SEQ ID NO: 15258
  Description of Artificial Sequence: Synthetic polypeptide
  VL of XENP019048

SEQ ID NO: 20968 - protein, 11 aa, Artificial Sequence
  Description of Artificial Sequence: Synthetic peptide
  XENP019048 vlCDR1
RASQSVSNDVA

SEQ ID NO: 20969 - protein, 7 aa, Artificial Sequence
  Description of Artificial Sequence: Synthetic peptide
  XENP019048 vlCDR2
YASHRYT

SEQ ID NO: 20970 - protein, 9 aa, Artificial Sequence
  Description of Artificial Sequence: Synthetic peptide
  XENP019048 vlCDR3
QQDWSSPRT

SEQ ID NO: 20971 - protein, 451 aa, Artificial Sequence; identical to SEQ ID NO: 16221
  Description of Artificial Sequence: Synthetic polypeptide
  XENP019049 1G6_H1_L1.172_IgG1_PVA_/S267K Heavy Chain

SEQ ID NO: 20972 - protein, 122 aa, Artificial Sequence; identical to SEQ ID NO: 10922
  Description of Artificial Sequence: Synthetic polypeptide
  VH of XENP019049

SEQ ID NO: 20973 - protein, 5 aa, Artificial Sequence
  Description of Artificial Sequence: Synthetic peptide
  XENP019049 vhCDR1
NYWMN

SEQ ID NO: 20974 - protein, 19 aa, Artificial Sequence
  Description of Artificial Sequence: Synthetic peptide
  XENP019049 vhCDR2
EIRLKSNNYATHYAEPVKG

SEQ ID NO: 20975 - protein, 11 aa, Artificial Sequence
  Description of Artificial Sequence: Synthetic peptide
  XENP019049 vhCDR3
YYGNYGGYFDV

SEQ ID NO: 20976 - protein, 214 aa, Artificial Sequence
  Description of Artificial Sequence: Synthetic polypeptide
  XENP019049 1G6_H1_L1.172_IgG1_PVA_/S267K Light Chain
SIVMTQSPATLSVSPGERATLSCRASQSVSNDVAWYQQKPGQSPRLLINYASHRYTSVPDRFTGSGYGTEFTLTISSLQSEDFAVYFCQQDFSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 20977 - protein, 107 aa, Artificial Sequence; identical to SEQ ID NO: 15267
  Description of Artificial Sequence: Synthetic polypeptide
  VL of XENP019049

SEQ ID NO: 20978 - protein, 11 aa, Artificial Sequence
  Description of Artificial Sequence: Synthetic peptide
  XENP019049 vlCDR1
RASQSVSNDVA

SEQ ID NO: 20979 - protein, 7 aa, Artificial Sequence
  Description of Artificial Sequence: Synthetic peptide
  XENP019049 vlCDR2
YASHRYT

SEQ ID NO: 20980 - protein, 9 aa, Artificial Sequence
  Description of Artificial Sequence: Synthetic peptide
  XENP019049 vlCDR3
QQDFSSPRT

SEQ ID NO: 20981 - protein, 451 aa, Artificial Sequence; identical to SEQ ID NO: 16221
  Description of Artificial Sequence: Synthetic polypeptide
  XENP019050 1G6_H1_L1.173_IgG1_PVA_/S267K Heavy Chain

SEQ ID NO: 20982 - protein, 122 aa, Artificial Sequence; identical to SEQ ID NO: 10922
  Description of Artificial Sequence: Synthetic polypeptide
  VH of XENP019050

SEQ ID NO: 20983 - protein, 5 aa, Artificial Sequence
  Description of Artificial Sequence: Synthetic peptide
  XENP019050 vhCDR1
NYWMN

SEQ ID NO: 20984 - protein, 19 aa, Artificial Sequence
  Description of Artificial Sequence: Synthetic peptide
  XENP019050 vhCDR2
EIRLKSNNYATHYAEPVKG

SEQ ID NO: 20985 - protein, 11 aa, Artificial Sequence
  Description of Artificial Sequence: Synthetic peptide
  XENP019050 vhCDR3
YYGNYGGYFDV

SEQ ID NO: 20986 - protein, 214 aa, Artificial Sequence
  Description of Artificial Sequence: Synthetic polypeptide
  XENP019050 1G6_H1_L1.173_IgG1_PVA_/S267K Light Chain
SIVMTQSPATLSVSPGERATLSCRASQSVSNDVAWYQQKPGQSPRLLINYASHRYTGVPDRFTGSGYGTEFTLTISSLQSEDFAVYFCQQDFGSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 20987 - protein, 107 aa, Artificial Sequence; identical to SEQ ID NO: 15276
  Description of Artificial Sequence: Synthetic polypeptide
  VL of XENP019050

SEQ ID NO: 20988 - protein, 11 aa, Artificial Sequence
  Description of Artificial Sequence: Synthetic peptide
  XENP019050 vlCDR1
RASQSVSNDVA

SEQ ID NO: 20989 - protein, 7 aa, Artificial Sequence
  Description of Artificial Sequence: Synthetic peptide
  XENP019050 vlCDR2
YASHRYT

SEQ ID NO: 20990 - protein, 9 aa, Artificial Sequence
  Description of Artificial Sequence: Synthetic peptide
  XENP019050 vlCDR3
QQDFGSPRT

SEQ ID NO: 20991 - protein, 451 aa, Artificial Sequence; identical to SEQ ID NO: 16221
  Description of Artificial Sequence: Synthetic polypeptide
  XENP019051 1G6_H1_L1.174_IgG1_PVA_/S267K Heavy Chain

SEQ ID NO: 20992 - protein, 122 aa, Artificial Sequence; identical to SEQ ID NO: 10922
  Description of Artificial Sequence: Synthetic polypeptide
  VH of XENP019051

SEQ ID NO: 20993 - protein, 5 aa, Artificial Sequence
  Description of Artificial Sequence: Synthetic peptide
  XENP019051 vhCDR1
NYWMN

SEQ ID NO: 20994 - protein, 19 aa, Artificial Sequence
  Description of Artificial Sequence: Synthetic peptide
  XENP019051 vhCDR2
EIRLKSNNYATHYAEPVKG

SEQ ID NO: 20995 - protein, 11 aa, Artificial Sequence
  Description of Artificial Sequence: Synthetic peptide
  XENP019051 vhCDR3
YYGNYGGYFDV

SEQ ID NO: 20996 - protein, 214 aa, Artificial Sequence
  Description of Artificial Sequence: Synthetic polypeptide
  XENP019051 1G6_H1_L1.174_IgG1_PVA_/S267K Light Chain
SIVMTQSPATLSVSPGERATLSCRASQSVSNDVAWYQQKPGQSPRLLINYASHRYTGVPDRFTGSGYGTEFTLTISSLQSEDFAVYFCQQDWGSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 20997 - protein, 107 aa, Artificial Sequence; identical to SEQ ID NO: 15285
  Description of Artificial Sequence: Synthetic polypeptide
  VL of XENP019051

SEQ ID NO: 20998 - protein, 11 aa, Artificial Sequence
  Description of Artificial Sequence: Synthetic peptide
  XENP019051 vlCDR1
RASQSVSNDVA

SEQ ID NO: 20999 - protein, 7 aa, Artificial Sequence
  Description of Artificial Sequence: Synthetic peptide
  XENP019051 vlCDR2
YASHRYT

SEQ ID NO: 21000 - protein, 9 aa, Artificial Sequence
  Description of Artificial Sequence: Synthetic peptide
  XENP019051 vlCDR3
QQDWGSPRT

SEQ ID NO: 21001 - protein, 451 aa, Artificial Sequence; identical to SEQ ID NO: 16221
  Description of Artificial Sequence: Synthetic polypeptide
  XENP019052 1G6_H1_L1.175_IgG1_PVA_/S267K Heavy Chain

SEQ ID NO: 21002 - protein, 122 aa, Artificial Sequence; identical to SEQ ID NO: 10922
  Description of Artificial Sequence: Synthetic polypeptide
  VH of XENP019052

SEQ ID NO: 21003 - protein, 5 aa, Artificial Sequence
  Description of Artificial Sequence: Synthetic peptide
  XENP019052 vhCDR1
NYWMN

SEQ ID NO: 21004 - protein, 19 aa, Artificial Sequence
  Description of Artificial Sequence: Synthetic peptide
  XENP019052 vhCDR2
EIRLKSNNYATHYAEPVKG

SEQ ID NO: 21005 - protein, 11 aa, Artificial Sequence
  Description of Artificial Sequence: Synthetic peptide
  XENP019052 vhCDR3
YYGNYGGYFDV

SEQ ID NO: 21006 - protein, 214 aa, Artificial Sequence
  Description of Artificial Sequence: Synthetic polypeptide
  XENP019052 1G6_H1_L1.175_IgG1_PVA_/S267K Light Chain
SIVMTQSPATLSVSPGERATLSCRASQSVGNDVAWYQQKPGQSPRLLINYASHRYTSVPDRFTGSGYGTEFTLTISSLQSEDFAVYFCQQDWSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 21007 - protein, 107 aa, Artificial Sequence; identical to SEQ ID NO: 15294
  Description of Artificial Sequence: Synthetic polypeptide
  VL of XENP019052

SEQ ID NO: 21008 - protein, 11 aa, Artificial Sequence
  Description of Artificial Sequence: Synthetic peptide
  XENP019052 vlCDR1
RASQSVGNDVA

SEQ ID NO: 21009 - protein, 7 aa, Artificial Sequence
  Description of Artificial Sequence: Synthetic peptide
  XENP019052 vlCDR2
YASHRYT

SEQ ID NO: 21010 - protein, 9 aa, Artificial Sequence
  Description of Artificial Sequence: Synthetic peptide
  XENP019052 vlCDR3
QQDWSSPRT

SEQ ID NO: 21011 - protein, 451 aa, Artificial Sequence; identical to SEQ ID NO: 16221
  Description of Artificial Sequence: Synthetic polypeptide
  XENP019053 1G6_H1_L1.176_IgG1_PVA_/S267K Heavy Chain

SEQ ID NO: 21012 - protein, 122 aa, Artificial Sequence; identical to SEQ ID NO: 10922
  Description of Artificial Sequence: Synthetic polypeptide
  VH of XENP019053

SEQ ID NO: 21013 - protein, 5 aa, Artificial Sequence
  Description of Artificial Sequence: Synthetic peptide
  XENP019053 vhCDR1
NYWMN

SEQ ID NO: 21014 - protein, 19 aa, Artificial Sequence
  Description of Artificial Sequence: Synthetic peptide
  XENP019053 vhCDR2
EIRLKSNNYATHYAEPVKG

SEQ ID NO: 21015 - protein, 11 aa, Artificial Sequence
  Description of Artificial Sequence: Synthetic peptide
  XENP019053 vhCDR3
YYGNYGGYFDV

SEQ ID NO: 21016 - protein, 214 aa, Artificial Sequence
  Description of Artificial Sequence: Synthetic polypeptide
  XENP019053 1G6_H1_L1.176_IgG1_PVA_/S267K Light Chain
SIVMTQSPATLSVSPGERATLSCRASQSVGNDVAWYQQKPGQSPRLLINYASWRYTSVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 21017 - protein, 107 aa, Artificial Sequence; identical to SEQ ID NO: 15303
  Description of Artificial Sequence: Synthetic polypeptide
  VL of XENP019053

SEQ ID NO: 21018 - protein, 11 aa, Artificial Sequence
  Description of Artificial Sequence: Synthetic peptide
  XENP019053 vlCDR1
RASQSVGNDVA

SEQ ID NO: 21019 - protein, 7 aa, Artificial Sequence
  Description of Artificial Sequence: Synthetic peptide
  XENP019053 vlCDR2
YASWRYT

SEQ ID NO: 21020 - protein, 9 aa, Artificial Sequence
  Description of Artificial Sequence: Synthetic peptide
  XENP019053 vlCDR3
QQDYSSPRT

SEQ ID NO: 21021 - protein, 451 aa, Artificial Sequence; identical to SEQ ID NO: 16221
  Description of Artificial Sequence: Synthetic polypeptide
  XENP019054 1G6_H1_L1.177_IgG1_PVA_/S267K Heavy Chain

SEQ ID NO: 21022 - protein, 122 aa, Artificial Sequence; identical to SEQ ID NO: 10922
  Description of Artificial Sequence: Synthetic polypeptide
  VH of XENP019054

SEQ ID NO: 21023 - protein, 5 aa, Artificial Sequence
  Description of Artificial Sequence: Synthetic peptide
  XENP019054 vhCDR1
NYWMN

SEQ ID NO: 21024 - protein, 19 aa, Artificial Sequence
  Description of Artificial Sequence: Synthetic peptide
  XENP019054 vhCDR2
EIRLKSNNYATHYAEPVKG

SEQ ID NO: 21025 - protein, 11 aa, Artificial Sequence
  Description of Artificial Sequence: Synthetic peptide
  XENP019054 vhCDR3
YYGNYGGYFDV

SEQ ID NO: 21026 - protein, 214 aa, Artificial Sequence
  Description of Artificial Sequence: Synthetic polypeptide
  XENP019054 1G6_H1_L1.177_IgG1_PVA_/S267K Light Chain
SIVMTQSPATLSVSPGERATLSCRASQSVGNDVAWYQQKPGQSPRLLINYASHRYTSVPDRFTGSGYGTEFTLTISSLQSEDFAVYFCQQDFSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 21027 - protein, 107 aa, Artificial Sequence; identical to SEQ ID NO: 15312
  Description of Artificial Sequence: Synthetic polypeptide
  VL of XENP019054

SEQ ID NO: 21028 - protein, 11 aa, Artificial Sequence
  Description of Artificial Sequence: Synthetic peptide
  XENP019054 vlCDR1
RASQSVGNDVA

SEQ ID NO: 21029 - protein, 7 aa, Artificial Sequence
  Description of Artificial Sequence: Synthetic peptide
  XENP019054 vlCDR2
YASHRYT

SEQ ID NO: 21030 - protein, 9 aa, Artificial Sequence
  Description of Artificial Sequence: Synthetic peptide
  XENP019054 vlCDR3
QQDFSSPRT

SEQ ID NO: 21031 - protein, 451 aa, Artificial Sequence; identical to SEQ ID NO: 16221
  Description of Artificial Sequence: Synthetic polypeptide
  XENP019055 1G6_H1_L1.178_IgG1_PVA_/S267K Heavy Chain

SEQ ID NO: 21032 - protein, 122 aa, Artificial Sequence; identical to SEQ ID NO: 10922
  Description of Artificial Sequence: Synthetic polypeptide
  VH of XENP019055

SEQ ID NO: 21033 - protein, 5 aa, Artificial Sequence
  Description of Artificial Sequence: Synthetic peptide
  XENP019055 vhCDR1
NYWMN

SEQ ID NO: 21034 - protein, 19 aa, Artificial Sequence
  Description of Artificial Sequence: Synthetic peptide
  XENP019055 vhCDR2
EIRLKSNNYATHYAEPVKG

SEQ ID NO: 21035 - protein, 11 aa, Artificial Sequence
  Description of Artificial Sequence: Synthetic peptide
  XENP019055 vhCDR3
YYGNYGGYFDV

SEQ ID NO: 21036 - protein, 214 aa, Artificial Sequence
  Description of Artificial Sequence: Synthetic polypeptide
  XENP019055 1G6_H1_L1.178_IgG1_PVA_/S267K Light Chain
SIVMTQSPATLSVSPGERATLSCRASQSVGNDVAWYQQKPGQSPRLLINYASHRYTSVPDRFTGSGYGTEFTLTISSLQSEDFAVYFCQQDGSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 21037 - protein, 107 aa, Artificial Sequence; identical to SEQ ID NO: 15321
  Description of Artificial Sequence: Synthetic polypeptide
  VL of XENP019055

SEQ ID NO: 21038 - protein, 11 aa, Artificial Sequence
  Description of Artificial Sequence: Synthetic peptide
  XENP019055 vlCDR1
RASQSVGNDVA

SEQ ID NO: 21039 - protein, 7 aa, Artificial Sequence
  Description of Artificial Sequence: Synthetic peptide
  XENP019055 vlCDR2
YASHRYT

SEQ ID NO: 21040 - protein, 9 aa, Artificial Sequence
  Description of Artificial Sequence: Synthetic peptide
  XENP019055 vlCDR3
QQDGSSPRT

SEQ ID NO: 21041 - protein, 451 aa, Artificial Sequence; identical to SEQ ID NO: 16221
  Description of Artificial Sequence: Synthetic polypeptide
  XENP019056 1G6_H1_L1.179_IgG1_PVA_/S267K Heavy Chain

SEQ ID NO: 21042 - protein, 122 aa, Artificial Sequence; identical to SEQ ID NO: 10922
  Description of Artificial Sequence: Synthetic polypeptide
  VH of XENP019056

SEQ ID NO: 21043 - protein, 5 aa, Artificial Sequence
  Description of Artificial Sequence: Synthetic peptide
  XENP019056 vhCDR1
NYWMN

SEQ ID NO: 21044 - protein, 19 aa, Artificial Sequence
  Description of Artificial Sequence: Synthetic peptide
  XENP019056 vhCDR2
EIRLKSNNYATHYAEPVKG

SEQ ID NO: 21045 - protein, 11 aa, Artificial Sequence
  Description of Artificial Sequence: Synthetic peptide
  XENP019056 vhCDR3
YYGNYGGYFDV

SEQ ID NO: 21046 - protein, 214 aa, Artificial Sequence
  Description of Artificial Sequence: Synthetic polypeptide
  XENP019056 1G6_H1_L1.179_IgG1_PVA_/S267K Light Chain
SIVMTQSPATLSVSPGERATLSCRASQSVSNDVAWYQQKPGQSPRLLINYASWRYTSVPDRFTGSGYGTEFTLTISSLQSEDFAVYFCQQDFSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 21047 - protein, 107 aa, Artificial Sequence; identical to SEQ ID NO: 15330
  Description of Artificial Sequence: Synthetic polypeptide
  VL of XENP019056

SEQ ID NO: 21048 - protein, 11 aa, Artificial Sequence
  Description of Artificial Sequence: Synthetic peptide
  XENP019056 vlCDR1
RASQSVSNDVA

SEQ ID NO: 21049 - protein, 7 aa, Artificial Sequence
  Description of Artificial Sequence: Synthetic peptide
  XENP019056 vlCDR2
YASWRYT

SEQ ID NO: 21050 - protein, 9 aa, Artificial Sequence
  Description of Artificial Sequence: Synthetic peptide
  XENP019056 vlCDR3
QQDFSSPRT

SEQ ID NO: 21051 - protein, 451 aa, Artificial Sequence; identical to SEQ ID NO: 16221
  Description of Artificial Sequence: Synthetic polypeptide
  XENP019057 1G6_H1_L1.180_IgG1_PVA_/S267K Heavy Chain

SEQ ID NO: 21052 - protein, 122 aa, Artificial Sequence; identical to SEQ ID NO: 10922
  Description of Artificial Sequence: Synthetic polypeptide
  VH of XENP019057

SEQ ID NO: 21053 - protein, 5 aa, Artificial Sequence
  Description of Artificial Sequence: Synthetic peptide
  XENP019057 vhCDR1
NYWMN

SEQ ID NO: 21054 - protein, 19 aa, Artificial Sequence
  Description of Artificial Sequence: Synthetic peptide
  XENP019057 vhCDR2
EIRLKSNNYATHYAEPVKG

SEQ ID NO: 21055 - protein, 11 aa, Artificial Sequence
  Description of Artificial Sequence: Synthetic peptide
  XENP019057 vhCDR3
YYGNYGGYFDV

SEQ ID NO: 21056 - protein, 214 aa, Artificial Sequence
  Description of Artificial Sequence: Synthetic polypeptide
  XENP019057 1G6_H1_L1.180_IgG1_PVA_/S267K Light Chain
SIVMTQSPATLSVSPGERATLSCRASQSVSNDVAWYQQKPGQSPRLLINYASWRYTSVPDRFTGSGYGTEFTLTISSLQSEDFAVYFCQQDWSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 21057 - protein, 107 aa, Artificial Sequence; identical to SEQ ID NO: 15339
  Description of Artificial Sequence: Synthetic polypeptide
  VL of XENP019057

SEQ ID NO: 21058 - protein, 11 aa, Artificial Sequence
  Description of Artificial Sequence: Synthetic peptide
  XENP019057 vlCDR1
RASQSVSNDVA

SEQ ID NO: 21059 - protein, 7 aa, Artificial Sequence
  Description of Artificial Sequence: Synthetic peptide
  XENP019057 vlCDR2
YASWRYT

SEQ ID NO: 21060 - protein, 9 aa, Artificial Sequence
  Description of Artificial Sequence: Synthetic peptide
  XENP019057 vlCDR3
QQDWSSPRT

SEQ ID NO: 21061 - protein, 451 aa, Artificial Sequence; identical to SEQ ID NO: 16221
  Description of Artificial Sequence: Synthetic polypeptide
  XENP019058 1G6_H1_L1.181_IgG1_PVA_/S267K Heavy Chain

SEQ ID NO: 21062 - protein, 122 aa, Artificial Sequence; identical to SEQ ID NO: 10922
  Description of Artificial Sequence: Synthetic polypeptide
  VH of XENP019058

SEQ ID NO: 21063 - protein, 5 aa, Artificial Sequence
  Description of Artificial Sequence: Synthetic peptide
  XENP019058 vhCDR1
NYWMN

SEQ ID NO: 21064 - protein, 19 aa, Artificial Sequence
  Description of Artificial Sequence: Synthetic peptide
  XENP019058 vhCDR2
EIRLKSNNYATHYAEPVKG

SEQ ID NO: 21065 - protein, 11 aa, Artificial Sequence
  Description of Artificial Sequence: Synthetic peptide
  XENP019058 vhCDR3
YYGNYGGYFDV

SEQ ID NO: 21066 - protein, 214 aa, Artificial Sequence
  Description of Artificial Sequence: Synthetic polypeptide
  XENP019058 1G6_H1_L1.181_IgG1_PVA_/S267K Light Chain
SIVMTQSPATLSVSPGERATLSCRASQSVSNDVAWYQQKPGQSPRLLINYASWRYTSVPDRFTGSGYGTEFTLTISSLQSEDFAVYFCQQDGSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 21067 - protein, 107 aa, Artificial Sequence; identical to SEQ ID NO: 15348
  Description of Artificial Sequence: Synthetic polypeptide
  VL of XENP019058

SEQ ID NO: 21068 - protein, 11 aa, Artificial Sequence
  Description of Artificial Sequence: Synthetic peptide
  XENP019058 vlCDR1
RASQSVSNDVA

SEQ ID NO: 21069 - protein, 7 aa, Artificial Sequence
  Description of Artificial Sequence: Synthetic peptide
  XENP019058 vlCDR2
YASWRYT

SEQ ID NO: 21070 - protein, 9 aa, Artificial Sequence
  Description of Artificial Sequence: Synthetic peptide
  XENP019058 vlCDR3
QQDGSSPRT

SEQ ID NO: 21071 - protein, 451 aa, Artificial Sequence; identical to SEQ ID NO: 16221
  Description of Artificial Sequence: Synthetic polypeptide
  XENP019059 1G6_H1_L1.182_IgG1_PVA_/S267K Heavy Chain

SEQ ID NO: 21072 - protein, 122 aa, Artificial Sequence; identical to SEQ ID NO: 10922
  Description of Artificial Sequence: Synthetic polypeptide
  VH of XENP019059

SEQ ID NO: 21073 - protein, 5 aa, Artificial Sequence
  Description of Artificial Sequence: Synthetic peptide
  XENP019059 vhCDR1
NYWMN

SEQ ID NO: 21074 - protein, 19 aa, Artificial Sequence
  Description of Artificial Sequence: Synthetic peptide
  XENP019059 vhCDR2
EIRLKSNNYATHYAEPVKG

SEQ ID NO: 21075 - protein, 11 aa, Artificial Sequence
  Description of Artificial Sequence: Synthetic peptide
  XENP019059 vhCDR3
YYGNYGGYFDV

SEQ ID NO: 21076 - protein, 214 aa, Artificial Sequence
  Description of Artificial Sequence: Synthetic polypeptide
  XENP019059 1G6_H1_L1.182_IgG1_PVA_/S267K Light Chain
SIVMTQSPATLSVSPGERATLSCRASQSVGNDVAWYQQKPGQSPRLLINYASWRYTSVPDRFTGSGYGTEFTLTISSLQSEDFAVYFCQQDWSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 21077 - protein, 107 aa, Artificial Sequence; identical to SEQ ID NO: 15357
  Description of Artificial Sequence: Synthetic polypeptide
  VL of XENP019059

SEQ ID NO: 21078 - protein, 11 aa, Artificial Sequence
  Description of Artificial Sequence: Synthetic peptide
  XENP019059 vlCDR1
RASQSVGNDVA

SEQ ID NO: 21079 - protein, 7 aa, Artificial Sequence
  Description of Artificial Sequence: Synthetic peptide
  XENP019059 vlCDR2
YASWRYT

SEQ ID NO: 21080 - protein, 9 aa, Artificial Sequence
  Description of Artificial Sequence: Synthetic peptide
  XENP019059 vlCDR3
QQDWSSPRT

SEQ ID NO: 21081 - protein, 451 aa, Artificial Sequence; identical to SEQ ID NO: 16221
  Description of Artificial Sequence: Synthetic polypeptide
  XENP019060 1G6_H1_L1.183_IgG1_PVA_/S267K Heavy Chain

SEQ ID NO: 21082 - protein, 122 aa, Artificial Sequence; identical to SEQ ID NO: 10922
  Description of Artificial Sequence: Synthetic polypeptide
  VH of XENP019060

SEQ ID NO: 21083 - protein, 5 aa, Artificial Sequence
  Description of Artificial Sequence: Synthetic peptide
  XENP019060 vhCDR1
NYWMN

SEQ ID NO: 21084 - protein, 19 aa, Artificial Sequence
  Description of Artificial Sequence: Synthetic peptide
  XENP019060 vhCDR2
EIRLKSNNYATHYAEPVKG

SEQ ID NO: 21085 - protein, 11 aa, Artificial Sequence
  Description of Artificial Sequence: Synthetic peptide
  XENP019060 vhCDR3
YYGNYGGYFDV

SEQ ID NO: 21086 - protein, 214 aa, Artificial Sequence
  Description of Artificial Sequence: Synthetic polypeptide
  XENP019060 1G6_H1_L1.183_IgG1_PVA_/S267K Light Chain
SIVMTQSPATLSVSPGERATLSCRASQSVGNDVAWYQQKPGQSPRLLINYASWRYTSVPDRFTGSGYGTEFTLTISSLQSEDFAVYFCQQDFSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 21087 - protein, 107 aa, Artificial Sequence; identical to SEQ ID NO: 15366
  Description of Artificial Sequence: Synthetic polypeptide
  VL of XENP019060

SEQ ID NO: 21088 - protein, 11 aa, Artificial Sequence
  Description of Artificial Sequence: Synthetic peptide
  XENP019060 vlCDR1
RASQSVGNDVA

SEQ ID NO: 21089 - protein, 7 aa, Artificial Sequence
  Description of Artificial Sequence: Synthetic peptide
  XENP019060 vlCDR2
YASWRYT

SEQ ID NO: 21090 - protein, 9 aa, Artificial Sequence
  Description of Artificial Sequence: Synthetic peptide
  XENP019060 vlCDR3
QQDFSSPRT

SEQ ID NO: 21091 - protein, 451 aa, Artificial Sequence; identical to SEQ ID NO: 16221
  Description of Artificial Sequence: Synthetic polypeptide
  XENP019061 1G6_H1_L1.184_IgG1_PVA_/S267K Heavy Chain

SEQ ID NO: 21092 - protein, 122 aa, Artificial Sequence; identical to SEQ ID NO: 10922
  Description of Artificial Sequence: Synthetic polypeptide
  VH of XENP019061

SEQ ID NO: 21093 - protein, 5 aa, Artificial Sequence
  Description of Artificial Sequence: Synthetic peptide
  XENP019061 vhCDR1
NYWMN

SEQ ID NO: 21094 - protein, 19 aa, Artificial Sequence
  Description of Artificial Sequence: Synthetic peptide
  XENP019061 vhCDR2
EIRLKSNNYATHYAEPVKG

SEQ ID NO: 21095 - protein, 11 aa, Artificial Sequence
  Description of Artificial Sequence: Synthetic peptide
  XENP019061 vhCDR3
YYGNYGGYFDV

SEQ ID NO: 21096 - protein, 214 aa, Artificial Sequence
  Description of Artificial Sequence: Synthetic polypeptide
  XENP019061 1G6_H1_L1.184_IgG1_PVA_/S267K Light Chain
SIVMTQSPATLSVSPGERATLSCRASQSVGNDVAWYQQKPGQSPRLLINYASWRYTSVPDRFTGSGYGTEFTLTISSLQSEDFAVYFCQQDGSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 21097 - protein, 107 aa, Artificial Sequence; identical to SEQ ID NO: 15375
  Description of Artificial Sequence: Synthetic polypeptide
  VL of XENP019061

SEQ ID NO: 21098 - protein, 11 aa, Artificial Sequence
  Description of Artificial Sequence: Synthetic peptide
  XENP019061 vlCDR1
RASQSVGNDVA

SEQ ID NO: 21099 - protein, 7 aa, Artificial Sequence
  Description of Artificial Sequence: Synthetic peptide
  XENP019061 vlCDR2
YASWRYT

SEQ ID NO: 21100 - protein, 9 aa, Artificial Sequence
  Description of Artificial Sequence: Synthetic peptide
  XENP019061 vlCDR3
QQDGSSPRT

SEQ ID NO: 21101 - protein, 451 aa, Artificial Sequence; identical to SEQ ID NO: 16221
  Description of Artificial Sequence: Synthetic polypeptide
  XENP019062 1G6_H1_L1.185_IgG1_PVA_/S267K Heavy Chain

SEQ ID NO: 21102 - protein, 122 aa, Artificial Sequence; identical to SEQ ID NO: 10922
  Description of Artificial Sequence: Synthetic polypeptide
  VH of XENP019062

SEQ ID NO: 21103 - protein, 5 aa, Artificial Sequence
  Description of Artificial Sequence: Synthetic peptide
  XENP019062 vhCDR1
NYWMN

SEQ ID NO: 21104 - protein, 19 aa, Artificial Sequence
  Description of Artificial Sequence: Synthetic peptide
  XENP019062 vhCDR2
EIRLKSNNYATHYAEPVKG

SEQ ID NO: 21105 - protein, 11 aa, Artificial Sequence
  Description of Artificial Sequence: Synthetic peptide
  XENP019062 vhCDR3
YYGNYGGYFDV

SEQ ID NO: 21106 - protein, 214 aa, Artificial Sequence
  Description of Artificial Sequence: Synthetic polypeptide
  XENP019062 1G6_H1_L1.185_IgG1_PVA_/S267K Light Chain
EIVMTQSPATLSVSPGERATLSCRASQSVSNDLAWYQQKPGQSPRLLINYASHRYTGVPARFSGSGYGTEFTLTISSLQSEDFAVYYCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 21107 - protein, 107 aa, Artificial Sequence; identical to SEQ ID NO: 15384
  Description of Artificial Sequence: Synthetic polypeptide
  VL of XENP019062

SEQ ID NO: 21108 - protein, 11 aa, Artificial Sequence
  Description of Artificial Sequence: Synthetic peptide
  XENP019062 vlCDR1
RASQSVSNDLA

SEQ ID NO: 21109 - protein, 7 aa, Artificial Sequence
  Description of Artificial Sequence: Synthetic peptide
  XENP019062 vlCDR2
YASHRYT

SEQ ID NO: 21110 - protein, 9 aa, Artificial Sequence
  Description of Artificial Sequence: Synthetic peptide
  XENP019062 vlCDR3
QQDYSSPRT

SEQ ID NO: 21111 - protein, 451 aa, Artificial Sequence; identical to SEQ ID NO: 16221
  Description of Artificial Sequence: Synthetic polypeptide
  XENP019063 1G6_H1_L1.186_IgG1_PVA_/S267K Heavy Chain

SEQ ID NO: 21112 - protein, 122 aa, Artificial Sequence; identical to SEQ ID NO: 10922
  Description of Artificial Sequence: Synthetic polypeptide
  VH of XENP019063

SEQ ID NO: 21113 - protein, 5 aa, Artificial Sequence
  Description of Artificial Sequence: Synthetic peptide
  XENP019063 vhCDR1
NYWMN

SEQ ID NO: 21114 - protein, 19 aa, Artificial Sequence
  Description of Artificial Sequence: Synthetic peptide
  XENP019063 vhCDR2
EIRLKSNNYATHYAEPVKG

SEQ ID NO: 21115 - protein, 11 aa, Artificial Sequence
  Description of Artificial Sequence: Synthetic peptide
  XENP019063 vhCDR3
YYGNYGGYFDV

SEQ ID NO: 21116 - protein, 214 aa, Artificial Sequence
  Description of Artificial Sequence: Synthetic polypeptide
  XENP019063 1G6_H1_L1.186_IgG1_PVA_/S267K Light Chain
DIVMTQSPATLSVSPGERATLSCRASQSVSNDLAWYQQKPGQSPRLLINYASHRYTGVPDRFSGSGYGTEFTLTISSLQSEDFAVYYCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 21117 - protein, 107 aa, Artificial Sequence; identical to SEQ ID NO: 15393
  Description of Artificial Sequence: Synthetic polypeptide
  VL of XENP019063

SEQ ID NO: 21118 - protein, 11 aa, Artificial Sequence
  Description of Artificial Sequence: Synthetic peptide
  XENP019063 vlCDR1
RASQSVSNDLA

SEQ ID NO: 21119 - protein, 7 aa, Artificial Sequence
  Description of Artificial Sequence: Synthetic peptide
  XENP019063 vlCDR2
YASHRYT

SEQ ID NO: 21120 - protein, 9 aa, Artificial Sequence
  Description of Artificial Sequence: Synthetic peptide
  XENP019063 vlCDR3
QQDYSSPRT

SEQ ID NO: 21121 - protein, 451 aa, Artificial Sequence; identical to SEQ ID NO: 20621
  Description of Artificial Sequence: Synthetic polypeptide
  XENP019160 1G6_H1.269_L1.116_IgG1_PVA_/S267K Heavy Chain

SEQ ID NO: 21122 - protein, 122 aa, Artificial Sequence; identical to SEQ ID NO: 14951
  Description of Artificial Sequence: Synthetic polypeptide
  VH of XENP019160

SEQ ID NO: 21123 - protein, 5 aa, Artificial Sequence
  Description of Artificial Sequence: Synthetic peptide
  XENP019160 vhCDR1
NFWMN

SEQ ID NO: 21124 - protein, 19 aa, Artificial Sequence
  Description of Artificial Sequence: Synthetic peptide
  XENP019160 vhCDR2
EIRLYSNNYATHYAEPVKG

SEQ ID NO: 21125 - protein, 11 aa, Artificial Sequence
  Description of Artificial Sequence: Synthetic peptide
  XENP019160 vhCDR3
YYGNYGGYFDV

SEQ ID NO: 21126 - protein, 214 aa, Artificial Sequence; identical to SEQ ID NO: 19936
  Description of Artificial Sequence: Synthetic polypeptide
  XENP019160 1G6_H1.269_L1.116_IgG1_PVA_/S267K Light Chain

SEQ ID NO: 21127 - protein, 107 aa, Artificial Sequence; identical to SEQ ID NO: 14214
  Description of Artificial Sequence: Synthetic polypeptide
  VL of XENP019160

SEQ ID NO: 21128 - protein, 11 aa, Artificial Sequence
  Description of Artificial Sequence: Synthetic peptide
  XENP019160 vlCDR1
RASQSVSNDVA

SEQ ID NO: 21129 - protein, 7 aa, Artificial Sequence
  Description of Artificial Sequence: Synthetic peptide
  XENP019160 vlCDR2
YASHRYT

SEQ ID NO: 21130 - protein, 9 aa, Artificial Sequence
  Description of Artificial Sequence: Synthetic peptide
  XENP019160 vlCDR3
QQDFSSPRT

SEQ ID NO: 21131 - protein, 451 aa, Artificial Sequence; identical to SEQ ID NO: 20641
  Description of Artificial Sequence: Synthetic polypeptide
  XENP019161 1G6_H1.271_L1.116_IgG1_PVA_/S267K Heavy Chain

SEQ ID NO: 21132 - protein, 122 aa, Artificial Sequence; identical to SEQ ID NO: 14969
  Description of Artificial Sequence: Synthetic polypeptide
  VH of XENP019161

SEQ ID NO: 21133 - protein, 5 aa, Artificial Sequence
  Description of Artificial Sequence: Synthetic peptide
  XENP019161 vhCDR1
NYWMN

SEQ ID NO: 21134 - protein, 19 aa, Artificial Sequence
  Description of Artificial Sequence: Synthetic peptide
  XENP019161 vhCDR2
EIRLYSNNYATHYAEPVKG

SEQ ID NO: 21135 - protein, 11 aa, Artificial Sequence
  Description of Artificial Sequence: Synthetic peptide
  XENP019161 vhCDR3
YYGNYGGYFDV

SEQ ID NO: 21136 - protein, 214 aa, Artificial Sequence; identical to SEQ ID NO: 19936
  Description of Artificial Sequence: Synthetic polypeptide
  XENP019161 1G6_H1.271_L1.116_IgG1_PVA_/S267K Light Chain

SEQ ID NO: 21137 - protein, 107 aa, Artificial Sequence; identical to SEQ ID NO: 14214
  Description of Artificial Sequence: Synthetic polypeptide
  VL of XENP019161

SEQ ID NO: 21138 - protein, 11 aa, Artificial Sequence
  Description of Artificial Sequence: Synthetic peptide
  XENP019161 vlCDR1
RASQSVSNDVA

SEQ ID NO: 21139 - protein, 7 aa, Artificial Sequence
  Description of Artificial Sequence: Synthetic peptide
  XENP019161 vlCDR2
YASHRYT

SEQ ID NO: 21140 - protein, 9 aa, Artificial Sequence
  Description of Artificial Sequence: Synthetic peptide
  XENP019161 vlCDR3
QQDFSSPRT

SEQ ID NO: 21141 - protein, 451 aa, Artificial Sequence; identical to SEQ ID NO: 20651
  Description of Artificial Sequence: Synthetic polypeptide
  XENP019162 1G6_H1.272_L1.116_IgG1_PVA_/S267K Heavy Chain

SEQ ID NO: 21142 - protein, 122 aa, Artificial Sequence; identical to SEQ ID NO: 14978
  Description of Artificial Sequence: Synthetic polypeptide
  VH of XENP019162

SEQ ID NO: 21143 - protein, 5 aa, Artificial Sequence
  Description of Artificial Sequence: Synthetic peptide
  XENP019162 vhCDR1
NFWMN

SEQ ID NO: 21144 - protein, 19 aa, Artificial Sequence
  Description of Artificial Sequence: Synthetic peptide
  XENP019162 vhCDR2
EIRLYSNNYATHYAEPVKG

SEQ ID NO: 21145 - protein, 11 aa, Artificial Sequence
  Description of Artificial Sequence: Synthetic peptide
  XENP019162 vhCDR3
YYGNYGGYFDV

SEQ ID NO: 21146 - protein, 214 aa, Artificial Sequence; identical to SEQ ID NO: 19936
  Description of Artificial Sequence: Synthetic polypeptide
  XENP019162 1G6_H1.272_L1.116_IgG1_PVA_/S267K Light Chain

SEQ ID NO: 21147 - protein, 107 aa, Artificial Sequence; identical to SEQ ID NO: 14214
  Description of Artificial Sequence: Synthetic polypeptide
  VL of XENP019162

SEQ ID NO: 21148 - protein, 11 aa, Artificial Sequence
  Description of Artificial Sequence: Synthetic peptide
  XENP019162 vlCDR1
RASQSVSNDVA

SEQ ID NO: 21149 - protein, 7 aa, Artificial Sequence
  Description of Artificial Sequence: Synthetic peptide
  XENP019162 vlCDR2
YASHRYT

SEQ ID NO: 21150 - protein, 9 aa, Artificial Sequence
  Description of Artificial Sequence: Synthetic peptide
  XENP019162 vlCDR3
QQDFSSPRT

SEQ ID NO: 21151 - protein, 451 aa, Artificial Sequence; identical to SEQ ID NO: 17291
  Description of Artificial Sequence: Synthetic polypeptide
  XENP019163 1G6_H1.90_L1.177_IgG1_PVA_/S267K Heavy Chain

SEQ ID NO: 21152 - protein, 122 aa, Artificial Sequence; identical to SEQ ID NO: 11837
  Description of Artificial Sequence: Synthetic polypeptide
  VH of XENP019163

SEQ ID NO: 21153 - protein, 5 aa, Artificial Sequence
  Description of Artificial Sequence: Synthetic peptide
  XENP019163 vhCDR1
NYWMN

SEQ ID NO: 21154 - protein, 19 aa, Artificial Sequence
  Description of Artificial Sequence: Synthetic peptide
  XENP019163 vhCDR2
EIRLYSNNYATHYAEPVKG

SEQ ID NO: 21155 - protein, 11 aa, Artificial Sequence
  Description of Artificial Sequence: Synthetic peptide
  XENP019163 vhCDR3
YYGNYGGYFDV

SEQ ID NO: 21156 - protein, 214 aa, Artificial Sequence; identical to SEQ ID NO: 21026
  Description of Artificial Sequence: Synthetic polypeptide
  XENP019163 1G6_H1.90_L1.177_IgG1_PVA_/S267K Light Chain

SEQ ID NO: 21157 - protein, 107 aa, Artificial Sequence; identical to SEQ ID NO: 15312
  Description of Artificial Sequence: Synthetic polypeptide
  VL of XENP019163

SEQ ID NO: 21158 - protein, 11 aa, Artificial Sequence
  Description of Artificial Sequence: Synthetic peptide
  XENP019163 vlCDR1
RASQSVGNDVA

SEQ ID NO: 21159 - protein, 7 aa, Artificial Sequence
  Description of Artificial Sequence: Synthetic peptide
  XENP019163 vlCDR2
YASHRYT

SEQ ID NO: 21160 - protein, 9 aa, Artificial Sequence
  Description of Artificial Sequence: Synthetic peptide
  XENP019163 vlCDR3
QQDFSSPRT

SEQ ID NO: 21161 - protein, 451 aa, Artificial Sequence; identical to SEQ ID NO: 20621
  Description of Artificial Sequence: Synthetic polypeptide
  XENP019164 1G6_H1.269_L1.177_IgG1_PVA_/S267K Heavy Chain

SEQ ID NO: 21162 - protein, 122 aa, Artificial Sequence; identical to SEQ ID NO: 14951
  Description of Artificial Sequence: Synthetic polypeptide
  VH of XENP019164

SEQ ID NO: 21163 - protein, 5 aa, Artificial Sequence
  Description of Artificial Sequence: Synthetic peptide
  XENP019164 vhCDR1
NFWMN

SEQ ID NO: 21164 - protein, 19 aa, Artificial Sequence
  Description of Artificial Sequence: Synthetic peptide
  XENP019164 vhCDR2
EIRLYSNNYATHYAEPVKG

SEQ ID NO: 21165 - protein, 11 aa, Artificial Sequence
  Description of Artificial Sequence: Synthetic peptide
  XENP019164 vhCDR3
YYGNYGGYFDV

SEQ ID NO: 21166 - protein, 214 aa, Artificial Sequence; identical to SEQ ID NO: 21026
  Description of Artificial Sequence: Synthetic polypeptide
  XENP019164 1G6_H1.269_L1.177_IgG1_PVA_/S267K Light Chain

SEQ ID NO: 21167 - protein, 107 aa, Artificial Sequence; identical to SEQ ID NO: 15312
  Description of Artificial Sequence: Synthetic polypeptide
  VL of XENP019164

SEQ ID NO: 21168 - protein, 11 aa, Artificial Sequence
  Description of Artificial Sequence: Synthetic peptide
  XENP019164 vlCDR1
RASQSVGNDVA

SEQ ID NO: 21169 - protein, 7 aa, Artificial Sequence
  Description of Artificial Sequence: Synthetic peptide
  XENP019164 vlCDR2
YASHRYT

SEQ ID NO: 21170 - protein, 9 aa, Artificial Sequence
  Description of Artificial Sequence: Synthetic peptide
  XENP019164 vlCDR3
QQDFSSPRT

SEQ ID NO: 21171 - protein, 451 aa, Artificial Sequence; identical to SEQ ID NO: 20641
  Description of Artificial Sequence: Synthetic polypeptide
  XENP019165 1G6_H1.271_L1.177_IgG1_PVA_/S267K Heavy Chain

SEQ ID NO: 21172 - protein, 122 aa, Artificial Sequence; identical to SEQ ID NO: 14969
  Description of Artificial Sequence: Synthetic polypeptide
  VH of XENP019165

SEQ ID NO: 21173 - protein, 5 aa, Artificial Sequence
  Description of Artificial Sequence: Synthetic peptide
  XENP019165 vhCDR1
NYWMN

SEQ ID NO: 21174 - protein, 19 aa, Artificial Sequence
  Description of Artificial Sequence: Synthetic peptide
  XENP019165 vhCDR2
EIRLYSNNYATHYAEPVKG

SEQ ID NO: 21175 - protein, 11 aa, Artificial Sequence
  Description of Artificial Sequence: Synthetic peptide
  XENP019165 vhCDR3
YYGNYGGYFDV

SEQ ID NO: 21176 - protein, 214 aa, Artificial Sequence; identical to SEQ ID NO: 21026
  Description of Artificial Sequence: Synthetic polypeptide
  XENP019165 1G6_H1.271_L1.177_IgG1_PVA_/S267K Light Chain

SEQ ID NO: 21177 - protein, 107 aa, Artificial Sequence; identical to SEQ ID NO: 15312
  Description of Artificial Sequence: Synthetic polypeptide
  VL of XENP019165

SEQ ID NO: 21178 - protein, 11 aa, Artificial Sequence
  Description of Artificial Sequence: Synthetic peptide
  XENP019165 vlCDR1
RASQSVGNDVA

SEQ ID NO: 21179 - protein, 7 aa, Artificial Sequence
  Description of Artificial Sequence: Synthetic peptide
  XENP019165 vlCDR2
YASHRYT

SEQ ID NO: 21180 - protein, 9 aa, Artificial Sequence
  Description of Artificial Sequence: Synthetic peptide
  XENP019165 vlCDR3
QQDFSSPRT

SEQ ID NO: 21181 - protein, 451 aa, Artificial Sequence; identical to SEQ ID NO: 20651
  Description of Artificial Sequence: Synthetic polypeptide
  XENP019166 1G6_H1.272_L1.177_IgG1_PVA_/S267K Heavy Chain

SEQ ID NO: 21182 - protein, 122 aa, Artificial Sequence; identical to SEQ ID NO: 14978
  Description of Artificial Sequence: Synthetic polypeptide
  VH of XENP019166

SEQ ID NO: 21183 - protein, 5 aa, Artificial Sequence
  Description of Artificial Sequence: Synthetic peptide
  XENP019166 vhCDR1
NFWMN

SEQ ID NO: 21184 - protein, 19 aa, Artificial Sequence
  Description of Artificial Sequence: Synthetic peptide
  XENP019166 vhCDR2
EIRLYSNNYATHYAEPVKG

SEQ ID NO: 21185 - protein, 11 aa, Artificial Sequence
  Description of Artificial Sequence: Synthetic peptide
  XENP019166 vhCDR3
YYGNYGGYFDV

SEQ ID NO: 21186 - protein, 214 aa, Artificial Sequence; identical to SEQ ID NO: 21026
  Description of Artificial Sequence: Synthetic polypeptide
  XENP019166 1G6_H1.272_L1.177_IgG1_PVA_/S267K Light Chain

SEQ ID NO: 21187 - protein, 107 aa, Artificial Sequence; identical to SEQ ID NO: 15312
  Description of Artificial Sequence: Synthetic polypeptide
  VL of XENP019166

SEQ ID NO: 21188 - protein, 11 aa, Artificial Sequence
  Description of Artificial Sequence: Synthetic peptide
  XENP019166 vlCDR1
RASQSVGNDVA

SEQ ID NO: 21189 - protein, 7 aa, Artificial Sequence
  Description of Artificial Sequence: Synthetic peptide
  XENP019166 vlCDR2
YASHRYT

SEQ ID NO: 21190 - protein, 9 aa, Artificial Sequence
  Description of Artificial Sequence: Synthetic peptide
  XENP019166 vlCDR3
QQDFSSPRT

SEQ ID NO: 21191 - protein, 451 aa, Artificial Sequence; identical to SEQ ID NO: 17291
  Description of Artificial Sequence: Synthetic polypeptide
  XENP019167 1G6_H1.90_L1.175_IgG1_PVA_/S267K Heavy Chain

SEQ ID NO: 21192 - protein, 122 aa, Artificial Sequence; identical to SEQ ID NO: 11837
  Description of Artificial Sequence: Synthetic polypeptide
  VH of XENP019167

SEQ ID NO: 21193 - protein, 5 aa, Artificial Sequence
  Description of Artificial Sequence: Synthetic peptide
  XENP019167 vhCDR1
NYWMN

SEQ ID NO: 21194 - protein, 19 aa, Artificial Sequence
  Description of Artificial Sequence: Synthetic peptide
  XENP019167 vhCDR2
EIRLYSNNYATHYAEPVKG

SEQ ID NO: 21195 - protein, 11 aa, Artificial Sequence
  Description of Artificial Sequence: Synthetic peptide
  XENP019167 vhCDR3
YYGNYGGYFDV

SEQ ID NO: 21196 - protein, 214 aa, Artificial Sequence; identical to SEQ ID NO: 21006
  Description of Artificial Sequence: Synthetic polypeptide
  XENP019167 1G6_H1.90_L1.175_IgG1_PVA_/S267K Light Chain

SEQ ID NO: 21197 - protein, 107 aa, Artificial Sequence; identical to SEQ ID NO: 15294
  Description of Artificial Sequence: Synthetic polypeptide
  VL of XENP019167

SEQ ID NO: 21198 - protein, 11 aa, Artificial Sequence
  Description of Artificial Sequence: Synthetic peptide
  XENP019167 vlCDR1
RASQSVGNDVA

SEQ ID NO: 21199 - protein, 7 aa, Artificial Sequence
  Description of Artificial Sequence: Synthetic peptide
  XENP019167 vlCDR2
YASHRYT

SEQ ID NO: 21200 - protein, 9 aa, Artificial Sequence
  Description of Artificial Sequence: Synthetic peptide
  XENP019167 vlCDR3
QQDWSSPRT

SEQ ID NO: 21201 - protein, 451 aa, Artificial Sequence; identical to SEQ ID NO: 20621
  Description of Artificial Sequence: Synthetic polypeptide
  XENP019168 1G6_H1.269_L1.175_IgG1_PVA_/S267K Heavy Chain

SEQ ID NO: 21202 - protein, 122 aa, Artificial Sequence; identical to SEQ ID NO: 14951
  Description of Artificial Sequence: Synthetic polypeptide
  VH of XENP019168

SEQ ID NO: 21203 - protein, 5 aa, Artificial Sequence
  Description of Artificial Sequence: Synthetic peptide
  XENP019168 vhCDR1
NFWMN

SEQ ID NO: 21204 - protein, 19 aa, Artificial Sequence
  Description of Artificial Sequence: Synthetic peptide
  XENP019168 vhCDR2
EIRLYSNNYATHYAEPVKG

SEQ ID NO: 21205 - protein, 11 aa, Artificial Sequence
  Description of Artificial Sequence: Synthetic peptide
  XENP019168 vhCDR3
YYGNYGGYFDV

SEQ ID NO: 21206 - protein, 214 aa, Artificial Sequence; identical to SEQ ID NO: 21006
  Description of Artificial Sequence: Synthetic polypeptide
  XENP019168 1G6_H1.269_L1.175_IgG1_PVA_/S267K Light Chain

SEQ ID NO: 21207 - protein, 107 aa, Artificial Sequence; identical to SEQ ID NO: 15294
  Description of Artificial Sequence: Synthetic polypeptide
  VL of XENP019168

SEQ ID NO: 21208 - protein, 11 aa, Artificial Sequence
  Description of Artificial Sequence: Synthetic peptide
  XENP019168 vlCDR1
RASQSVGNDVA

SEQ ID NO: 21209 - protein, 7 aa, Artificial Sequence
  Description of Artificial Sequence: Synthetic peptide
  XENP019168 vlCDR2
YASHRYT

SEQ ID NO: 21210 - protein, 9 aa, Artificial Sequence
  Description of Artificial Sequence: Synthetic peptide
  XENP019168 vlCDR3
QQDWSSPRT

SEQ ID NO: 21211 - protein, 451 aa, Artificial Sequence; identical to SEQ ID NO: 20641
  Description of Artificial Sequence: Synthetic polypeptide
  XENP019169 1G6_H1.271_L1.175_IgG1_PVA_/S267K Heavy Chain

SEQ ID NO: 21212 - protein, 122 aa, Artificial Sequence; identical to SEQ ID NO: 14969
  Description of Artificial Sequence: Synthetic polypeptide
  VH of XENP019169

SEQ ID NO: 21213 - protein, 5 aa, Artificial Sequence
  Description of Artificial Sequence: Synthetic peptide
  XENP019169 vhCDR1
NYWMN

SEQ ID NO: 21214 - protein, 19 aa, Artificial Sequence
  Description of Artificial Sequence: Synthetic peptide
  XENP019169 vhCDR2
EIRLYSNNYATHYAEPVKG

SEQ ID NO: 21215 - protein, 11 aa, Artificial Sequence
  Description of Artificial Sequence: Synthetic peptide
  XENP019169 vhCDR3
YYGNYGGYFDV

SEQ ID NO: 21216 - protein, 214 aa, Artificial Sequence; identical to SEQ ID NO: 21006
  Description of Artificial Sequence: Synthetic polypeptide
  XENP019169 1G6_H1.271_L1.175_IgG1_PVA_/S267K Light Chain

SEQ ID NO: 21217 - protein, 107 aa, Artificial Sequence; identical to SEQ ID NO: 15294
  Description of Artificial Sequence: Synthetic polypeptide
  VL of XENP019169

SEQ ID NO: 21218 - protein, 11 aa, Artificial Sequence
  Description of Artificial Sequence: Synthetic peptide
  XENP019169 vlCDR1
RASQSVGNDVA

SEQ ID NO: 21219 - protein, 7 aa, Artificial Sequence
  Description of Artificial Sequence: Synthetic peptide
  XENP019169 vlCDR2
YASHRYT

SEQ ID NO: 21220 - protein, 9 aa, Artificial Sequence
  Description of Artificial Sequence: Synthetic peptide
  XENP019169 vlCDR3
QQDWSSPRT

SEQ ID NO: 21221 - protein, 451 aa, Artificial Sequence; identical to SEQ ID NO: 20651
  Description of Artificial Sequence: Synthetic polypeptide
  XENP019170 1G6_H1.272_L1.175_IgG1_PVA_/S267K Heavy Chain

SEQ ID NO: 21222 - protein, 122 aa, Artificial Sequence; identical to SEQ ID NO: 14978
  Description of Artificial Sequence: Synthetic polypeptide
  VH of XENP019170

SEQ ID NO: 21223 - protein, 5 aa, Artificial Sequence
  Description of Artificial Sequence: Synthetic peptide
  XENP019170 vhCDR1
NFWMN

SEQ ID NO: 21224 - protein, 19 aa, Artificial Sequence
  Description of Artificial Sequence: Synthetic peptide
  XENP019170 vhCDR2
EIRLYSNNYATHYAEPVKG

SEQ ID NO: 21225 - protein, 11 aa, Artificial Sequence
  Description of Artificial Sequence: Synthetic peptide
  XENP019170 vhCDR3
YYGNYGGYFDV

SEQ ID NO: 21226 - protein, 214 aa, Artificial Sequence; identical to SEQ ID NO: 21006
  Description of Artificial Sequence: Synthetic polypeptide
  XENP019170 1G6_H1.272_L1.175_IgG1_PVA_/S267K Light Chain

SEQ ID NO: 21227 - protein, 107 aa, Artificial Sequence; identical to SEQ ID NO: 15294
  Description of Artificial Sequence: Synthetic polypeptide
  VL of XENP019170

SEQ ID NO: 21228 - protein, 11 aa, Artificial Sequence
  Description of Artificial Sequence: Synthetic peptide
  XENP019170 vlCDR1
RASQSVGNDVA

SEQ ID NO: 21229 - protein, 7 aa, Artificial Sequence
  Description of Artificial Sequence: Synthetic peptide
  XENP019170 vlCDR2
YASHRYT

SEQ ID NO: 21230 - protein, 9 aa, Artificial Sequence
  Description of Artificial Sequence: Synthetic peptide
  XENP019170 vlCDR3
QQDWSSPRT

SEQ ID NO: 21231 - protein, 451 aa, Artificial Sequence; identical to SEQ ID NO: 16221
  Description of Artificial Sequence: Synthetic polypeptide
  XENP019172 1G6_H1_L1.190_IgG1_PVA_/S267K Heavy Chain

SEQ ID NO: 21232 - protein, 122 aa, Artificial Sequence; identical to SEQ ID NO: 10922
  Description of Artificial Sequence: Synthetic polypeptide
  VH of XENP019172

SEQ ID NO: 21233 - protein, 5 aa, Artificial Sequence
  Description of Artificial Sequence: Synthetic peptide
  XENP019172 vhCDR1
NYWMN

SEQ ID NO: 21234 - protein, 19 aa, Artificial Sequence
  Description of Artificial Sequence: Synthetic peptide
  XENP019172 vhCDR2
EIRLKSNNYATHYAEPVKG

SEQ ID NO: 21235 - protein, 11 aa, Artificial Sequence
  Description of Artificial Sequence: Synthetic peptide
  XENP019172 vhCDR3
YYGNYGGYFDV

SEQ ID NO: 21236 - protein, 214 aa, Artificial Sequence
  Description of Artificial Sequence: Synthetic polypeptide
  XENP019172 1G6_H1_L1.190_IgG1_PVA_/S267K Light Chain
SIVMTQSPATLSVSPGERATLSCRASQSVGNDVAWYQQKPGQSPRLLINYASHRYTGVPDRFTGSGYGTEFTLTISSLQSEDFAVYFCQQDFSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 21237 - protein, 107 aa, Artificial Sequence; identical to SEQ ID NO: 15504
  Description of Artificial Sequence: Synthetic polypeptide
  VL of XENP019172

SEQ ID NO: 21238 - protein, 11 aa, Artificial Sequence
  Description of Artificial Sequence: Synthetic peptide
  XENP019172 vlCDR1
RASQSVGNDVA

SEQ ID NO: 21239 - protein, 7 aa, Artificial Sequence
  Description of Artificial Sequence: Synthetic peptide
  XENP019172 vlCDR2
YASHRYT

SEQ ID NO: 21240 - protein, 9 aa, Artificial Sequence
  Description of Artificial Sequence: Synthetic peptide
  XENP019172 vlCDR3
QQDFSSPRT

SEQ ID NO: 21241 - protein, 451 aa, Artificial Sequence; identical to SEQ ID NO: 16221
  Description of Artificial Sequence: Synthetic polypeptide
  XENP019173 1G6_H1_L1.191_IgG1_PVA_/S267K Heavy Chain

SEQ ID NO: 21242 - protein, 122 aa, Artificial Sequence; identical to SEQ ID NO: 10922
  Description of Artificial Sequence: Synthetic polypeptide
  VH of XENP019173

SEQ ID NO: 21243 - protein, 5 aa, Artificial Sequence
  Description of Artificial Sequence: Synthetic peptide
  XENP019173 vhCDR1
NYWMN

SEQ ID NO: 21244 - protein, 19 aa, Artificial Sequence
  Description of Artificial Sequence: Synthetic peptide
  XENP019173 vhCDR2
EIRLKSNNYATHYAEPVKG

SEQ ID NO: 21245 - protein, 11 aa, Artificial Sequence
  Description of Artificial Sequence: Synthetic peptide
  XENP019173 vhCDR3
YYGNYGGYFDV

SEQ ID NO: 21246 - protein, 214 aa, Artificial Sequence
  Description of Artificial Sequence: Synthetic polypeptide
  XENP019173 1G6_H1_L1.191_IgG1_PVA_/S267K Light Chain
SIVMTQSPATLSVSPGERATLSCRASQSVGNDVAWYQQKPGQSPRLLINYASHRYTGVPDRFTGSGYGTEFTLTISSLQSEDFAVYFCQQDWSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 21247 - protein, 107 aa, Artificial Sequence; identical to SEQ ID NO: 15513
  Description of Artificial Sequence: Synthetic polypeptide
  VL of XENP019173

SEQ ID NO: 21248 - protein, 11 aa, Artificial Sequence
  Description of Artificial Sequence: Synthetic peptide
  XENP019173 vlCDR1
RASQSVGNDVA

SEQ ID NO: 21249 - protein, 7 aa, Artificial Sequence
  Description of Artificial Sequence: Synthetic peptide
  XENP019173 vlCDR2
YASHRYT

SEQ ID NO: 21250 - protein, 9 aa, Artificial Sequence
  Description of Artificial Sequence: Synthetic peptide
  XENP019173 vlCDR3
QQDWSSPRT

SEQ ID NO: 21251 - protein, 451 aa, Artificial Sequence; identical to SEQ ID NO: 17291
  Description of Artificial Sequence: Synthetic polypeptide
  XENP019174 1G6_H1.90_L1.190_IgG1_PVA_/S267K Heavy Chain

SEQ ID NO: 21252 - protein, 122 aa, Artificial Sequence; identical to SEQ ID NO: 11837
  Description of Artificial Sequence: Synthetic polypeptide
  VH of XENP019174

SEQ ID NO: 21253 - protein, 5 aa, Artificial Sequence
  Description of Artificial Sequence: Synthetic peptide
  XENP019174 vhCDR1
NYWMN

SEQ ID NO: 21254 - protein, 19 aa, Artificial Sequence
  Description of Artificial Sequence: Synthetic peptide
  XENP019174 vhCDR2
EIRLYSNNYATHYAEPVKG

SEQ ID NO: 21255 - protein, 11 aa, Artificial Sequence
  Description of Artificial Sequence: Synthetic peptide
  XENP019174 vhCDR3
YYGNYGGYFDV

SEQ ID NO: 21256 - protein, 214 aa, Artificial Sequence; identical to SEQ ID NO: 21236
  Description of Artificial Sequence: Synthetic polypeptide
  XENP019174 1G6_H1.90_L1.190_IgG1_PVA_/S267K Light Chain

SEQ ID NO: 21257 - protein, 107 aa, Artificial Sequence; identical to SEQ ID NO: 15504
  Description of Artificial Sequence: Synthetic polypeptide
  VL of XENP019174

SEQ ID NO: 21258 - protein, 11 aa, Artificial Sequence
  Description of Artificial Sequence: Synthetic peptide
  XENP019174 vlCDR1
RASQSVGNDVA

SEQ ID NO: 21259 - protein, 7 aa, Artificial Sequence
  Description of Artificial Sequence: Synthetic peptide
  XENP019174 vlCDR2
YASHRYT

SEQ ID NO: 21260 - protein, 9 aa, Artificial Sequence
  Description of Artificial Sequence: Synthetic peptide
  XENP019174 vlCDR3
QQDFSSPRT

SEQ ID NO: 21261 - protein, 451 aa, Artificial Sequence; identical to SEQ ID NO: 17291
  Description of Artificial Sequence: Synthetic polypeptide
  XENP019175 1G6_H1.90_L1.191_IgG1_PVA_/S267K Heavy Chain

SEQ ID NO: 21262 - protein, 122 aa, Artificial Sequence; identical to SEQ ID NO: 11837
  Description of Artificial Sequence: Synthetic polypeptide
  VH of XENP019175

SEQ ID NO: 21263 - protein, 5 aa, Artificial Sequence
  Description of Artificial Sequence: Synthetic peptide
  XENP019175 vhCDR1
NYWMN

SEQ ID NO: 21264 - protein, 19 aa, Artificial Sequence
  Description of Artificial Sequence: Synthetic peptide
  XENP019175 vhCDR2
EIRLYSNNYATHYAEPVKG

SEQ ID NO: 21265 - protein, 11 aa, Artificial Sequence
  Description of Artificial Sequence: Synthetic peptide
  XENP019175 vhCDR3
YYGNYGGYFDV

SEQ ID NO: 21266 - protein, 214 aa, Artificial Sequence; identical to SEQ ID NO: 21246
  Description of Artificial Sequence: Synthetic polypeptide
  XENP019175 1G6_H1.90_L1.191_IgG1_PVA_/S267K Light Chain

SEQ ID NO: 21267 - protein, 107 aa, Artificial Sequence; identical to SEQ ID NO: 15513
  Description of Artificial Sequence: Synthetic polypeptide
  VL of XENP019175

SEQ ID NO: 21268 - protein, 11 aa, Artificial Sequence
  Description of Artificial Sequence: Synthetic peptide
  XENP019175 vlCDR1
RASQSVGNDVA

SEQ ID NO: 21269 - protein, 7 aa, Artificial Sequence
  Description of Artificial Sequence: Synthetic peptide
  XENP019175 vlCDR2
YASHRYT

SEQ ID NO: 21270 - protein, 9 aa, Artificial Sequence
  Description of Artificial Sequence: Synthetic peptide
  XENP019175 vlCDR3
QQDWSSPRT

SEQ ID NO: 21271 - protein, 451 aa, Artificial Sequence; identical to SEQ ID NO: 20621
  Description of Artificial Sequence: Synthetic polypeptide
  XENP019176 1G6_H1.269_L1.190_IgG1_PVA_/S267K Heavy Chain

SEQ ID NO: 21272 - protein, 122 aa, Artificial Sequence; identical to SEQ ID NO: 14951
  Description of Artificial Sequence: Synthetic polypeptide
  VH of XENP019176

SEQ ID NO: 21273 - protein, 5 aa, Artificial Sequence
  Description of Artificial Sequence: Synthetic peptide
  XENP019176 vhCDR1
NFWMN

SEQ ID NO: 21274 - protein, 19 aa, Artificial Sequence
  Description of Artificial Sequence: Synthetic peptide
  XENP019176 vhCDR2
EIRLYSNNYATHYAEPVKG

SEQ ID NO: 21275 - protein, 11 aa, Artificial Sequence
  Description of Artificial Sequence: Synthetic peptide
  XENP019176 vhCDR3
YYGNYGGYFDV

SEQ ID NO: 21276 - protein, 214 aa, Artificial Sequence; identical to SEQ ID NO: 21236
  Description of Artificial Sequence: Synthetic polypeptide
  XENP019176 1G6_H1.269_L1.190_IgG1_PVA_/S267K Light Chain

SEQ ID NO: 21277 - protein, 107 aa, Artificial Sequence; identical to SEQ ID NO: 15504
  Description of Artificial Sequence: Synthetic polypeptide
  VL of XENP019176

SEQ ID NO: 21278 - protein, 11 aa, Artificial Sequence
  Description of Artificial Sequence: Synthetic peptide
  XENP019176 vlCDR1
RASQSVGNDVA

SEQ ID NO: 21279 - protein, 7 aa, Artificial Sequence
  Description of Artificial Sequence: Synthetic peptide
  XENP019176 vlCDR2
YASHRYT

SEQ ID NO: 21280 - protein, 9 aa, Artificial Sequence
  Description of Artificial Sequence: Synthetic peptide
  XENP019176 vlCDR3
QQDFSSPRT

SEQ ID NO: 21281 - protein, 451 aa, Artificial Sequence; identical to SEQ ID NO: 20641
  Description of Artificial Sequence: Synthetic polypeptide
  XENP019177 1G6_H1.271_L1.190_IgG1_PVA_/S267K Heavy Chain

SEQ ID NO: 21282 - protein, 122 aa, Artificial Sequence; identical to SEQ ID NO: 14969
  Description of Artificial Sequence: Synthetic polypeptide
  VH of XENP019177

SEQ ID NO: 21283 - protein, 5 aa, Artificial Sequence
  Description of Artificial Sequence: Synthetic peptide
  XENP019177 vhCDR1
NYWMN

SEQ ID NO: 21284 - protein, 19 aa, Artificial Sequence
  Description of Artificial Sequence: Synthetic peptide
  XENP019177 vhCDR2
EIRLYSNNYATHYAEPVKG

SEQ ID NO: 21285 - protein, 11 aa, Artificial Sequence
  Description of Artificial Sequence: Synthetic peptide
  XENP019177 vhCDR3
YYGNYGGYFDV

SEQ ID NO: 21286 - protein, 214 aa, Artificial Sequence; identical to SEQ ID NO: 21236
  Description of Artificial Sequence: Synthetic polypeptide
  XENP019177 1G6_H1.271_L1.190_IgG1_PVA_/S267K Light Chain

SEQ ID NO: 21287 - protein, 107 aa, Artificial Sequence; identical to SEQ ID NO: 15504
  Description of Artificial Sequence: Synthetic polypeptide
  VL of XENP019177

SEQ ID NO: 21288 - protein, 11 aa, Artificial Sequence
  Description of Artificial Sequence: Synthetic peptide
  XENP019177 vlCDR1
RASQSVGNDVA

SEQ ID NO: 21289 - protein, 7 aa, Artificial Sequence
  Description of Artificial Sequence: Synthetic peptide
  XENP019177 vlCDR2
YASHRYT

SEQ ID NO: 21290 - protein, 9 aa, Artificial Sequence
  Description of Artificial Sequence: Synthetic peptide
  XENP019177 vlCDR3
QQDFSSPRT

SEQ ID NO: 21291 - protein, 451 aa, Artificial Sequence; identical to SEQ ID NO: 20651
  Description of Artificial Sequence: Synthetic polypeptide
  XENP019178 1G6_H1.272_L1.190_IgG1_PVA_/S267K Heavy Chain

SEQ ID NO: 21292 - protein, 122 aa, Artificial Sequence; identical to SEQ ID NO: 14978
  Description of Artificial Sequence: Synthetic polypeptide
  VH of XENP019178

SEQ ID NO: 21293 - protein, 5 aa, Artificial Sequence
  Description of Artificial Sequence: Synthetic peptide
  XENP019178 vhCDR1
NFWMN

SEQ ID NO: 21294 - protein, 19 aa, Artificial Sequence
  Description of Artificial Sequence: Synthetic peptide
  XENP019178 vhCDR2
EIRLYSNNYATHYAEPVKG

SEQ ID NO: 21295 - protein, 11 aa, Artificial Sequence
  Description of Artificial Sequence: Synthetic peptide
  XENP019178 vhCDR3
YYGNYGGYFDV

SEQ ID NO: 21296 - protein, 214 aa, Artificial Sequence; identical to SEQ ID NO: 21236
  Description of Artificial Sequence: Synthetic polypeptide
  XENP019178 1G6_H1.272_L1.190_IgG1_PVA_/S267K Light Chain

SEQ ID NO: 21297 - protein, 107 aa, Artificial Sequence; identical to SEQ ID NO: 15504
  Description of Artificial Sequence: Synthetic polypeptide
  VL of XENP019178

SEQ ID NO: 21298 - protein, 11 aa, Artificial Sequence
  Description of Artificial Sequence: Synthetic peptide
  XENP019178 vlCDR1
RASQSVGNDVA

SEQ ID NO: 21299 - protein, 7 aa, Artificial Sequence
  Description of Artificial Sequence: Synthetic peptide
  XENP019178 vlCDR2
YASHRYT

SEQ ID NO: 21300 - protein, 9 aa, Artificial Sequence
  Description of Artificial Sequence: Synthetic peptide
  XENP019178 vlCDR3
QQDFSSPRT

SEQ ID NO: 21301 - protein, 451 aa, Artificial Sequence; identical to SEQ ID NO: 20621
  Description of Artificial Sequence: Synthetic polypeptide
  XENP019179 1G6_H1.269_L1.191_IgG1_PVA_/S267K Heavy Chain

SEQ ID NO: 21302 - protein, 122 aa, Artificial Sequence; identical to SEQ ID NO: 14951
  Description of Artificial Sequence: Synthetic polypeptide
  VH of XENP019179

SEQ ID NO: 21303 - protein, 5 aa, Artificial Sequence
  Description of Artificial Sequence: Synthetic peptide
  XENP019179 vhCDR1
NFWMN

SEQ ID NO: 21304 - protein, 19 aa, Artificial Sequence
  Description of Artificial Sequence: Synthetic peptide
  XENP019179 vhCDR2
EIRLYSNNYATHYAEPVKG

SEQ ID NO: 21305 - protein, 11 aa, Artificial Sequence
  Description of Artificial Sequence: Synthetic peptide
  XENP019179 vhCDR3
YYGNYGGYFDV

SEQ ID NO: 21306 - protein, 214 aa, Artificial Sequence; identical to SEQ ID NO: 21246
  Description of Artificial Sequence: Synthetic polypeptide
  XENP019179 1G6_H1.269_L1.191_IgG1_PVA_/S267K Light Chain

SEQ ID NO: 21307 - protein, 107 aa, Artificial Sequence; identical to SEQ ID NO: 15513
  Description of Artificial Sequence: Synthetic polypeptide
  VL of XENP019179

SEQ ID NO: 21308 - protein, 11 aa, Artificial Sequence
  Description of Artificial Sequence: Synthetic peptide
  XENP019179 vlCDR1
RASQSVGNDVA

SEQ ID NO: 21309 - protein, 7 aa, Artificial Sequence
  Description of Artificial Sequence: Synthetic peptide
  XENP019179 vlCDR2
YASHRYT

SEQ ID NO: 21310 - protein, 9 aa, Artificial Sequence
  Description of Artificial Sequence: Synthetic peptide
  XENP019179 vlCDR3
QQDWSSPRT

SEQ ID NO: 21311 - protein, 451 aa, Artificial Sequence; identical to SEQ ID NO: 20641
  Description of Artificial Sequence: Synthetic polypeptide
  XENP019180 1G6_H1.271_L1.191_IgG1_PVA_/S267K Heavy Chain

SEQ ID NO: 21312 - protein, 122 aa, Artificial Sequence; identical to SEQ ID NO: 14969
  Description of Artificial Sequence: Synthetic polypeptide
  VH of XENP019180

SEQ ID NO: 21313 - protein, 5 aa, Artificial Sequence
  Description of Artificial Sequence: Synthetic peptide
  XENP019180 vhCDR1
NYWMN

SEQ ID NO: 21314 - protein, 19 aa, Artificial Sequence
  Description of Artificial Sequence: Synthetic peptide
  XENP019180 vhCDR2
EIRLYSNNYATHYAEPVKG

SEQ ID NO: 21315 - protein, 11 aa, Artificial Sequence
  Description of Artificial Sequence: Synthetic peptide
  XENP019180 vhCDR3
YYGNYGGYFDV

SEQ ID NO: 21316 - protein, 214 aa, Artificial Sequence; identical to SEQ ID NO: 21246
  Description of Artificial Sequence: Synthetic polypeptide
  XENP019180 1G6_H1.271_L1.191_IgG1_PVA_/S267K Light Chain

SEQ ID NO: 21317 - protein, 107 aa, Artificial Sequence; identical to SEQ ID NO: 15513
  Description of Artificial Sequence: Synthetic polypeptide
  VL of XENP019180

SEQ ID NO: 21318 - protein, 11 aa, Artificial Sequence
  Description of Artificial Sequence: Synthetic peptide
  XENP019180 vlCDR1
RASQSVGNDVA

SEQ ID NO: 21319 - protein, 7 aa, Artificial Sequence
  Description of Artificial Sequence: Synthetic peptide
  XENP019180 vlCDR2
YASHRYT

SEQ ID NO: 21320 - protein, 9 aa, Artificial Sequence
  Description of Artificial Sequence: Synthetic peptide
  XENP019180 vlCDR3
QQDWSSPRT

SEQ ID NO: 21321 - protein, 451 aa, Artificial Sequence; identical to SEQ ID NO: 20651
  Description of Artificial Sequence: Synthetic polypeptide
  XENP019181 1G6_H1.272_L1.191_IgG1_PVA_/S267K Heavy Chain

SEQ ID NO: 21322 - protein, 122 aa, Artificial Sequence; identical to SEQ ID NO: 14978
  Description of Artificial Sequence: Synthetic polypeptide
  VH of XENP019181

SEQ ID NO: 21323 - protein, 5 aa, Artificial Sequence
  Description of Artificial Sequence: Synthetic peptide
  XENP019181 vhCDR1
NFWMN

SEQ ID NO: 21324 - protein, 19 aa, Artificial Sequence
  Description of Artificial Sequence: Synthetic peptide
  XENP019181 vhCDR2
EIRLYSNNYATHYAEPVKG

SEQ ID NO: 21325 - protein, 11 aa, Artificial Sequence
  Description of Artificial Sequence: Synthetic peptide
  XENP019181 vhCDR3
YYGNYGGYFDV

SEQ ID NO: 21326 - protein, 214 aa, Artificial Sequence; identical to SEQ ID NO: 21246
  Description of Artificial Sequence: Synthetic polypeptide
  XENP019181 1G6_H1.272_L1.191_IgG1_PVA_/S267K Light Chain

SEQ ID NO: 21327 - protein, 107 aa, Artificial Sequence; identical to SEQ ID NO: 15513
  Description of Artificial Sequence: Synthetic polypeptide
  VL of XENP019181

SEQ ID NO: 21328 - protein, 11 aa, Artificial Sequence
  Description of Artificial Sequence: Synthetic peptide
  XENP019181 vlCDR1
RASQSVGNDVA

SEQ ID NO: 21329 - protein, 7 aa, Artificial Sequence
  Description of Artificial Sequence: Synthetic peptide
  XENP019181 vlCDR2
YASHRYT

SEQ ID NO: 21330 - protein, 9 aa, Artificial Sequence
  Description of Artificial Sequence: Synthetic peptide
  XENP019181 vlCDR3
QQDWSSPRT

SEQ ID NO: 21331 - protein, 451 aa, Artificial Sequence; identical to SEQ ID NO: 16221
  Description of Artificial Sequence: Synthetic polypeptide
  XENP019193 1G6_H1_L1.188_IgG1_PVA_/S267K Heavy Chain

SEQ ID NO: 21332 - protein, 122 aa, Artificial Sequence; identical to SEQ ID NO: 10922
  Description of Artificial Sequence: Synthetic polypeptide
  VH of XENP019193

SEQ ID NO: 21333 - protein, 5 aa, Artificial Sequence
  Description of Artificial Sequence: Synthetic peptide
  XENP019193 vhCDR1
NYWMN

SEQ ID NO: 21334 - protein, 19 aa, Artificial Sequence
  Description of Artificial Sequence: Synthetic peptide
  XENP019193 vhCDR2
EIRLKSNNYATHYAEPVKG

SEQ ID NO: 21335 - protein, 11 aa, Artificial Sequence
  Description of Artificial Sequence: Synthetic peptide
  XENP019193 vhCDR3
YYGNYGGYFDV

SEQ ID NO: 21336 - protein, 214 aa, Artificial Sequence
  Description of Artificial Sequence: Synthetic polypeptide
  XENP019193 1G6_H1_L1.188_IgG1_PVA_/S267K Light Chain
EIVMTQSPATLSVSPGERVTLTCRASQSVGNDVAWYQQKPGQSPRLLINYASHRYTGVPDRFTGSGYGTEFTLTISSVQSEDFAVYFCQQDFSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 21337 - protein, 107 aa, Artificial Sequence; identical to SEQ ID NO: 15531
  Description of Artificial Sequence: Synthetic polypeptide
  VL of XENP019193

SEQ ID NO: 21338 - protein, 11 aa, Artificial Sequence
  Description of Artificial Sequence: Synthetic peptide
  XENP019193 vlCDR1
RASQSVGNDVA

SEQ ID NO: 21339 - protein, 7 aa, Artificial Sequence
  Description of Artificial Sequence: Synthetic peptide
  XENP019193 vlCDR2
YASHRYT

SEQ ID NO: 21340 - protein, 9 aa, Artificial Sequence
  Description of Artificial Sequence: Synthetic peptide
  XENP019193 vlCDR3
QQDFSSPRT

SEQ ID NO: 21341 - protein, 451 aa, Artificial Sequence; identical to SEQ ID NO: 16221
  Description of Artificial Sequence: Synthetic polypeptide
  XENP019194 1G6_H1_L1.189_IgG1_PVA_/S267K Heavy Chain

SEQ ID NO: 21342 - protein, 122 aa, Artificial Sequence; identical to SEQ ID NO: 10922
  Description of Artificial Sequence: Synthetic polypeptide
  VH of XENP019194

SEQ ID NO: 21343 - protein, 5 aa, Artificial Sequence
  Description of Artificial Sequence: Synthetic peptide
  XENP019194 vhCDR1
NYWMN

SEQ ID NO: 21344 - protein, 19 aa, Artificial Sequence
  Description of Artificial Sequence: Synthetic peptide
  XENP019194 vhCDR2
EIRLKSNNYATHYAEPVKG

SEQ ID NO: 21345 - protein, 11 aa, Artificial Sequence
  Description of Artificial Sequence: Synthetic peptide
  XENP019194 vhCDR3
YYGNYGGYFDV

SEQ ID NO: 21346 - protein, 214 aa, Artificial Sequence
  Description of Artificial Sequence: Synthetic polypeptide
  XENP019194 1G6_H1_L1.189_IgG1_PVA_/S267K Light Chain
EIVLTQSPATLSVSPGERVTLTCRASQSVGNDVAWYQQKPGQAPRLLINYASHRYTGVPDRFTGSGYGTEFTLTISSVQSEDFAVYYCQQDFSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 21347 - protein, 107 aa, Artificial Sequence; identical to SEQ ID NO: 15540
  Description of Artificial Sequence: Synthetic polypeptide
  VL of XENP019194

SEQ ID NO: 21348 - protein, 11 aa, Artificial Sequence
  Description of Artificial Sequence: Synthetic peptide
  XENP019194 vlCDR1
RASQSVGNDVA

SEQ ID NO: 21349 - protein, 7 aa, Artificial Sequence
  Description of Artificial Sequence: Synthetic peptide
  XENP019194 vlCDR2
YASHRYT

SEQ ID NO: 21350 - protein, 9 aa, Artificial Sequence
  Description of Artificial Sequence: Synthetic peptide
  XENP019194 vlCDR3
QQDFSSPRT

SEQ ID NO: 21351 - protein, 451 aa, Artificial Sequence
  Description of Artificial Sequence: Synthetic polypeptide
  XENP019195 1G6_H1.278_L1.188_IgG1_PVA_/S267K Heavy Chain
EVQLVESGGGLVKPGGSLRLSCVASGFTFSNYWMNWVRQAPGKGLEWVAEIRLYSNNYATHYAESVKGRFTISRDDSKSTLYLQMNNLKTEDTGVYYCTRYYGNYGGYFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 21352 - protein, 122 aa, Artificial Sequence; identical to SEQ ID NO: 15521
  Description of Artificial Sequence: Synthetic polypeptide
  VH of XENP019195

SEQ ID NO: 21353 - protein, 5 aa, Artificial Sequence
  Description of Artificial Sequence: Synthetic peptide
  XENP019195 vhCDR1
NYWMN

SEQ ID NO: 21354 - protein, 19 aa, Artificial Sequence
  Description of Artificial Sequence: Synthetic peptide
  XENP019195 vhCDR2
EIRLYSNNYATHYAESVKG

SEQ ID NO: 21355 - protein, 11 aa, Artificial Sequence
  Description of Artificial Sequence: Synthetic peptide
  XENP019195 vhCDR3
YYGNYGGYFDV

SEQ ID NO: 21356 - protein, 214 aa, Artificial Sequence; identical to SEQ ID NO: 21336
  Description of Artificial Sequence: Synthetic polypeptide
  XENP019195 1G6_H1.278_L1.188_IgG1_PVA_/S267K Light Chain

SEQ ID NO: 21357 - protein, 107 aa, Artificial Sequence; identical to SEQ ID NO: 15531
  Description of Artificial Sequence: Synthetic polypeptide
  VL of XENP019195

SEQ ID NO: 21358 - protein, 11 aa, Artificial Sequence
  Description of Artificial Sequence: Synthetic peptide
  XENP019195 vlCDR1
RASQSVGNDVA

SEQ ID NO: 21359 - protein, 7 aa, Artificial Sequence
  Description of Artificial Sequence: Synthetic peptide
  XENP019195 vlCDR2
YASHRYT

SEQ ID NO: 21360 - protein, 9 aa, Artificial Sequence
  Description of Artificial Sequence: Synthetic peptide
  XENP019195 vlCDR3
QQDFSSPRT

SEQ ID NO: 21361 - protein, 451 aa, Artificial Sequence; identical to SEQ ID NO: 21351
  Description of Artificial Sequence: Synthetic polypeptide
  XENP019196 1G6_H1.278_L1.189_IgG1_PVA_/S267K Heavy Chain

SEQ ID NO: 21362 - protein, 122 aa, Artificial Sequence; identical to SEQ ID NO: 15521
  Description of Artificial Sequence: Synthetic polypeptide
  VH of XENP019196

SEQ ID NO: 21363 - protein, 5 aa, Artificial Sequence
  Description of Artificial Sequence: Synthetic peptide
  XENP019196 vhCDR1
NYWMN

SEQ ID NO: 21364 - protein, 19 aa, Artificial Sequence
  Description of Artificial Sequence: Synthetic peptide
  XENP019196 vhCDR2
EIRLYSNNYATHYAESVKG

SEQ ID NO: 21365 - protein, 11 aa, Artificial Sequence
  Description of Artificial Sequence: Synthetic peptide
  XENP019196 vhCDR3
YYGNYGGYFDV

SEQ ID NO: 21366 - protein, 214 aa, Artificial Sequence; identical to SEQ ID NO: 21346
  Description of Artificial Sequence: Synthetic polypeptide
  XENP019196 1G6_H1.278_L1.189_IgG1_PVA_/S267K Light Chain

SEQ ID NO: 21367 - protein, 107 aa, Artificial Sequence; identical to SEQ ID NO: 15540
  Description of Artificial Sequence: Synthetic polypeptide
  VL of XENP019196

SEQ ID NO: 21368 - protein, 11 aa, Artificial Sequence
  Description of Artificial Sequence: Synthetic peptide
  XENP019196 vlCDR1
RASQSVGNDVA

SEQ ID NO: 21369 - protein, 7 aa, Artificial Sequence
  Description of Artificial Sequence: Synthetic peptide
  XENP019196 vlCDR2
YASHRYT

SEQ ID NO: 21370 - protein, 9 aa, Artificial Sequence
  Description of Artificial Sequence: Synthetic peptide
  XENP019196 vlCDR3
QQDFSSPRT

SEQ ID NO: 21371 - protein, 451 aa, Artificial Sequence; identical to SEQ ID NO: 21351
  Description of Artificial Sequence: Synthetic polypeptide
  XENP019201 1G6_H1.278_L1_IgG1_PVA_/S267K Heavy Chain

SEQ ID NO: 21372 - protein, 122 aa, Artificial Sequence; identical to SEQ ID NO: 15521
  Description of Artificial Sequence: Synthetic polypeptide
  VH of XENP019201

SEQ ID NO: 21373 - protein, 5 aa, Artificial Sequence
  Description of Artificial Sequence: Synthetic peptide
  XENP019201 vhCDR1
NYWMN

SEQ ID NO: 21374 - protein, 19 aa, Artificial Sequence
  Description of Artificial Sequence: Synthetic peptide
  XENP019201 vhCDR2
EIRLYSNNYATHYAESVKG

SEQ ID NO: 21375 - protein, 11 aa, Artificial Sequence
  Description of Artificial Sequence: Synthetic peptide
  XENP019201 vhCDR3
YYGNYGGYFDV

SEQ ID NO: 21376 - protein, 214 aa, Artificial Sequence; identical to SEQ ID NO: 16226
  Description of Artificial Sequence: Synthetic polypeptide
  XENP019201 1G6_H1.278_L1_IgG1_PVA_/S267K Light Chain

SEQ ID NO: 21377 - protein, 107 aa, Artificial Sequence; identical to SEQ ID NO: 10923
  Description of Artificial Sequence: Synthetic polypeptide
  VL of XENP019201

SEQ ID NO: 21378 - protein, 11 aa, Artificial Sequence
  Description of Artificial Sequence: Synthetic peptide
  XENP019201 vlCDR1
RASQSVSNDVA

SEQ ID NO: 21379 - protein, 7 aa, Artificial Sequence
  Description of Artificial Sequence: Synthetic peptide
  XENP019201 vlCDR2
YASHRYT

SEQ ID NO: 21380 - protein, 9 aa, Artificial Sequence
  Description of Artificial Sequence: Synthetic peptide
  XENP019201 vlCDR3
QQDYSSPRT

SEQ ID NO: 21381 - protein, 451 aa, Artificial Sequence
  Description of Artificial Sequence: Synthetic polypeptide
  XENP019589 1G6_H1.279_L1.189_IgG1_PVA_/S267K Heavy Chain
EVQLVESGGGLVKPGGSLRLSCVASGFTFSNYWMNWVRQAPGKGLEWVAEIRLYSNNYATHYAESVKGRFTISRDDSKSTLYLQMNNLKTEDTGVYYCTRYYGNYGGYFDVWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 21382 - protein, 122 aa, Artificial Sequence; identical to SEQ ID NO: 2872
  Description of Artificial Sequence: Synthetic polypeptide
  VH of XENP019589

SEQ ID NO: 21383 - protein, 5 aa, Artificial Sequence
  Description of Artificial Sequence: Synthetic peptide
  XENP019589 vhCDR1
NYWMN

SEQ ID NO: 21384 - protein, 19 aa, Artificial Sequence
  Description of Artificial Sequence: Synthetic peptide
  XENP019589 vhCDR2
EIRLYSNNYATHYAESVKG

SEQ ID NO: 21385 - protein, 11 aa, Artificial Sequence
  Description of Artificial Sequence: Synthetic peptide
  XENP019589 vhCDR3
YYGNYGGYFDV

SEQ ID NO: 21386 - protein, 214 aa, Artificial Sequence; identical to SEQ ID NO: 21346
  Description of Artificial Sequence: Synthetic polypeptide
  XENP019589 1G6_H1.279_L1.189_IgG1_PVA_/S267K Light Chain

SEQ ID NO: 21387 - protein, 107 aa, Artificial Sequence; identical to SEQ ID NO: 15540
  Description of Artificial Sequence: Synthetic polypeptide
  VL of XENP019589

SEQ ID NO: 21388 - protein, 11 aa, Artificial Sequence
  Description of Artificial Sequence: Synthetic peptide
  XENP019589 vlCDR1
RASQSVGNDVA

SEQ ID NO: 21389 - protein, 7 aa, Artificial Sequence
  Description of Artificial Sequence: Synthetic peptide
  XENP019589 vlCDR2
YASHRYT

SEQ ID NO: 21390 - protein, 9 aa, Artificial Sequence
  Description of Artificial Sequence: Synthetic peptide
  XENP019589 vlCDR3
QQDFSSPRT

SEQ ID NO: 21391 - protein, 451 aa, Artificial Sequence
  Description of Artificial Sequence: Synthetic polypeptide
  XENP019590 1G6_H1.280_L1.189_IgG1_PVA_/S267K Heavy Chain
EVQLVESGGGLVKPGGSLRLTCVASGFTFSNYWMNWVRQAPGKGLEWVAEIRLYSNNYATHYAESVKGRFTISRDDSKSTLYLQMNNLKTEDTGVYYCTRYYGNYGGYFDVWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 21392 - protein, 122 aa, Artificial Sequence; identical to SEQ ID NO: 15593
  Description of Artificial Sequence: Synthetic polypeptide
  VH of XENP019590

SEQ ID NO: 21393 - protein, 5 aa, Artificial Sequence
  Description of Artificial Sequence: Synthetic peptide
  XENP019590 vhCDR1
NYWMN

SEQ ID NO: 21394 - protein, 19 aa, Artificial Sequence
  Description of Artificial Sequence: Synthetic peptide
  XENP019590 vhCDR2
EIRLYSNNYATHYAESVKG

SEQ ID NO: 21395 - protein, 11 aa, Artificial Sequence
  Description of Artificial Sequence: Synthetic peptide
  XENP019590 vhCDR3
YYGNYGGYFDV

SEQ ID NO: 21396 - protein, 214 aa, Artificial Sequence; identical to SEQ ID NO: 21346
  Description of Artificial Sequence: Synthetic polypeptide
  XENP019590 1G6_H1.280_L1.189_IgG1_PVA_/S267K Light Chain

SEQ ID NO: 21397 - protein, 107 aa, Artificial Sequence; identical to SEQ ID NO: 15540
  Description of Artificial Sequence: Synthetic polypeptide
  VL of XENP019590

SEQ ID NO: 21398 - protein, 11 aa, Artificial Sequence
  Description of Artificial Sequence: Synthetic peptide
  XENP019590 vlCDR1
RASQSVGNDVA

SEQ ID NO: 21399 - protein, 7 aa, Artificial Sequence
  Description of Artificial Sequence: Synthetic peptide
  XENP019590 vlCDR2
YASHRYT

SEQ ID NO: 21400 - protein, 9 aa, Artificial Sequence
  Description of Artificial Sequence: Synthetic peptide
  XENP019590 vlCDR3
QQDFSSPRT

SEQ ID NO: 21401 - protein, 451 aa, Artificial Sequence
  Description of Artificial Sequence: Synthetic polypeptide
  XENP019591 1G6_H1.281_L1.189_IgG1_PVA_/S267K Heavy Chain
EVQLVESGGGLVKPGGSLRLSCVASGFTFSNYWMNWVRQAPGKGLEWVAEIRLYSNNYATHYAESVKGRFTISRDDSKSMLYLQMNNLKTEDTGVYYCTRYYGNYGGYFDVWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 21402 - protein, 122 aa, Artificial Sequence; identical to SEQ ID NO: 15602
  Description of Artificial Sequence: Synthetic polypeptide
  VH of XENP019591

SEQ ID NO: 21403 - protein, 5 aa, Artificial Sequence
  Description of Artificial Sequence: Synthetic peptide
  XENP019591 vhCDR1
NYWMN

SEQ ID NO: 21404 - protein, 19 aa, Artificial Sequence
  Description of Artificial Sequence: Synthetic peptide
  XENP019591 vhCDR2
EIRLYSNNYATHYAESVKG

SEQ ID NO: 21405 - protein, 11 aa, Artificial Sequence
  Description of Artificial Sequence: Synthetic peptide
  XENP019591 vhCDR3
YYGNYGGYFDV

SEQ ID NO: 21406 - protein, 214 aa, Artificial Sequence; identical to SEQ ID NO: 21346
  Description of Artificial Sequence: Synthetic polypeptide
  XENP019591 1G6_H1.281_L1.189_IgG1_PVA_/S267K Light Chain

SEQ ID NO: 21407 - protein, 107 aa, Artificial Sequence; identical to SEQ ID NO: 15540
  Description of Artificial Sequence: Synthetic polypeptide
  VL of XENP019591

SEQ ID NO: 21408 - protein, 11 aa, Artificial Sequence
  Description of Artificial Sequence: Synthetic peptide
  XENP019591 vlCDR1
RASQSVGNDVA

SEQ ID NO: 21409 - protein, 7 aa, Artificial Sequence
  Description of Artificial Sequence: Synthetic peptide
  XENP019591 vlCDR2
YASHRYT

SEQ ID NO: 21410 - protein, 9 aa, Artificial Sequence
  Description of Artificial Sequence: Synthetic peptide
  XENP019591 vlCDR3
QQDFSSPRT

SEQ ID NO: 21411 - protein, 451 aa, Artificial Sequence
  Description of Artificial Sequence: Synthetic polypeptide
  XENP019592 1G6_H1.282_L1.189_IgG1_PVA_/S267K Heavy Chain
EVQLVESGGGLVKPGGSLRLTCVASGFTFSNYWMNWVRQAPGKGLEWVAEIRLYSNNYATHYAESVKGRFTISRDDSKSMLYLQMNNLKTEDTGVYYCTRYYGNYGGYFDVWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 21412 - protein, 122 aa, Artificial Sequence; identical to SEQ ID NO: 15611
  Description of Artificial Sequence: Synthetic polypeptide
  VH of XENP019592

SEQ ID NO: 21413 - protein, 5 aa, Artificial Sequence
  Description of Artificial Sequence: Synthetic peptide
  XENP019592 vhCDR1
NYWMN

SEQ ID NO: 21414 - protein, 19 aa, Artificial Sequence
  Description of Artificial Sequence: Synthetic peptide
  XENP019592 vhCDR2
EIRLYSNNYATHYAESVKG

SEQ ID NO: 21415 - protein, 11 aa, Artificial Sequence
  Description of Artificial Sequence: Synthetic peptide
  XENP019592 vhCDR3
YYGNYGGYFDV

SEQ ID NO: 21416 - protein, 214 aa, Artificial Sequence; identical to SEQ ID NO: 21346
  Description of Artificial Sequence: Synthetic polypeptide
  XENP019592 1G6_H1.282_L1.189_IgG1_PVA_/S267K Light Chain

SEQ ID NO: 21417 - protein, 107 aa, Artificial Sequence; identical to SEQ ID NO: 15540
  Description of Artificial Sequence: Synthetic polypeptide
  VL of XENP019592

SEQ ID NO: 21418 - protein, 11 aa, Artificial Sequence
  Description of Artificial Sequence: Synthetic peptide
  XENP019592 vlCDR1
RASQSVGNDVA

SEQ ID NO: 21419 - protein, 7 aa, Artificial Sequence
  Description of Artificial Sequence: Synthetic peptide
  XENP019592 vlCDR2
YASHRYT

SEQ ID NO: 21420 - protein, 9 aa, Artificial Sequence
  Description of Artificial Sequence: Synthetic peptide
  XENP019592 vlCDR3
QQDFSSPRT

SEQ ID NO: 21421 - protein, 451 aa, Artificial Sequence
  Description of Artificial Sequence: Synthetic polypeptide
  XENP019593 1G6_H1.283_L1.189_IgG1_PVA_/S267K Heavy Chain
EVQLVESGGGLVKPGGSLRLSCVASGFTFSNYWMNWVRQAPGKGLEWVCEIRLYSNNYATHYAESVKGRFTCSRDDSKSTLYLQMNNLKTEDTGVYYCTRYYGNYGGYFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 21422 - protein, 122 aa, Artificial Sequence; identical to SEQ ID NO: 15620
  Description of Artificial Sequence: Synthetic polypeptide
  VH of XENP019593

SEQ ID NO: 21423 - protein, 5 aa, Artificial Sequence
  Description of Artificial Sequence: Synthetic peptide
  XENP019593 vhCDR1
NYWMN

SEQ ID NO: 21424 - protein, 19 aa, Artificial Sequence
  Description of Artificial Sequence: Synthetic peptide
  XENP019593 vhCDR2
EIRLYSNNYATHYAESVKG

SEQ ID NO: 21425 - protein, 11 aa, Artificial Sequence
  Description of Artificial Sequence: Synthetic peptide
  XENP019593 vhCDR3
YYGNYGGYFDV

SEQ ID NO: 21426 - protein, 214 aa, Artificial Sequence; identical to SEQ ID NO: 21346
  Description of Artificial Sequence: Synthetic polypeptide
  XENP019593 1G6_H1.283_L1.189_IgG1_PVA_/S267K Light Chain

SEQ ID NO: 21427 - protein, 107 aa, Artificial Sequence; identical to SEQ ID NO: 15540
  Description of Artificial Sequence: Synthetic polypeptide
  VL of XENP019593

SEQ ID NO: 21428 - protein, 11 aa, Artificial Sequence
  Description of Artificial Sequence: Synthetic peptide
  XENP019593 vlCDR1
RASQSVGNDVA

SEQ ID NO: 21429 - protein, 7 aa, Artificial Sequence
  Description of Artificial Sequence: Synthetic peptide
  XENP019593 vlCDR2
YASHRYT

SEQ ID NO: 21430 - protein, 9 aa, Artificial Sequence
  Description of Artificial Sequence: Synthetic peptide
  XENP019593 vlCDR3
QQDFSSPRT

SEQ ID NO: 21431 - protein, 451 aa, Artificial Sequence
  Description of Artificial Sequence: Synthetic polypeptide
  XENP019594 1G6_H1.284_L1.189_IgG1_PVA_/S267K Heavy Chain
EVQLVESGGGLVKPGGSLRLSCVASGFTFSNYWMNWVRQAPGKGLEWVCEIRLYSNNYATHYAESVKGRFTCSRDDSKSTLYLQMNNLKTEDTGVYYCTRYYGNYGGYFDVWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 21432 - protein, 122 aa, Artificial Sequence; identical to SEQ ID NO: 15629
  Description of Artificial Sequence: Synthetic polypeptide
  VH of XENP019594

SEQ ID NO: 21433 - protein, 5 aa, Artificial Sequence
  Description of Artificial Sequence: Synthetic peptide
  XENP019594 vhCDR1
NYWMN

SEQ ID NO: 21434 - protein, 19 aa, Artificial Sequence
  Description of Artificial Sequence: Synthetic peptide
  XENP019594 vhCDR2
EIRLYSNNYATHYAESVKG

SEQ ID NO: 21435 - protein, 11 aa, Artificial Sequence
  Description of Artificial Sequence: Synthetic peptide
  XENP019594 vhCDR3
YYGNYGGYFDV

SEQ ID NO: 21436 - protein, 214 aa, Artificial Sequence; identical to SEQ ID NO: 21346
  Description of Artificial Sequence: Synthetic polypeptide
  XENP019594 1G6_H1.284_L1.189_IgG1_PVA_/S267K Light Chain

SEQ ID NO: 21437 - protein, 107 aa, Artificial Sequence; identical to SEQ ID NO: 15540
  Description of Artificial Sequence: Synthetic polypeptide
  VL of XENP019594

SEQ ID NO: 21438 - protein, 11 aa, Artificial Sequence
  Description of Artificial Sequence: Synthetic peptide
  XENP019594 vlCDR1
RASQSVGNDVA

SEQ ID NO: 21439 - protein, 7 aa, Artificial Sequence
  Description of Artificial Sequence: Synthetic peptide
  XENP019594 vlCDR2
YASHRYT

SEQ ID NO: 21440 - protein, 9 aa, Artificial Sequence
  Description of Artificial Sequence: Synthetic peptide
  XENP019594 vlCDR3
QQDFSSPRT

SEQ ID NO: 21441 - protein, 451 aa, Artificial Sequence
  Description of Artificial Sequence: Synthetic polypeptide
  XENP019595 1G6_H1.285_L1.189_IgG1_PVA_/S267K Heavy Chain
EVQLVESGGGLVKPGGSLRLTCVASGFTFSNYWMNWVRQAPGKGLEWVCEIRLYSNNYATHYAESVKGRFTCSRDDSKSMLYLQMNNLKTEDTGVYYCTRYYGNYGGYFDVWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 21442 - protein, 122 aa, Artificial Sequence; identical to SEQ ID NO: 15638
  Description of Artificial Sequence: Synthetic polypeptide
  VH of XENP019595

SEQ ID NO: 21443 - protein, 5 aa, Artificial Sequence
  Description of Artificial Sequence: Synthetic peptide
  XENP019595 vhCDR1
NYWMN

SEQ ID NO: 21444 - protein, 19 aa, Artificial Sequence
  Description of Artificial Sequence: Synthetic peptide
  XENP019595 vhCDR2
EIRLYSNNYATHYAESVKG

SEQ ID NO: 21445 - protein, 11 aa, Artificial Sequence
  Description of Artificial Sequence: Synthetic peptide
  XENP019595 vhCDR3
YYGNYGGYFDV

SEQ ID NO: 21446 - protein, 214 aa, Artificial Sequence; identical to SEQ ID NO: 21346
  Description of Artificial Sequence: Synthetic polypeptide
  XENP019595 1G6_H1.285_L1.189_IgG1_PVA_/S267K Light Chain

SEQ ID NO: 21447 - protein, 107 aa, Artificial Sequence; identical to SEQ ID NO: 15540
  Description of Artificial Sequence: Synthetic polypeptide
  VL of XENP019595

SEQ ID NO: 21448 - protein, 11 aa, Artificial Sequence
  Description of Artificial Sequence: Synthetic peptide
  XENP019595 vlCDR1
RASQSVGNDVA

SEQ ID NO: 21449 - protein, 7 aa, Artificial Sequence
  Description of Artificial Sequence: Synthetic peptide
  XENP019595 vlCDR2
YASHRYT

SEQ ID NO: 21450 - protein, 9 aa, Artificial Sequence
  Description of Artificial Sequence: Synthetic peptide
  XENP019595 vlCDR3
QQDFSSPRT

SEQ ID NO: 21451 - protein, 451 aa, Artificial Sequence
  Description of Artificial Sequence: Synthetic polypeptide
  XENP019596 1G6_H1.286_L1.189_IgG1_PVA_/S267K Heavy Chain
EVQLVESGGGLVKPGGSLRLSCVASGFTFSNYWMNWVRQAPGKGLEWVAEIRLYSDNYATHYAESVKGRFTISRDDSKSTLYLQMNNLKTEDTGVYYCTRYYGNYGGYFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 21452 - protein, 122 aa, Artificial Sequence; identical to SEQ ID NO: 15647
  Description of Artificial Sequence: Synthetic polypeptide
  VH of XENP019596

SEQ ID NO: 21453 - protein, 5 aa, Artificial Sequence
  Description of Artificial Sequence: Synthetic peptide
  XENP019596 vhCDR1
NYWMN

SEQ ID NO: 21454 - protein, 19 aa, Artificial Sequence
  Description of Artificial Sequence: Synthetic peptide
  XENP019596 vhCDR2
EIRLYSDNYATHYAESVKG

SEQ ID NO: 21455 - protein, 11 aa, Artificial Sequence
  Description of Artificial Sequence: Synthetic peptide
  XENP019596 vhCDR3
YYGNYGGYFDV

SEQ ID NO: 21456 - protein, 214 aa, Artificial Sequence; identical to SEQ ID NO: 21346
  Description of Artificial Sequence: Synthetic polypeptide
  XENP019596 1G6_H1.286_L1.189_IgG1_PVA_/S267K Light Chain

SEQ ID NO: 21457 - protein, 107 aa, Artificial Sequence; identical to SEQ ID NO: 15540
  Description of Artificial Sequence: Synthetic polypeptide
  VL of XENP019596

SEQ ID NO: 21458 - protein, 11 aa, Artificial Sequence
  Description of Artificial Sequence: Synthetic peptide
  XENP019596 vlCDR1
RASQSVGNDVA

SEQ ID NO: 21459 - protein, 7 aa, Artificial Sequence
  Description of Artificial Sequence: Synthetic peptide
  XENP019596 vlCDR2
YASHRYT

SEQ ID NO: 21460 - protein, 9 aa, Artificial Sequence
  Description of Artificial Sequence: Synthetic peptide
  XENP019596 vlCDR3
QQDFSSPRT

SEQ ID NO: 21461 - protein, 451 aa, Artificial Sequence; identical to SEQ ID NO: 21351
  Description of Artificial Sequence: Synthetic polypeptide
  XENP019601 1G6_H1.278_L1.192_IgG1_PVA_/S267K Heavy Chain

SEQ ID NO: 21462 - protein, 122 aa, Artificial Sequence; identical to SEQ ID NO: 15521
  Description of Artificial Sequence: Synthetic polypeptide
  VH of XENP019601

SEQ ID NO: 21463 - protein, 5 aa, Artificial Sequence
  Description of Artificial Sequence: Synthetic peptide
  XENP019601 vhCDR1
NYWMN

SEQ ID NO: 21464 - protein, 19 aa, Artificial Sequence
  Description of Artificial Sequence: Synthetic peptide
  XENP019601 vhCDR2
EIRLYSNNYATHYAESVKG

SEQ ID NO: 21465 - protein, 11 aa, Artificial Sequence
  Description of Artificial Sequence: Synthetic peptide
  XENP019601 vhCDR3
YYGNYGGYFDV

SEQ ID NO: 21466 - protein, 214 aa, Artificial Sequence
  Description of Artificial Sequence: Synthetic polypeptide
  XENP019601 1G6_H1.278_L1.192_IgG1_PVA_/S267K Light Chain
EIVLTQSPATLSASPGERVTLTCRASQSVGNDVAWYQQKPGQAPRLLINYASHRYTGVPDRFTGSGYGTEFTLTISSVQSEDFAVYYCQQDFSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 21467 - protein, 107 aa, Artificial Sequence; identical to SEQ ID NO: 15657
  Description of Artificial Sequence: Synthetic polypeptide
  VL of XENP019601

SEQ ID NO: 21468 - protein, 11 aa, Artificial Sequence
  Description of Artificial Sequence: Synthetic peptide
  XENP019601 vlCDR1
RASQSVGNDVA

SEQ ID NO: 21469 - protein, 7 aa, Artificial Sequence
  Description of Artificial Sequence: Synthetic peptide
  XENP019601 vlCDR2
YASHRYT

SEQ ID NO: 21470 - protein, 9 aa, Artificial Sequence
  Description of Artificial Sequence: Synthetic peptide
  XENP019601 vlCDR3
QQDFSSPRT

SEQ ID NO: 21471 - protein, 451 aa, Artificial Sequence; identical to SEQ ID NO: 21351
  Description of Artificial Sequence: Synthetic polypeptide
  XENP019602 1G6_H1.278_L1.193_IgG1_PVA_/S267K Heavy Chain

SEQ ID NO: 21472 - protein, 122 aa, Artificial Sequence; identical to SEQ ID NO: 15521
  Description of Artificial Sequence: Synthetic polypeptide
  VH of XENP019602

SEQ ID NO: 21473 - protein, 5 aa, Artificial Sequence
  Description of Artificial Sequence: Synthetic peptide
  XENP019602 vhCDR1
NYWMN

SEQ ID NO: 21474 - protein, 19 aa, Artificial Sequence
  Description of Artificial Sequence: Synthetic peptide
  XENP019602 vhCDR2
EIRLYSNNYATHYAESVKG

SEQ ID NO: 21475 - protein, 11 aa, Artificial Sequence
  Description of Artificial Sequence: Synthetic peptide
  XENP019602 vhCDR3
YYGNYGGYFDV

SEQ ID NO: 21476 - protein, 214 aa, Artificial Sequence
  Description of Artificial Sequence: Synthetic polypeptide
  XENP019602 1G6_H1.278_L1.193_IgG1_PVA_/S267K Light Chain
EIVLTQSPATLSVSPGERVTLTCRASQSVGNDVAWYQQKPGQAPRLLINYASHRYTGVPDRFTGSGYGTEFTLTISSVQSEDFGVYYCQQDFSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 21477 - protein, 107 aa, Artificial Sequence; identical to SEQ ID NO: 15666
  Description of Artificial Sequence: Synthetic polypeptide
  VL of XENP019602

SEQ ID NO: 21478 - protein, 11 aa, Artificial Sequence
  Description of Artificial Sequence: Synthetic peptide
  XENP019602 vlCDR1
RASQSVGNDVA

SEQ ID NO: 21479 - protein, 7 aa, Artificial Sequence
  Description of Artificial Sequence: Synthetic peptide
  XENP019602 vlCDR2
YASHRYT

SEQ ID NO: 21480 - protein, 9 aa, Artificial Sequence
  Description of Artificial Sequence: Synthetic peptide
  XENP019602 vlCDR3
QQDFSSPRT

SEQ ID NO: 21481 - protein, 451 aa, Artificial Sequence; identical to SEQ ID NO: 21351
  Description of Artificial Sequence: Synthetic polypeptide
  XENP019603 1G6_H1.278_L1.194_IgG1_PVA_/S267K Heavy Chain

SEQ ID NO: 21482 - protein, 122 aa, Artificial Sequence; identical to SEQ ID NO: 15521
  Description of Artificial Sequence: Synthetic polypeptide
  VH of XENP019603

SEQ ID NO: 21483 - protein, 5 aa, Artificial Sequence
  Description of Artificial Sequence: Synthetic peptide
  XENP019603 vhCDR1
NYWMN

SEQ ID NO: 21484 - protein, 19 aa, Artificial Sequence
  Description of Artificial Sequence: Synthetic peptide
  XENP019603 vhCDR2
EIRLYSNNYATHYAESVKG

SEQ ID NO: 21485 - protein, 11 aa, Artificial Sequence
  Description of Artificial Sequence: Synthetic peptide
  XENP019603 vhCDR3
YYGNYGGYFDV

SEQ ID NO: 21486 - protein, 214 aa, Artificial Sequence
  Description of Artificial Sequence: Synthetic polypeptide
  XENP019603 1G6_H1.278_L1.194_IgG1_PVA_/S267K Light Chain
EIVLTQSPATLSASPGERVTLTCRASQSVGNDVAWYQQKPGQAPRLLINYASHRYTGVPDRFTGSGYGTEFTLTISSVQSEDFGVYYCQQDFSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 21487 - protein, 107 aa, Artificial Sequence; identical to SEQ ID NO: 2871
  Description of Artificial Sequence: Synthetic polypeptide
  VL of XENP019603

SEQ ID NO: 21488 - protein, 11 aa, Artificial Sequence
  Description of Artificial Sequence: Synthetic peptide
  XENP019603 vlCDR1
RASQSVGNDVA

SEQ ID NO: 21489 - protein, 7 aa, Artificial Sequence
  Description of Artificial Sequence: Synthetic peptide
  XENP019603 vlCDR2
YASHRYT

SEQ ID NO: 21490 - protein, 9 aa, Artificial Sequence
  Description of Artificial Sequence: Synthetic peptide
  XENP019603 vlCDR3
QQDFSSPRT

SEQ ID NO: 21491 - protein, 451 aa, Artificial Sequence; identical to SEQ ID NO: 21351
  Description of Artificial Sequence: Synthetic polypeptide
  XENP019604 1G6_H1.278_L1.195_IgG1_PVA_/S267K Heavy Chain

SEQ ID NO: 21492 - protein, 122 aa, Artificial Sequence; identical to SEQ ID NO: 15521
  Description of Artificial Sequence: Synthetic polypeptide
  VH of XENP019604

SEQ ID NO: 21493 - protein, 5 aa, Artificial Sequence
  Description of Artificial Sequence: Synthetic peptide
  XENP019604 vhCDR1
NYWMN

SEQ ID NO: 21494 - protein, 19 aa, Artificial Sequence
  Description of Artificial Sequence: Synthetic peptide
  XENP019604 vhCDR2
EIRLYSNNYATHYAESVKG

SEQ ID NO: 21495 - protein, 11 aa, Artificial Sequence
  Description of Artificial Sequence: Synthetic peptide
  XENP019604 vhCDR3
YYGNYGGYFDV

SEQ ID NO: 21496 - protein, 214 aa, Artificial Sequence
  Description of Artificial Sequence: Synthetic polypeptide
  XENP019604 1G6_H1.278_L1.195_IgG1_PVA_/S267K Light Chain
EIVLTQSPATLSVSPGERVTLTCRASQSVGNDVAWYQQKPGQAPRLLCNYASHRYTGVPDRFTCSGYGTEFTLTISSVQSEDFAVYYCQQDFSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 21497 - protein, 107 aa, Artificial Sequence; identical to SEQ ID NO: 15684
  Description of Artificial Sequence: Synthetic polypeptide
  VL of XENP019604

SEQ ID NO: 21498 - protein, 11 aa, Artificial Sequence
  Description of Artificial Sequence: Synthetic peptide
  XENP019604 vlCDR1
RASQSVGNDVA

SEQ ID NO: 21499 - protein, 7 aa, Artificial Sequence
  Description of Artificial Sequence: Synthetic peptide
  XENP019604 vlCDR2
YASHRYT

SEQ ID NO: 21500 - protein, 9 aa, Artificial Sequence
  Description of Artificial Sequence: Synthetic peptide
  XENP019604 vlCDR3
QQDFSSPRT

SEQ ID NO: 21501 - protein, 451 aa, Artificial Sequence; identical to SEQ ID NO: 21351
  Description of Artificial Sequence: Synthetic polypeptide
  XENP019605 1G6_H1.278_L1.196_IgG1_PVA_/S267K Heavy Chain

SEQ ID NO: 21502 - protein, 122 aa, Artificial Sequence; identical to SEQ ID NO: 15521
  Description of Artificial Sequence: Synthetic polypeptide
  VH of XENP019605

SEQ ID NO: 21503 - protein, 5 aa, Artificial Sequence
  Description of Artificial Sequence: Synthetic peptide
  XENP019605 vhCDR1
NYWMN

SEQ ID NO: 21504 - protein, 19 aa, Artificial Sequence
  Description of Artificial Sequence: Synthetic peptide
  XENP019605 vhCDR2
EIRLYSNNYATHYAESVKG

SEQ ID NO: 21505 - protein, 11 aa, Artificial Sequence
  Description of Artificial Sequence: Synthetic peptide
  XENP019605 vhCDR3
YYGNYGGYFDV

SEQ ID NO: 21506 - protein, 214 aa, Artificial Sequence
  Description of Artificial Sequence: Synthetic polypeptide
  XENP019605 1G6_H1.278_L1.196_IgG1_PVA_/S267K Light Chain
EIVLTQSPATLSASPGERVTLTCRASQSVGNDVAWYQQKPGQAPRLLCNYASHRYTGVPDRFTCSGYGTEFTLTISSVQSEDFGVYYCQQDFSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 21507 - protein, 107 aa, Artificial Sequence; identical to SEQ ID NO: 15693
  Description of Artificial Sequence: Synthetic polypeptide
  VL of XENP019605

SEQ ID NO: 21508 - protein, 11 aa, Artificial Sequence
  Description of Artificial Sequence: Synthetic peptide
  XENP019605 vlCDR1
RASQSVGNDVA

SEQ ID NO: 21509 - protein, 7 aa, Artificial Sequence
  Description of Artificial Sequence: Synthetic peptide
  XENP019605 vlCDR2
YASHRYT

SEQ ID NO: 21510 - protein, 9 aa, Artificial Sequence
  Description of Artificial Sequence: Synthetic peptide
  XENP019605 vlCDR3
QQDFSSPRT

SEQ ID NO: 21511 - protein, 451 aa, Artificial Sequence; identical to SEQ ID NO: 21351
  Description of Artificial Sequence: Synthetic polypeptide
  XENP019606 1G6_H1.278_L1.197_IgG1_PVA_/S267K Heavy Chain

SEQ ID NO: 21512 - protein, 122 aa, Artificial Sequence; identical to SEQ ID NO: 15521
  Description of Artificial Sequence: Synthetic polypeptide
  VH of XENP019606

SEQ ID NO: 21513 - protein, 5 aa, Artificial Sequence
  Description of Artificial Sequence: Synthetic peptide
  XENP019606 vhCDR1
NYWMN

SEQ ID NO: 21514 - protein, 19 aa, Artificial Sequence
  Description of Artificial Sequence: Synthetic peptide
  XENP019606 vhCDR2
EIRLYSNNYATHYAESVKG

SEQ ID NO: 21515 - protein, 11 aa, Artificial Sequence
  Description of Artificial Sequence: Synthetic peptide
  XENP019606 vhCDR3
YYGNYGGYFDV

SEQ ID NO: 21516 - protein, 214 aa, Artificial Sequence
  Description of Artificial Sequence: Synthetic polypeptide
  XENP019606 1G6_H1.278_L1.197_IgG1_PVA_/S267K Light Chain
EIVLTQSPATLSASPGERVTLTCRASQSVGNDVAWYQQKPGQAPRLLCNYASHRYTSVPDRFTCSGYGTEFTLTISSVQSEDFGVYYCQQDFSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 21517 - protein, 107 aa, Artificial Sequence; identical to SEQ ID NO: 15702
  Description of Artificial Sequence: Synthetic polypeptide
  VL of XENP019606

SEQ ID NO: 21518 - protein, 11 aa, Artificial Sequence
  Description of Artificial Sequence: Synthetic peptide
  XENP019606 vlCDR1
RASQSVGNDVA

SEQ ID NO: 21519 - protein, 7 aa, Artificial Sequence
  Description of Artificial Sequence: Synthetic peptide
  XENP019606 vlCDR2
YASHRYT

SEQ ID NO: 21520 - protein, 9 aa, Artificial Sequence
  Description of Artificial Sequence: Synthetic peptide
  XENP019606 vlCDR3
QQDFSSPRT

SEQ ID NO: 21521 - protein, 451 aa, Artificial Sequence; identical to SEQ ID NO: 21351
  Description of Artificial Sequence: Synthetic polypeptide
  XENP019607 1G6_H1.278_L1.198_IgG1_PVA_/S267K Heavy Chain

SEQ ID NO: 21522 - protein, 122 aa, Artificial Sequence; identical to SEQ ID NO: 15521
  Description of Artificial Sequence: Synthetic polypeptide
  VH of XENP019607

SEQ ID NO: 21523 - protein, 5 aa, Artificial Sequence
  Description of Artificial Sequence: Synthetic peptide
  XENP019607 vhCDR1
NYWMN

SEQ ID NO: 21524 - protein, 19 aa, Artificial Sequence
  Description of Artificial Sequence: Synthetic peptide
  XENP019607 vhCDR2
EIRLYSNNYATHYAESVKG

SEQ ID NO: 21525 - protein, 11 aa, Artificial Sequence
  Description of Artificial Sequence: Synthetic peptide
  XENP019607 vhCDR3
YYGNYGGYFDV

SEQ ID NO: 21526 - protein, 214 aa, Artificial Sequence
  Description of Artificial Sequence: Synthetic polypeptide
  XENP019607 1G6_H1.278_L1.198_IgG1_PVA_/S267K Light Chain
EIVLTQSPSTLSVSPGERVTLTCRASQSVGNDVAWYQQKPGQAPRLLINYASHRYTGVPDRFTGSGYGTEFTLTISSVQSEDFAVYYCQQDFSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 21527 - protein, 107 aa, Artificial Sequence; identical to SEQ ID NO: 15711
  Description of Artificial Sequence: Synthetic polypeptide
  VL of XENP019607

SEQ ID NO: 21528 - protein, 11 aa, Artificial Sequence
  Description of Artificial Sequence: Synthetic peptide
  XENP019607 vlCDR1
RASQSVGNDVA

SEQ ID NO: 21529 - protein, 7 aa, Artificial Sequence
  Description of Artificial Sequence: Synthetic peptide
  XENP019607 vlCDR2
YASHRYT

SEQ ID NO: 21530 - protein, 9 aa, Artificial Sequence
  Description of Artificial Sequence: Synthetic peptide
  XENP019607 vlCDR3
QQDFSSPRT

SEQ ID NO: 21531 - protein, 451 aa, Artificial Sequence; identical to SEQ ID NO: 21351
  Description of Artificial Sequence: Synthetic polypeptide
  XENP019608 1G6_H1.278_L1.199_IgG1_PVA_/S267K Heavy Chain

SEQ ID NO: 21532 - protein, 122 aa, Artificial Sequence; identical to SEQ ID NO: 15521
  Description of Artificial Sequence: Synthetic polypeptide
  VH of XENP019608

SEQ ID NO: 21533 - protein, 5 aa, Artificial Sequence
  Description of Artificial Sequence: Synthetic peptide
  XENP019608 vhCDR1
NYWMN

SEQ ID NO: 21534 - protein, 19 aa, Artificial Sequence
  Description of Artificial Sequence: Synthetic peptide
  XENP019608 vhCDR2
EIRLYSNNYATHYAESVKG

SEQ ID NO: 21535 - protein, 11 aa, Artificial Sequence
  Description of Artificial Sequence: Synthetic peptide
  XENP019608 vhCDR3
YYGNYGGYFDV

SEQ ID NO: 21536 - protein, 214 aa, Artificial Sequence
  Description of Artificial Sequence: Synthetic polypeptide
  XENP019608 1G6_H1.278_L1.199_IgG1_PVA_/S267K Light Chain
EIVLTQSPDTLSVSPGERVTLTCRASQSVGNDVAWYQQKPGQAPRLLINYASHRYTGVPDRFTGSGYGTEFTLTISSVQSEDFAVYYCQQDFSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 21537 - protein, 107 aa, Artificial Sequence; identical to SEQ ID NO: 15720
  Description of Artificial Sequence: Synthetic polypeptide
  VL of XENP019608

SEQ ID NO: 21538 - protein, 11 aa, Artificial Sequence
  Description of Artificial Sequence: Synthetic peptide
  XENP019608 vlCDR1
RASQSVGNDVA

SEQ ID NO: 21539 - protein, 7 aa, Artificial Sequence
  Description of Artificial Sequence: Synthetic peptide
  XENP019608 vlCDR2
YASHRYT

SEQ ID NO: 21540 - protein, 9 aa, Artificial Sequence
  Description of Artificial Sequence: Synthetic peptide
  XENP019608 vlCDR3
QQDFSSPRT

SEQ ID NO: 21541 - protein, 451 aa, Artificial Sequence; identical to SEQ ID NO: 21351
  Description of Artificial Sequence: Synthetic polypeptide
  XENP019609 1G6_H1.278_L1.200_IgG1_PVA_/S267K Heavy Chain

SEQ ID NO: 21542 - protein, 122 aa, Artificial Sequence; identical to SEQ ID NO: 15521
  Description of Artificial Sequence: Synthetic polypeptide
  VH of XENP019609

SEQ ID NO: 21543 - protein, 5 aa, Artificial Sequence
  Description of Artificial Sequence: Synthetic peptide
  XENP019609 vhCDR1
NYWMN

SEQ ID NO: 21544 - protein, 19 aa, Artificial Sequence
  Description of Artificial Sequence: Synthetic peptide
  XENP019609 vhCDR2
EIRLYSNNYATHYAESVKG

SEQ ID NO: 21545 - protein, 11 aa, Artificial Sequence
  Description of Artificial Sequence: Synthetic peptide
  XENP019609 vhCDR3
YYGNYGGYFDV

SEQ ID NO: 21546 - protein, 214 aa, Artificial Sequence
  Description of Artificial Sequence: Synthetic polypeptide
  XENP019609 1G6_H1.278_L1.200_IgG1_PVA_/S267K Light Chain
EIVLTQSPATLAVSPGERVTLTCRASQSVGNDVAWYQQKPGQAPRLLINYASHRYTGVPDRFTGSGYGTEFTLTISSVQSEDFAVYYCQQDFSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 21547 - protein, 107 aa, Artificial Sequence; identical to SEQ ID NO: 15729
  Description of Artificial Sequence: Synthetic polypeptide
  VL of XENP019609

SEQ ID NO: 21548 - protein, 11 aa, Artificial Sequence
  Description of Artificial Sequence: Synthetic peptide
  XENP019609 vlCDR1
RASQSVGNDVA

SEQ ID NO: 21549 - protein, 7 aa, Artificial Sequence
  Description of Artificial Sequence: Synthetic peptide
  XENP019609 vlCDR2
YASHRYT

SEQ ID NO: 21550 - protein, 9 aa, Artificial Sequence
  Description of Artificial Sequence: Synthetic peptide
  XENP019609 vlCDR3
QQDFSSPRT

SEQ ID NO: 21551 - protein, 451 aa, Artificial Sequence; identical to SEQ ID NO: 21351
  Description of Artificial Sequence: Synthetic polypeptide
  XENP019610 1G6_H1.278_L1.201_IgG1_PVA_/S267K Heavy Chain

SEQ ID NO: 21552 - protein, 122 aa, Artificial Sequence; identical to SEQ ID NO: 15521
  Description of Artificial Sequence: Synthetic polypeptide
  VH of XENP019610

SEQ ID NO: 21553 - protein, 5 aa, Artificial Sequence
  Description of Artificial Sequence: Synthetic peptide
  XENP019610 vhCDR1
NYWMN

SEQ ID NO: 21554 - protein, 19 aa, Artificial Sequence
  Description of Artificial Sequence: Synthetic peptide
  XENP019610 vhCDR2
EIRLYSNNYATHYAESVKG

SEQ ID NO: 21555 - protein, 11 aa, Artificial Sequence
  Description of Artificial Sequence: Synthetic peptide
  XENP019610 vhCDR3
YYGNYGGYFDV

SEQ ID NO: 21556 - protein, 214 aa, Artificial Sequence; identical to SEQ ID NO: 21466
  Description of Artificial Sequence: Synthetic polypeptide
  XENP019610 1G6_H1.278_L1.201_IgG1_PVA_/S267K Light Chain

SEQ ID NO: 21557 - protein, 107 aa, Artificial Sequence; identical to SEQ ID NO: 15657
  Description of Artificial Sequence: Synthetic polypeptide
  VL of XENP019610

SEQ ID NO: 21558 - protein, 11 aa, Artificial Sequence
  Description of Artificial Sequence: Synthetic peptide
  XENP019610 vlCDR1
RASQSVGNDVA

SEQ ID NO: 21559 - protein, 7 aa, Artificial Sequence
  Description of Artificial Sequence: Synthetic peptide
  XENP019610 vlCDR2
YASHRYT

SEQ ID NO: 21560 - protein, 9 aa, Artificial Sequence
  Description of Artificial Sequence: Synthetic peptide
  XENP019610 vlCDR3
QQDFSSPRT

SEQ ID NO: 21561 - protein, 451 aa, Artificial Sequence; identical to SEQ ID NO: 21351
  Description of Artificial Sequence: Synthetic polypeptide
  XENP019611 1G6_H1.278_L1.202_IgG1_PVA_/S267K Heavy Chain

SEQ ID NO: 21562 - protein, 122 aa, Artificial Sequence; identical to SEQ ID NO: 15521
  Description of Artificial Sequence: Synthetic polypeptide
  VH of XENP019611

SEQ ID NO: 21563 - protein, 5 aa, Artificial Sequence
  Description of Artificial Sequence: Synthetic peptide
  XENP019611 vhCDR1
NYWMN

SEQ ID NO: 21564 - protein, 19 aa, Artificial Sequence
  Description of Artificial Sequence: Synthetic peptide
  XENP019611 vhCDR2
EIRLYSNNYATHYAESVKG

SEQ ID NO: 21565 - protein, 11 aa, Artificial Sequence
  Description of Artificial Sequence: Synthetic peptide
  XENP019611 vhCDR3
YYGNYGGYFDV

SEQ ID NO: 21566 - protein, 214 aa, Artificial Sequence
  Description of Artificial Sequence: Synthetic polypeptide
  XENP019611 1G6_H1.278_L1.202_IgG1_PVA_/S267K Light Chain
EIVLTQSPATLSVSVGERVTLTCRASQSVGNDVAWYQQKPGQAPRLLINYASHRYTGVPDRFTGSGYGTEFTLTISSVQSEDFAVYYCQQDFSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 21567 - protein, 107 aa, Artificial Sequence; identical to SEQ ID NO: 15747
  Description of Artificial Sequence: Synthetic polypeptide
  VL of XENP019611

SEQ ID NO: 21568 - protein, 11 aa, Artificial Sequence
  Description of Artificial Sequence: Synthetic peptide
  XENP019611 vlCDR1
RASQSVGNDVA

SEQ ID NO: 21569 - protein, 7 aa, Artificial Sequence
  Description of Artificial Sequence: Synthetic peptide
  XENP019611 vlCDR2
YASHRYT

SEQ ID NO: 21570 - protein, 9 aa, Artificial Sequence
  Description of Artificial Sequence: Synthetic peptide
  XENP019611 vlCDR3
QQDFSSPRT

SEQ ID NO: 21571 - protein, 451 aa, Artificial Sequence; identical to SEQ ID NO: 21351
  Description of Artificial Sequence: Synthetic polypeptide
  XENP019612 1G6_H1.278_L1.203_IgG1_PVA_/S267K Heavy Chain

SEQ ID NO: 21572 - protein, 122 aa, Artificial Sequence; identical to SEQ ID NO: 15521
  Description of Artificial Sequence: Synthetic polypeptide
  VH of XENP019612

SEQ ID NO: 21573 - protein, 5 aa, Artificial Sequence
  Description of Artificial Sequence: Synthetic peptide
  XENP019612 vhCDR1
NYWMN

SEQ ID NO: 21574 - protein, 19 aa, Artificial Sequence
  Description of Artificial Sequence: Synthetic peptide
  XENP019612 vhCDR2
EIRLYSNNYATHYAESVKG

SEQ ID NO: 21575 - protein, 11 aa, Artificial Sequence
  Description of Artificial Sequence: Synthetic peptide
  XENP019612 vhCDR3
YYGNYGGYFDV

SEQ ID NO: 21576 - protein, 214 aa, Artificial Sequence
  Description of Artificial Sequence: Synthetic polypeptide
  XENP019612 1G6_H1.278_L1.203_IgG1_PVA_/S267K Light Chain
EIVLTQSPATLSVSLGERVTLTCRASQSVGNDVAWYQQKPGQAPRLLINYASHRYTGVPDRFTGSGYGTEFTLTISSVQSEDFAVYYCQQDFSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 21577 - protein, 107 aa, Artificial Sequence; identical to SEQ ID NO: 15756
  Description of Artificial Sequence: Synthetic polypeptide
  VL of XENP019612

SEQ ID NO: 21578 - protein, 11 aa, Artificial Sequence
  Description of Artificial Sequence: Synthetic peptide
  XENP019612 vlCDR1
RASQSVGNDVA

SEQ ID NO: 21579 - protein, 7 aa, Artificial Sequence
  Description of Artificial Sequence: Synthetic peptide
  XENP019612 vlCDR2
YASHRYT

SEQ ID NO: 21580 - protein, 9 aa, Artificial Sequence
  Description of Artificial Sequence: Synthetic peptide
  XENP019612 vlCDR3
QQDFSSPRT

SEQ ID NO: 21581 - protein, 451 aa, Artificial Sequence; identical to SEQ ID NO: 21351
  Description of Artificial Sequence: Synthetic polypeptide
  XENP019613 1G6_H1.278_L1.204_IgG1_PVA_/S267K Heavy Chain

SEQ ID NO: 21582 - protein, 122 aa, Artificial Sequence; identical to SEQ ID NO: 15521
  Description of Artificial Sequence: Synthetic polypeptide
  VH of XENP019613

SEQ ID NO: 21583 - protein, 5 aa, Artificial Sequence
  Description of Artificial Sequence: Synthetic peptide
  XENP019613 vhCDR1
NYWMN

SEQ ID NO: 21584 - protein, 19 aa, Artificial Sequence
  Description of Artificial Sequence: Synthetic peptide
  XENP019613 vhCDR2
EIRLYSNNYATHYAESVKG

SEQ ID NO: 21585 - protein, 11 aa, Artificial Sequence
  Description of Artificial Sequence: Synthetic peptide
  XENP019613 vhCDR3
YYGNYGGYFDV

SEQ ID NO: 21586 - protein, 214 aa, Artificial Sequence
  Description of Artificial Sequence: Synthetic polypeptide
  XENP019613 1G6_H1.278_L1.204_IgG1_PVA_/S267K Light Chain
EIVLTQSPATLSVSPGERVTLNCRASQSVGNDVAWYQQKPGQAPRLLINYASHRYTGVPDRFTGSGYGTEFTLTISSVQSEDFAVYYCQQDFSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 21587 - protein, 107 aa, Artificial Sequence; identical to SEQ ID NO: 15765
  Description of Artificial Sequence: Synthetic polypeptide
  VL of XENP019613

SEQ ID NO: 21588 - protein, 11 aa, Artificial Sequence
  Description of Artificial Sequence: Synthetic peptide
  XENP019613 vlCDR1
RASQSVGNDVA

SEQ ID NO: 21589 - protein, 7 aa, Artificial Sequence
  Description of Artificial Sequence: Synthetic peptide
  XENP019613 vlCDR2
YASHRYT

SEQ ID NO: 21590 - protein, 9 aa, Artificial Sequence
  Description of Artificial Sequence: Synthetic peptide
  XENP019613 vlCDR3
QQDFSSPRT

SEQ ID NO: 21591 - protein, 451 aa, Artificial Sequence; identical to SEQ ID NO: 21351
  Description of Artificial Sequence: Synthetic polypeptide
  XENP019614 1G6_H1.278_L1.205_IgG1_PVA_/S267K Heavy Chain

SEQ ID NO: 21592 - protein, 122 aa, Artificial Sequence; identical to SEQ ID NO: 15521
  Description of Artificial Sequence: Synthetic polypeptide
  VH of XENP019614

SEQ ID NO: 21593 - protein, 5 aa, Artificial Sequence
  Description of Artificial Sequence: Synthetic peptide
  XENP019614 vhCDR1
NYWMN

SEQ ID NO: 21594 - protein, 19 aa, Artificial Sequence
  Description of Artificial Sequence: Synthetic peptide
  XENP019614 vhCDR2
EIRLYSNNYATHYAESVKG

SEQ ID NO: 21595 - protein, 11 aa, Artificial Sequence
  Description of Artificial Sequence: Synthetic peptide
  XENP019614 vhCDR3
YYGNYGGYFDV

SEQ ID NO: 21596 - protein, 214 aa, Artificial Sequence
  Description of Artificial Sequence: Synthetic polypeptide
  XENP019614 1G6_H1.278_L1.205_IgG1_PVA_/S267K Light Chain
EIVLTQSPATLSVSPGERVTLTCRASQSVGNDVAWYQQKPGKAPRLLINYASHRYTGVPDRFTGSGYGTEFTLTISSVQSEDFAVYYCQQDFSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 21597 - protein, 107 aa, Artificial Sequence; identical to SEQ ID NO: 15774
  Description of Artificial Sequence: Synthetic polypeptide
  VL of XENP019614

SEQ ID NO: 21598 - protein, 11 aa, Artificial Sequence
  Description of Artificial Sequence: Synthetic peptide
  XENP019614 vlCDR1
RASQSVGNDVA

SEQ ID NO: 21599 - protein, 7 aa, Artificial Sequence
  Description of Artificial Sequence: Synthetic peptide
  XENP019614 vlCDR2
YASHRYT

SEQ ID NO: 21600 - protein, 9 aa, Artificial Sequence
  Description of Artificial Sequence: Synthetic peptide
  XENP019614 vlCDR3
QQDFSSPRT

SEQ ID NO: 21601 - protein, 451 aa, Artificial Sequence; identical to SEQ ID NO: 21351
  Description of Artificial Sequence: Synthetic polypeptide
  XENP019615 1G6_H1.278_L1.206_IgG1_PVA_/S267K Heavy Chain

SEQ ID NO: 21602 - protein, 122 aa, Artificial Sequence; identical to SEQ ID NO: 15521
  Description of Artificial Sequence: Synthetic polypeptide
  VH of XENP019615

SEQ ID NO: 21603 - protein, 5 aa, Artificial Sequence
  Description of Artificial Sequence: Synthetic peptide
  XENP019615 vhCDR1
NYWMN

SEQ ID NO: 21604 - protein, 19 aa, Artificial Sequence
  Description of Artificial Sequence: Synthetic peptide
  XENP019615 vhCDR2
EIRLYSNNYATHYAESVKG

SEQ ID NO: 21605 - protein, 11 aa, Artificial Sequence
  Description of Artificial Sequence: Synthetic peptide
  XENP019615 vhCDR3
YYGNYGGYFDV

SEQ ID NO: 21606 - protein, 214 aa, Artificial Sequence
  Description of Artificial Sequence: Synthetic polypeptide
  XENP019615 1G6_H1.278_L1.206_IgG1_PVA_/S267K Light Chain
EIVLTQSPATLSVSPGERVTLTCRASQSVGNDVAWYQQKPGQAPRLLINYASHRYTGVPDRFTGSGYGTEFTLTISSVQPEDFAVYYCQQDFSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 21607 - protein, 107 aa, Artificial Sequence; identical to SEQ ID NO: 15783
  Description of Artificial Sequence: Synthetic polypeptide
  VL of XENP019615

SEQ ID NO: 21608 - protein, 11 aa, Artificial Sequence
  Description of Artificial Sequence: Synthetic peptide
  XENP019615 vlCDR1
RASQSVGNDVA

SEQ ID NO: 21609 - protein, 7 aa, Artificial Sequence
  Description of Artificial Sequence: Synthetic peptide
  XENP019615 vlCDR2
YASHRYT

SEQ ID NO: 21610 - protein, 9 aa, Artificial Sequence
  Description of Artificial Sequence: Synthetic peptide
  XENP019615 vlCDR3
QQDFSSPRT

SEQ ID NO: 21611 - protein, 451 aa, Artificial Sequence; identical to SEQ ID NO: 21351
  Description of Artificial Sequence: Synthetic polypeptide
  XENP019616 1G6_H1.278_L1.207_IgG1_PVA_/S267K Heavy Chain

SEQ ID NO: 21612 - protein, 122 aa, Artificial Sequence; identical to SEQ ID NO: 15521
  Description of Artificial Sequence: Synthetic polypeptide
  VH of XENP019616

SEQ ID NO: 21613 - protein, 5 aa, Artificial Sequence
  Description of Artificial Sequence: Synthetic peptide
  XENP019616 vhCDR1
NYWMN

SEQ ID NO: 21614 - protein, 19 aa, Artificial Sequence
  Description of Artificial Sequence: Synthetic peptide
  XENP019616 vhCDR2
EIRLYSNNYATHYAESVKG

SEQ ID NO: 21615 - protein, 11 aa, Artificial Sequence
  Description of Artificial Sequence: Synthetic peptide
  XENP019616 vhCDR3
YYGNYGGYFDV

SEQ ID NO: 21616 - protein, 214 aa, Artificial Sequence
  Description of Artificial Sequence: Synthetic polypeptide
  XENP019616 1G6_H1.278_L1.207_IgG1_PVA_/S267K Light Chain
EIVLTQSPATLSVSPGERVTLTCRASQSVGNDVAWYQQKPGQAPRLLINYASHRYTGVPDRFTGSGYGTEFTLTISSVQSEDVAVYYCQQDFSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 21617 - protein, 107 aa, Artificial Sequence; identical to SEQ ID NO: 15792
  Description of Artificial Sequence: Synthetic polypeptide
  VL of XENP019616

SEQ ID NO: 21618 - protein, 11 aa, Artificial Sequence
  Description of Artificial Sequence: Synthetic peptide
  XENP019616 vlCDR1
RASQSVGNDVA

SEQ ID NO: 21619 - protein, 7 aa, Artificial Sequence
  Description of Artificial Sequence: Synthetic peptide
  XENP019616 vlCDR2
YASHRYT

SEQ ID NO: 21620 - protein, 9 aa, Artificial Sequence
  Description of Artificial Sequence: Synthetic peptide
  XENP019616 vlCDR3
QQDFSSPRT

SEQ ID NO: 21621 - protein, 451 aa, Artificial Sequence; identical to SEQ ID NO: 21351
  Description of Artificial Sequence: Synthetic polypeptide
  XENP019617 1G6_H1.278_L1.208_IgG1_PVA_/S267K Heavy Chain

SEQ ID NO: 21622 - protein, 122 aa, Artificial Sequence; identical to SEQ ID NO: 15521
  Description of Artificial Sequence: Synthetic polypeptide
  VH of XENP019617

SEQ ID NO: 21623 - protein, 5 aa, Artificial Sequence
  Description of Artificial Sequence: Synthetic peptide
  XENP019617 vhCDR1
NYWMN

SEQ ID NO: 21624 - protein, 19 aa, Artificial Sequence
  Description of Artificial Sequence: Synthetic peptide
  XENP019617 vhCDR2
EIRLYSNNYATHYAESVKG

SEQ ID NO: 21625 - protein, 11 aa, Artificial Sequence
  Description of Artificial Sequence: Synthetic peptide
  XENP019617 vhCDR3
YYGNYGGYFDV

SEQ ID NO: 21626 - protein, 214 aa, Artificial Sequence
  Description of Artificial Sequence: Synthetic polypeptide
  XENP019617 1G6_H1.278_L1.208_IgG1_PVA_/S267K Light Chain
EIVLTQSPATLSVSPGERVTLTCRASQSVGNDVAWYQQKPGQAPRLLINYASHRYTGVPDRFTGSGYGTEFTLTISSVQSEDFATYYCQQDFSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 21627 - protein, 107 aa, Artificial Sequence; identical to SEQ ID NO: 15801
  Description of Artificial Sequence: Synthetic polypeptide
  VL of XENP019617

SEQ ID NO: 21628 - protein, 11 aa, Artificial Sequence
  Description of Artificial Sequence: Synthetic peptide
  XENP019617 vlCDR1
RASQSVGNDVA

SEQ ID NO: 21629 - protein, 7 aa, Artificial Sequence
  Description of Artificial Sequence: Synthetic peptide
  XENP019617 vlCDR2
YASHRYT

SEQ ID NO: 21630 - protein, 9 aa, Artificial Sequence
  Description of Artificial Sequence: Synthetic peptide
  XENP019617 vlCDR3
QQDFSSPRT

SEQ ID NO: 21631 - protein, 451 aa, Artificial Sequence; identical to SEQ ID NO: 21381
  Description of Artificial Sequence: Synthetic polypeptide
  XENP019678 1G6_H1.279_L1.192_IgG1_PVA_/S267K Heavy Chain

SEQ ID NO: 21632 - protein, 122 aa, Artificial Sequence; identical to SEQ ID NO: 2872
  Description of Artificial Sequence: Synthetic polypeptide
  VH of XENP019678

SEQ ID NO: 21633 - protein, 5 aa, Artificial Sequence
  Description of Artificial Sequence: Synthetic peptide
  XENP019678 vhCDR1
NYWMN

SEQ ID NO: 21634 - protein, 19 aa, Artificial Sequence
  Description of Artificial Sequence: Synthetic peptide
  XENP019678 vhCDR2
EIRLYSNNYATHYAESVKG

SEQ ID NO: 21635 - protein, 11 aa, Artificial Sequence
  Description of Artificial Sequence: Synthetic peptide
  XENP019678 vhCDR3
YYGNYGGYFDV

SEQ ID NO: 21636 - protein, 214 aa, Artificial Sequence; identical to SEQ ID NO: 21466
  Description of Artificial Sequence: Synthetic polypeptide
  XENP019678 1G6_H1.279_L1.192_IgG1_PVA_/S267K Light Chain

SEQ ID NO: 21637 - protein, 107 aa, Artificial Sequence; identical to SEQ ID NO: 15657
  Description of Artificial Sequence: Synthetic polypeptide
  VL of XENP019678

SEQ ID NO: 21638 - protein, 11 aa, Artificial Sequence
  Description of Artificial Sequence: Synthetic peptide
  XENP019678 vlCDR1
RASQSVGNDVA

SEQ ID NO: 21639 - protein, 7 aa, Artificial Sequence
  Description of Artificial Sequence: Synthetic peptide
  XENP019678 vlCDR2
YASHRYT

SEQ ID NO: 21640 - protein, 9 aa, Artificial Sequence
  Description of Artificial Sequence: Synthetic peptide
  XENP019678 vlCDR3
QQDFSSPRT

SEQ ID NO: 21641 - protein, 451 aa, Artificial Sequence; identical to SEQ ID NO: 21391
  Description of Artificial Sequence: Synthetic polypeptide
  XENP019679 1G6_H1.280_L1.192_IgG1_PVA_/S267K Heavy Chain

SEQ ID NO: 21642 - protein, 122 aa, Artificial Sequence; identical to SEQ ID NO: 15593
  Description of Artificial Sequence: Synthetic polypeptide
  VH of XENP019679

SEQ ID NO: 21643 - protein, 5 aa, Artificial Sequence
  Description of Artificial Sequence: Synthetic peptide
  XENP019679 vhCDR1
NYWMN

SEQ ID NO: 21644 - protein, 19 aa, Artificial Sequence
  Description of Artificial Sequence: Synthetic peptide
  XENP019679 vhCDR2
EIRLYSNNYATHYAESVKG

SEQ ID NO: 21645 - protein, 11 aa, Artificial Sequence
  Description of Artificial Sequence: Synthetic peptide
  XENP019679 vhCDR3
YYGNYGGYFDV

SEQ ID NO: 21646 - protein, 214 aa, Artificial Sequence; identical to SEQ ID NO: 21466
  Description of Artificial Sequence: Synthetic polypeptide
  XENP019679 1G6_H1.280_L1.192_IgG1_PVA_/S267K Light Chain

SEQ ID NO: 21647 - protein, 107 aa, Artificial Sequence; identical to SEQ ID NO: 15657
  Description of Artificial Sequence: Synthetic polypeptide
  VL of XENP019679

SEQ ID NO: 21648 - protein, 11 aa, Artificial Sequence
  Description of Artificial Sequence: Synthetic peptide
  XENP019679 vlCDR1
RASQSVGNDVA

SEQ ID NO: 21649 - protein, 7 aa, Artificial Sequence
  Description of Artificial Sequence: Synthetic peptide
  XENP019679 vlCDR2
YASHRYT

SEQ ID NO: 21650 - protein, 9 aa, Artificial Sequence
  Description of Artificial Sequence: Synthetic peptide
  XENP019679 vlCDR3
QQDFSSPRT

SEQ ID NO: 21651 - protein, 451 aa, Artificial Sequence; identical to SEQ ID NO: 21401
  Description of Artificial Sequence: Synthetic polypeptide
  XENP019680 1G6_H1.281_L1.192_IgG1_PVA_/S267K Heavy Chain

SEQ ID NO: 21652 - protein, 122 aa, Artificial Sequence; identical to SEQ ID NO: 15602
  Description of Artificial Sequence: Synthetic polypeptide
  VH of XENP019680

SEQ ID NO: 21653 - protein, 5 aa, Artificial Sequence
  Description of Artificial Sequence: Synthetic peptide
  XENP019680 vhCDR1
NYWMN

SEQ ID NO: 21654 - protein, 19 aa, Artificial Sequence
  Description of Artificial Sequence: Synthetic peptide
  XENP019680 vhCDR2
EIRLYSNNYATHYAESVKG

SEQ ID NO: 21655 - protein, 11 aa, Artificial Sequence
  Description of Artificial Sequence: Synthetic peptide
  XENP019680 vhCDR3
YYGNYGGYFDV

SEQ ID NO: 21656 - protein, 214 aa, Artificial Sequence; identical to SEQ ID NO: 21466
  Description of Artificial Sequence: Synthetic polypeptide
  XENP019680 1G6_H1.281_L1.192_IgG1_PVA_/S267K Light Chain

SEQ ID NO: 21657 - protein, 107 aa, Artificial Sequence; identical to SEQ ID NO: 15657
  Description of Artificial Sequence: Synthetic polypeptide
  VL of XENP019680

SEQ ID NO: 21658 - protein, 11 aa, Artificial Sequence
  Description of Artificial Sequence: Synthetic peptide
  XENP019680 vlCDR1
RASQSVGNDVA

SEQ ID NO: 21659 - protein, 7 aa, Artificial Sequence
  Description of Artificial Sequence: Synthetic peptide
  XENP019680 vlCDR2
YASHRYT

SEQ ID NO: 21660 - protein, 9 aa, Artificial Sequence
  Description of Artificial Sequence: Synthetic peptide
  XENP019680 vlCDR3
QQDFSSPRT

SEQ ID NO: 21661 - protein, 451 aa, Artificial Sequence; identical to SEQ ID NO: 21411
  Description of Artificial Sequence: Synthetic polypeptide
  XENP019681 1G6_H1.282_L1.192_IgG1_PVA_/S267K Heavy Chain

SEQ ID NO: 21662 - protein, 122 aa, Artificial Sequence; identical to SEQ ID NO: 15611
  Description of Artificial Sequence: Synthetic polypeptide
  VH of XENP019681

SEQ ID NO: 21663 - protein, 5 aa, Artificial Sequence
  Description of Artificial Sequence: Synthetic peptide
  XENP019681 vhCDR1
NYWMN

SEQ ID NO: 21664 - protein, 19 aa, Artificial Sequence
  Description of Artificial Sequence: Synthetic peptide
  XENP019681 vhCDR2
EIRLYSNNYATHYAESVKG

SEQ ID NO: 21665 - protein, 11 aa, Artificial Sequence
  Description of Artificial Sequence: Synthetic peptide
  XENP019681 vhCDR3
YYGNYGGYFDV

SEQ ID NO: 21666 - protein, 214 aa, Artificial Sequence; identical to SEQ ID NO: 21466
  Description of Artificial Sequence: Synthetic polypeptide
  XENP019681 1G6_H1.282_L1.192_IgG1_PVA_/S267K Light Chain

SEQ ID NO: 21667 - protein, 107 aa, Artificial Sequence; identical to SEQ ID NO: 15657
  Description of Artificial Sequence: Synthetic polypeptide
  VL of XENP019681

SEQ ID NO: 21668 - protein, 11 aa, Artificial Sequence
  Description of Artificial Sequence: Synthetic peptide
  XENP019681 vlCDR1
RASQSVGNDVA

SEQ ID NO: 21669 - protein, 7 aa, Artificial Sequence
  Description of Artificial Sequence: Synthetic peptide
  XENP019681 vlCDR2
YASHRYT

SEQ ID NO: 21670 - protein, 9 aa, Artificial Sequence
  Description of Artificial Sequence: Synthetic peptide
  XENP019681 vlCDR3
QQDFSSPRT

SEQ ID NO: 21671 - protein, 451 aa, Artificial Sequence; identical to SEQ ID NO: 21381
  Description of Artificial Sequence: Synthetic polypeptide
  XENP019682 1G6_H1.279_L1.193_IgG1_PVA_/S267K Heavy Chain

SEQ ID NO: 21672 - protein, 122 aa, Artificial Sequence; identical to SEQ ID NO: 2872
  Description of Artificial Sequence: Synthetic polypeptide
  VH of XENP019682

SEQ ID NO: 21673 - protein, 5 aa, Artificial Sequence
  Description of Artificial Sequence: Synthetic peptide
  XENP019682 vhCDR1
NYWMN

SEQ ID NO: 21674 - protein, 19 aa, Artificial Sequence
  Description of Artificial Sequence: Synthetic peptide
  XENP019682 vhCDR2
EIRLYSNNYATHYAESVKG

SEQ ID NO: 21675 - protein, 11 aa, Artificial Sequence
  Description of Artificial Sequence: Synthetic peptide
  XENP019682 vhCDR3
YYGNYGGYFDV

SEQ ID NO: 21676 - protein, 214 aa, Artificial Sequence; identical to SEQ ID NO: 21476
  Description of Artificial Sequence: Synthetic polypeptide
  XENP019682 1G6_H1.279_L1.193_IgG1_PVA_/S267K Light Chain

SEQ ID NO: 21677 - protein, 107 aa, Artificial Sequence; identical to SEQ ID NO: 15666
  Description of Artificial Sequence: Synthetic polypeptide
  VL of XENP019682

SEQ ID NO: 21678 - protein, 11 aa, Artificial Sequence
  Description of Artificial Sequence: Synthetic peptide
  XENP019682 vlCDR1
RASQSVGNDVA

SEQ ID NO: 21679 - protein, 7 aa, Artificial Sequence
  Description of Artificial Sequence: Synthetic peptide
  XENP019682 vlCDR2
YASHRYT

SEQ ID NO: 21680 - protein, 9 aa, Artificial Sequence
  Description of Artificial Sequence: Synthetic peptide
  XENP019682 vlCDR3
QQDFSSPRT

SEQ ID NO: 21681 - protein, 451 aa, Artificial Sequence; identical to SEQ ID NO: 21391
  Description of Artificial Sequence: Synthetic polypeptide
  XENP019683 1G6_H1.280_L1.193_IgG1_PVA_/S267K Heavy Chain

SEQ ID NO: 21682 - protein, 122 aa, Artificial Sequence; identical to SEQ ID NO: 15593
  Description of Artificial Sequence: Synthetic polypeptide
  VH of XENP019683

SEQ ID NO: 21683 - protein, 5 aa, Artificial Sequence
  Description of Artificial Sequence: Synthetic peptide
  XENP019683 vhCDR1
NYWMN

SEQ ID NO: 21684 - protein, 19 aa, Artificial Sequence
  Description of Artificial Sequence: Synthetic peptide
  XENP019683 vhCDR2
EIRLYSNNYATHYAESVKG

SEQ ID NO: 21685 - protein, 11 aa, Artificial Sequence
  Description of Artificial Sequence: Synthetic peptide
  XENP019683 vhCDR3
YYGNYGGYFDV

SEQ ID NO: 21686 - protein, 214 aa, Artificial Sequence; identical to SEQ ID NO: 21476
  Description of Artificial Sequence: Synthetic polypeptide
  XENP019683 1G6_H1.280_L1.193_IgG1_PVA_/S267K Light Chain

SEQ ID NO: 21687 - protein, 107 aa, Artificial Sequence; identical to SEQ ID NO: 15666
  Description of Artificial Sequence: Synthetic polypeptide
  VL of XENP019683

SEQ ID NO: 21688 - protein, 11 aa, Artificial Sequence
  Description of Artificial Sequence: Synthetic peptide
  XENP019683 vlCDR1
RASQSVGNDVA

SEQ ID NO: 21689 - protein, 7 aa, Artificial Sequence
  Description of Artificial Sequence: Synthetic peptide
  XENP019683 vlCDR2
YASHRYT

SEQ ID NO: 21690 - protein, 9 aa, Artificial Sequence
  Description of Artificial Sequence: Synthetic peptide
  XENP019683 vlCDR3
QQDFSSPRT

SEQ ID NO: 21691 - protein, 451 aa, Artificial Sequence; identical to SEQ ID NO: 21401
  Description of Artificial Sequence: Synthetic polypeptide
  XENP019684 1G6_H1.281_L1.193_IgG1_PVA_/S267K Heavy Chain

SEQ ID NO: 21692 - protein, 122 aa, Artificial Sequence; identical to SEQ ID NO: 15602
  Description of Artificial Sequence: Synthetic polypeptide
  VH of XENP019684

SEQ ID NO: 21693 - protein, 5 aa, Artificial Sequence
  Description of Artificial Sequence: Synthetic peptide
  XENP019684 vhCDR1
NYWMN

SEQ ID NO: 21694 - protein, 19 aa, Artificial Sequence
  Description of Artificial Sequence: Synthetic peptide
  XENP019684 vhCDR2
EIRLYSNNYATHYAESVKG

SEQ ID NO: 21695 - protein, 11 aa, Artificial Sequence
  Description of Artificial Sequence: Synthetic peptide
  XENP019684 vhCDR3
YYGNYGGYFDV

SEQ ID NO: 21696 - protein, 214 aa, Artificial Sequence; identical to SEQ ID NO: 21476
  Description of Artificial Sequence: Synthetic polypeptide
  XENP019684 1G6_H1.281_L1.193_IgG1_PVA_/S267K Light Chain

SEQ ID NO: 21697 - protein, 107 aa, Artificial Sequence; identical to SEQ ID NO: 15666
  Description of Artificial Sequence: Synthetic polypeptide
  VL of XENP019684

SEQ ID NO: 21698 - protein, 11 aa, Artificial Sequence
  Description of Artificial Sequence: Synthetic peptide
  XENP019684 vlCDR1
RASQSVGNDVA

SEQ ID NO: 21699 - protein, 7 aa, Artificial Sequence
  Description of Artificial Sequence: Synthetic peptide
  XENP019684 vlCDR2
YASHRYT

SEQ ID NO: 21700 - protein, 9 aa, Artificial Sequence
  Description of Artificial Sequence: Synthetic peptide
  XENP019684 vlCDR3
QQDFSSPRT

SEQ ID NO: 21701 - protein, 451 aa, Artificial Sequence; identical to SEQ ID NO: 21411
  Description of Artificial Sequence: Synthetic polypeptide
  XENP019685 1G6_H1.282_L1.193_IgG1_PVA_/S267K Heavy Chain

SEQ ID NO: 21702 - protein, 122 aa, Artificial Sequence; identical to SEQ ID NO: 15611
  Description of Artificial Sequence: Synthetic polypeptide
  VH of XENP019685

SEQ ID NO: 21703 - protein, 5 aa, Artificial Sequence
  Description of Artificial Sequence: Synthetic peptide
  XENP019685 vhCDR1
NYWMN

SEQ ID NO: 21704 - protein, 19 aa, Artificial Sequence
  Description of Artificial Sequence: Synthetic peptide
  XENP019685 vhCDR2
EIRLYSNNYATHYAESVKG

SEQ ID NO: 21705 - protein, 11 aa, Artificial Sequence
  Description of Artificial Sequence: Synthetic peptide
  XENP019685 vhCDR3
YYGNYGGYFDV

SEQ ID NO: 21706 - protein, 214 aa, Artificial Sequence; identical to SEQ ID NO: 21476
  Description of Artificial Sequence: Synthetic polypeptide
  XENP019685 1G6_H1.282_L1.193_IgG1_PVA_/S267K Light Chain

SEQ ID NO: 21707 - protein, 107 aa, Artificial Sequence; identical to SEQ ID NO: 15666
  Description of Artificial Sequence: Synthetic polypeptide
  VL of XENP019685

SEQ ID NO: 21708 - protein, 11 aa, Artificial Sequence
  Description of Artificial Sequence: Synthetic peptide
  XENP019685 vlCDR1
RASQSVGNDVA

SEQ ID NO: 21709 - protein, 7 aa, Artificial Sequence
  Description of Artificial Sequence: Synthetic peptide
  XENP019685 vlCDR2
YASHRYT

SEQ ID NO: 21710 - protein, 9 aa, Artificial Sequence
  Description of Artificial Sequence: Synthetic peptide
  XENP019685 vlCDR3
QQDFSSPRT

SEQ ID NO: 21711 - protein, 451 aa, Artificial Sequence; identical to SEQ ID NO: 21381
  Description of Artificial Sequence: Synthetic polypeptide
  XENP019686 1G6_H1.279_L1.194_IgG1_PVA_/S267K Heavy Chain

SEQ ID NO: 21712 - protein, 122 aa, Artificial Sequence; identical to SEQ ID NO: 2872
  Description of Artificial Sequence: Synthetic polypeptide
  VH of XENP019686

SEQ ID NO: 21713 - protein, 5 aa, Artificial Sequence
  Description of Artificial Sequence: Synthetic peptide
  XENP019686 vhCDR1
NYWMN

SEQ ID NO: 21714 - protein, 19 aa, Artificial Sequence
  Description of Artificial Sequence: Synthetic peptide
  XENP019686 vhCDR2
EIRLYSNNYATHYAESVKG

SEQ ID NO: 21715 - protein, 11 aa, Artificial Sequence
  Description of Artificial Sequence: Synthetic peptide
  XENP019686 vhCDR3
YYGNYGGYFDV

SEQ ID NO: 21716 - protein, 214 aa, Artificial Sequence; identical to SEQ ID NO: 21486
  Description of Artificial Sequence: Synthetic polypeptide
  XENP019686 1G6_H1.279_L1.194_IgG1_PVA_/S267K Light Chain

SEQ ID NO: 21717 - protein, 107 aa, Artificial Sequence; identical to SEQ ID NO: 2871
  Description of Artificial Sequence: Synthetic polypeptide
  VL of XENP019686

SEQ ID NO: 21718 - protein, 11 aa, Artificial Sequence
  Description of Artificial Sequence: Synthetic peptide
  XENP019686 vlCDR1
RASQSVGNDVA

SEQ ID NO: 21719 - protein, 7 aa, Artificial Sequence
  Description of Artificial Sequence: Synthetic peptide
  XENP019686 vlCDR2
YASHRYT

SEQ ID NO: 21720 - protein, 9 aa, Artificial Sequence
  Description of Artificial Sequence: Synthetic peptide
  XENP019686 vlCDR3
QQDFSSPRT

SEQ ID NO: 21721 - protein, 451 aa, Artificial Sequence; identical to SEQ ID NO: 21391
  Description of Artificial Sequence: Synthetic polypeptide
  XENP019687 1G6_H1.280_L1.194_IgG1_PVA_/S267K Heavy Chain

SEQ ID NO: 21722 - protein, 122 aa, Artificial Sequence; identical to SEQ ID NO: 15593
  Description of Artificial Sequence: Synthetic polypeptide
  VH of XENP019687

SEQ ID NO: 21723 - protein, 5 aa, Artificial Sequence
  Description of Artificial Sequence: Synthetic peptide
  XENP019687 vhCDR1
NYWMN

SEQ ID NO: 21724 - protein, 19 aa, Artificial Sequence
  Description of Artificial Sequence: Synthetic peptide
  XENP019687 vhCDR2
EIRLYSNNYATHYAESVKG

SEQ ID NO: 21725 - protein, 11 aa, Artificial Sequence
  Description of Artificial Sequence: Synthetic peptide
  XENP019687 vhCDR3
YYGNYGGYFDV

SEQ ID NO: 21726 - protein, 214 aa, Artificial Sequence; identical to SEQ ID NO: 21486
  Description of Artificial Sequence: Synthetic polypeptide
  XENP019687 1G6_H1.280_L1.194_IgG1_PVA_/S267K Light Chain

SEQ ID NO: 21727 - protein, 107 aa, Artificial Sequence; identical to SEQ ID NO: 2871
  Description of Artificial Sequence: Synthetic polypeptide
  VL of XENP019687

SEQ ID NO: 21728 - protein, 11 aa, Artificial Sequence
  Description of Artificial Sequence: Synthetic peptide
  XENP019687 vlCDR1
RASQSVGNDVA

SEQ ID NO: 21729 - protein, 7 aa, Artificial Sequence
  Description of Artificial Sequence: Synthetic peptide
  XENP019687 vlCDR2
YASHRYT

SEQ ID NO: 21730 - protein, 9 aa, Artificial Sequence
  Description of Artificial Sequence: Synthetic peptide
  XENP019687 vlCDR3
QQDFSSPRT

SEQ ID NO: 21731 - protein, 451 aa, Artificial Sequence; identical to SEQ ID NO: 21401
  Description of Artificial Sequence: Synthetic polypeptide
  XENP019688 1G6_H1.281_L1.194_IgG1_PVA_/S267K Heavy Chain

SEQ ID NO: 21732 - protein, 122 aa, Artificial Sequence; identical to SEQ ID NO: 15602
  Description of Artificial Sequence: Synthetic polypeptide
  VH of XENP019688

SEQ ID NO: 21733 - protein, 5 aa, Artificial Sequence
  Description of Artificial Sequence: Synthetic peptide
  XENP019688 vhCDR1
NYWMN

SEQ ID NO: 21734 - protein, 19 aa, Artificial Sequence
  Description of Artificial Sequence: Synthetic peptide
  XENP019688 vhCDR2
EIRLYSNNYATHYAESVKG

SEQ ID NO: 21735 - protein, 11 aa, Artificial Sequence
  Description of Artificial Sequence: Synthetic peptide
  XENP019688 vhCDR3
YYGNYGGYFDV

SEQ ID NO: 21736 - protein, 214 aa, Artificial Sequence; identical to SEQ ID NO: 21486
  Description of Artificial Sequence: Synthetic polypeptide
  XENP019688 1G6_H1.281_L1.194_IgG1_PVA_/S267K Light Chain

SEQ ID NO: 21737 - protein, 107 aa, Artificial Sequence; identical to SEQ ID NO: 2871
  Description of Artificial Sequence: Synthetic polypeptide
  VL of XENP019688

SEQ ID NO: 21738 - protein, 11 aa, Artificial Sequence
  Description of Artificial Sequence: Synthetic peptide
  XENP019688 vlCDR1
RASQSVGNDVA

SEQ ID NO: 21739 - protein, 7 aa, Artificial Sequence
  Description of Artificial Sequence: Synthetic peptide
  XENP019688 vlCDR2
YASHRYT

SEQ ID NO: 21740 - protein, 9 aa, Artificial Sequence
  Description of Artificial Sequence: Synthetic peptide
  XENP019688 vlCDR3
QQDFSSPRT

SEQ ID NO: 21741 - protein, 451 aa, Artificial Sequence; identical to SEQ ID NO: 21411
  Description of Artificial Sequence: Synthetic polypeptide
  XENP019689 1G6_H1.282_L1.194_IgG1_PVA_/S267K Heavy Chain

SEQ ID NO: 21742 - protein, 122 aa, Artificial Sequence; identical to SEQ ID NO: 15611
  Description of Artificial Sequence: Synthetic polypeptide
  VH of XENP019689

SEQ ID NO: 21743 - protein, 5 aa, Artificial Sequence
  Description of Artificial Sequence: Synthetic peptide
  XENP019689 vhCDR1
NYWMN

SEQ ID NO: 21744 - protein, 19 aa, Artificial Sequence
  Description of Artificial Sequence: Synthetic peptide
  XENP019689 vhCDR2
EIRLYSNNYATHYAESVKG

SEQ ID NO: 21745 - protein, 11 aa, Artificial Sequence
  Description of Artificial Sequence: Synthetic peptide
  XENP019689 vhCDR3
YYGNYGGYFDV

SEQ ID NO: 21746 - protein, 214 aa, Artificial Sequence; identical to SEQ ID NO: 21486
  Description of Artificial Sequence: Synthetic polypeptide
  XENP019689 1G6_H1.282_L1.194_IgG1_PVA_/S267K Light Chain

SEQ ID NO: 21747 - protein, 107 aa, Artificial Sequence; identical to SEQ ID NO: 2871
  Description of Artificial Sequence: Synthetic polypeptide
  VL of XENP019689

SEQ ID NO: 21748 - protein, 11 aa, Artificial Sequence
  Description of Artificial Sequence: Synthetic peptide
  XENP019689 vlCDR1
RASQSVGNDVA

SEQ ID NO: 21749 - protein, 7 aa, Artificial Sequence
  Description of Artificial Sequence: Synthetic peptide
  XENP019689 vlCDR2
YASHRYT

SEQ ID NO: 21750 - protein, 9 aa, Artificial Sequence
  Description of Artificial Sequence: Synthetic peptide
  XENP019689 vlCDR3
QQDFSSPRT

SEQ ID NO: 21751 - protein, 449 aa, Artificial Sequence
  Description of Artificial Sequence: Synthetic polypeptide
  XENP020156 2E9_H1L1_IgG1_PVA_/S267K Heavy Chain
QVQLVQSGAEVKKPGASVKVSCKASGYAFTNYWLGWVRQAPGQGLEWMGNFYPGSSNTYYNEKFQGRVTMTADKSISTAYMELSRLRSDDTAVYFCARHYGTNYRYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 21752 - protein, 120 aa, Artificial Sequence; identical to SEQ ID NO: 3091
  Description of Artificial Sequence: Synthetic polypeptide
  VH of XENP020156

SEQ ID NO: 21753 - protein, 5 aa, Artificial Sequence
  Description of Artificial Sequence: Synthetic peptide
  XENP020156 vhCDR1
NYWLG

SEQ ID NO: 21754 - protein, 17 aa, Artificial Sequence
  Description of Artificial Sequence: Synthetic peptide
  XENP020156 vhCDR2
NFYPGSSNTYYNEKFQG

SEQ ID NO: 21755 - protein, 11 aa, Artificial Sequence
  Description of Artificial Sequence: Synthetic peptide
  XENP020156 vhCDR3
HYGTNYRYFDV

SEQ ID NO: 21756 - protein, 214 aa, Artificial Sequence; identical to SEQ ID NO: 3140
  Description of Artificial Sequence: Synthetic polypeptide
  XENP020156 2E9_H1L1_IgG1_PVA_/S267K Light Chain

SEQ ID NO: 21757 - protein, 107 aa, Artificial Sequence; identical to SEQ ID NO: 3092
  Description of Artificial Sequence: Synthetic polypeptide
  VL of XENP020156

SEQ ID NO: 21758 - protein, 11 aa, Artificial Sequence
  Description of Artificial Sequence: Synthetic peptide
  XENP020156 vlCDR1
RASQSVSNDVA

SEQ ID NO: 21759 - protein, 7 aa, Artificial Sequence
  Description of Artificial Sequence: Synthetic peptide
  XENP020156 vlCDR2
YASNRYT

SEQ ID NO: 21760 - protein, 9 aa, Artificial Sequence
  Description of Artificial Sequence: Synthetic peptide
  XENP020156 vlCDR3
QQDYSSPYT

SEQ ID NO: 21761 - protein, 449 aa, Artificial Sequence
  Description of Artificial Sequence: Synthetic polypeptide
  XENP020157 2E9_H2L1_IgG1_PVA_/S267K Heavy Chain
EVQLVQSGAEVKKPGESLKISCKASGYAFTNYWLGWVRQMPGKGLEWMGNFYPGSSNTYYNPSFQGQVTISADKSISTAYLQWSSLKASDTAMYFCARHYGTNYRYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 21762 - protein, 120 aa, Artificial Sequence; identical to SEQ ID NO: 16097
  Description of Artificial Sequence: Synthetic polypeptide
  VH of XENP020157

SEQ ID NO: 21763 - protein, 5 aa, Artificial Sequence
  Description of Artificial Sequence: Synthetic peptide
  XENP020157 vhCDR1
NYWLG

SEQ ID NO: 21764 - protein, 17 aa, Artificial Sequence
  Description of Artificial Sequence: Synthetic peptide
  XENP020157 vhCDR2
NFYPGSSNTYYNPSFQG

SEQ ID NO: 21765 - protein, 11 aa, Artificial Sequence
  Description of Artificial Sequence: Synthetic peptide
  XENP020157 vhCDR3
HYGTNYRYFDV

SEQ ID NO: 21766 - protein, 214 aa, Artificial Sequence; identical to SEQ ID NO: 3140
  Description of Artificial Sequence: Synthetic polypeptide
  XENP020157 2E9_H2L1_IgG1_PVA_/S267K Light Chain

SEQ ID NO: 21767 - protein, 107 aa, Artificial Sequence; identical to SEQ ID NO: 3092
  Description of Artificial Sequence: Synthetic polypeptide
  VL of XENP020157

SEQ ID NO: 21768 - protein, 11 aa, Artificial Sequence
  Description of Artificial Sequence: Synthetic peptide
  XENP020157 vlCDR1
RASQSVSNDVA

SEQ ID NO: 21769 - protein, 7 aa, Artificial Sequence
  Description of Artificial Sequence: Synthetic peptide
  XENP020157 vlCDR2
YASNRYT

SEQ ID NO: 21770 - protein, 9 aa, Artificial Sequence
  Description of Artificial Sequence: Synthetic peptide
  XENP020157 vlCDR3
QQDYSSPYT

SEQ ID NO: 21771 - protein, 444 aa, Artificial Sequence
  Description of Artificial Sequence: Synthetic polypeptide
  XENP020158 3C11(PD-1)_H1L1_IgG1_PVA_/S267K Heavy Chain
QVQLVQSGAEVKKPGASVKVSCKASGYTFTSYWMHWVRQAPGQGLEWMGAIYPGNIATSYNQKFQGRVTMTADTSTSTAYMELSSLRSEDTAVYYCTTSYVMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 21772 - protein, 115 aa, Artificial Sequence; identical to SEQ ID NO: 16106
  Description of Artificial Sequence: Synthetic polypeptide
  VH of XENP020158

SEQ ID NO: 21773 - protein, 5 aa, Artificial Sequence
  Description of Artificial Sequence: Synthetic peptide
  XENP020158 vhCDR1
SYWMH

SEQ ID NO: 21774 - protein, 17 aa, Artificial Sequence
  Description of Artificial Sequence: Synthetic peptide
  XENP020158 vhCDR2
AIYPGNIATSYNQKFQG

SEQ ID NO: 21775 - protein, 6 aa, Artificial Sequence
  Description of Artificial Sequence: Synthetic peptide
  XENP020158 vhCDR3
SYVMDY

SEQ ID NO: 21776 - protein, 214 aa, Artificial Sequence
  Description of Artificial Sequence: Synthetic polypeptide
  XENP020158 3C11(PD-1)_H1L1_IgG1_PVA_/S267K Light Chain
DIVMTQSPSSLSASVGDRVTITCQASQDINSYLSWFQQKPGKSPKTLIYRANRLVDGVPSRFSGSGSGQDYTFTISSLQPEDIATYYCLQYDEFPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 21777 - protein, 107 aa, Artificial Sequence; identical to SEQ ID NO: 16107
  Description of Artificial Sequence: Synthetic polypeptide
  VL of XENP020158

SEQ ID NO: 21778 - protein, 11 aa, Artificial Sequence
  Description of Artificial Sequence: Synthetic peptide
  XENP020158 vlCDR1
QASQDINSYLS

SEQ ID NO: 21779 - protein, 7 aa, Artificial Sequence
  Description of Artificial Sequence: Synthetic peptide
  XENP020158 vlCDR2
RANRLVD

SEQ ID NO: 21780 - protein, 9 aa, Artificial Sequence
  Description of Artificial Sequence: Synthetic peptide
  XENP020158 vlCDR3
LQYDEFPYT

SEQ ID NO: 21781 - protein, 441 aa, Artificial Sequence
  Description of Artificial Sequence: Synthetic polypeptide
  XENP020159 3G12_H1L1_IgG1_PVA_/S267K Heavy Chain
QVQLVQSGAEVKKPGASVKVSCKASGYTFTSYWMHWVRQAPGQGLEWMGVIDPSDSYTSYNQKFQGRVTMTVDTSTSTAYMELSSLRSEDTAVYYCTGAYYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 21782 - protein, 112 aa, Artificial Sequence; identical to SEQ ID NO: 16115
  Description of Artificial Sequence: Synthetic polypeptide
  VH of XENP020159

SEQ ID NO: 21783 - protein, 5 aa, Artificial Sequence
  Description of Artificial Sequence: Synthetic peptide
  XENP020159 vhCDR1
SYWMH

SEQ ID NO: 21784 - protein, 17 aa, Artificial Sequence
  Description of Artificial Sequence: Synthetic peptide
  XENP020159 vhCDR2
VIDPSDSYTSYNQKFQG

SEQ ID NO: 21785 - protein, 3 aa, Artificial Sequence
  Description of Artificial Sequence: Synthetic peptide
  XENP020159 vhCDR3
AYY

SEQ ID NO: 21786 - protein, 214 aa, Artificial Sequence
  Description of Artificial Sequence: Synthetic polypeptide
  XENP020159 3G12_H1L1_IgG1_PVA_/S267K Light Chain
DIVLTQSPSSLSASVGDRVTITCRASQGISSNIGWLQQKPGKSFKGLIYHGTNLEDGVPSRFTGSGSGADYTLTISSLQPEDFATYYCVQYAQSPWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 21787 - protein, 107 aa, Artificial Sequence; identical to SEQ ID NO: 16116
  Description of Artificial Sequence: Synthetic polypeptide
  VL of XENP020159

SEQ ID NO: 21788 - protein, 11 aa, Artificial Sequence
  Description of Artificial Sequence: Synthetic peptide
  XENP020159 vlCDR1
RASQGISSNIG

SEQ ID NO: 21789 - protein, 7 aa, Artificial Sequence
  Description of Artificial Sequence: Synthetic peptide
  XENP020159 vlCDR2
HGTNLED

SEQ ID NO: 21790 - protein, 9 aa, Artificial Sequence
  Description of Artificial Sequence: Synthetic peptide
  XENP020159 vlCDR3
VQYAQSPWT

SEQ ID NO: 21791 - protein, 441 aa, Artificial Sequence
  Description of Artificial Sequence: Synthetic polypeptide
  XENP020160 5C4_H1L1_IgG1_PVA_/S267K Heavy Chain
QVQLVQSGAEVKKPGASVKVSCKASGYTFTDYWMHWLRQAPGQGLEWMGAIDTSDSYPTYNQKFQGRVTMTVDDSTSTAYMELSSLRSEDTAVYYCTRFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 21792 - protein, 112 aa, Artificial Sequence; identical to SEQ ID NO: 16124
  Description of Artificial Sequence: Synthetic polypeptide
  VH of XENP020160

SEQ ID NO: 21793 - protein, 5 aa, Artificial Sequence
  Description of Artificial Sequence: Synthetic peptide
  XENP020160 vhCDR1
DYWMH

SEQ ID NO: 21794 - protein, 17 aa, Artificial Sequence
  Description of Artificial Sequence: Synthetic peptide
  XENP020160 vhCDR2
AIDTSDSYPTYNQKFQG

SEQ ID NO: 21795 - protein, 3 aa, Artificial Sequence
  Description of Artificial Sequence: Synthetic peptide
  XENP020160 vhCDR3
FDY

SEQ ID NO: 21796 - protein, 214 aa, Artificial Sequence
  Description of Artificial Sequence: Synthetic polypeptide
  XENP020160 5C4_H1L1_IgG1_PVA_/S267K Light Chain
DIVMTQSPDSLAVSLGERATINCKASQSVSNDVAWYQQKPGQSPKLLIYYASNRYTGVPDRFTGSGYGTDFTLTISSLQAEDVAVYFCQQDYSSPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 21797 - protein, 107 aa, Artificial Sequence; identical to SEQ ID NO: 16125
  Description of Artificial Sequence: Synthetic polypeptide
  VL of XENP020160

SEQ ID NO: 21798 - protein, 11 aa, Artificial Sequence
  Description of Artificial Sequence: Synthetic peptide
  XENP020160 vlCDR1
KASQSVSNDVA

SEQ ID NO: 21799 - protein, 7 aa, Artificial Sequence
  Description of Artificial Sequence: Synthetic peptide
  XENP020160 vlCDR2
YASNRYT

SEQ ID NO: 21800 - protein, 9 aa, Artificial Sequence
  Description of Artificial Sequence: Synthetic peptide
  XENP020160 vlCDR3
QQDYSSPYT

SEQ ID NO: 21801 - protein, 441 aa, Artificial Sequence
  Description of Artificial Sequence: Synthetic polypeptide
  XENP020161 5C4_H2L1_IgG1_PVA_/S267K Heavy Chain
QVQLVQSGSELKKPGASVKVSCKASGYTFTDYWMHWLRQAPGQGLEWMGAIDTSDSYPTYNQGFTGRFVFSVDDSVSTAYLQISSLKAEDTAVYYCTRFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 21802 - protein, 112 aa, Artificial Sequence; identical to SEQ ID NO: 16133
  Description of Artificial Sequence: Synthetic polypeptide
  VH of XENP020161

SEQ ID NO: 21803 - protein, 5 aa, Artificial Sequence
  Description of Artificial Sequence: Synthetic peptide
  XENP020161 vhCDR1
DYWMH

SEQ ID NO: 21804 - protein, 17 aa, Artificial Sequence
  Description of Artificial Sequence: Synthetic peptide
  XENP020161 vhCDR2
AIDTSDSYPTYNQGFTG

SEQ ID NO: 21805 - protein, 3 aa, Artificial Sequence
  Description of Artificial Sequence: Synthetic peptide
  XENP020161 vhCDR3
FDY

SEQ ID NO: 21806 - protein, 214 aa, Artificial Sequence; identical to SEQ ID NO: 21796
  Description of Artificial Sequence: Synthetic polypeptide
  XENP020161 5C4_H2L1_IgG1_PVA_/S267K Light Chain

SEQ ID NO: 21807 - protein, 107 aa, Artificial Sequence; identical to SEQ ID NO: 16125
  Description of Artificial Sequence: Synthetic polypeptide
  VL of XENP020161

SEQ ID NO: 21808 - protein, 11 aa, Artificial Sequence
  Description of Artificial Sequence: Synthetic peptide
  XENP020161 vlCDR1
KASQSVSNDVA

SEQ ID NO: 21809 - protein, 7 aa, Artificial Sequence
  Description of Artificial Sequence: Synthetic peptide
  XENP020161 vlCDR2
YASNRYT

SEQ ID NO: 21810 - protein, 9 aa, Artificial Sequence
  Description of Artificial Sequence: Synthetic peptide
  XENP020161 vlCDR3
QQDYSSPYT

SEQ ID NO: 21811 - protein, 449 aa, Artificial Sequence
  Description of Artificial Sequence: Synthetic polypeptide
  XENP016436 25F7_H0L0_IgG1_PVA_/S267K Heavy Chain
QVQLQQWGAGLLKPSETLSLTCAVYGGSFSDYYWNWIRQPPGKGLEWIGEINHNGNTNSNPSLKSRVTLSLDTSKNQFSLKLRSVTAADTAVYYCAFGYSDYEYNWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 21812 - protein, 120 aa, Artificial Sequence
  Description of Artificial Sequence: Synthetic polypeptide
  VH of XENP016436
QVQLQQWGAGLLKPSETLSLTCAVYGGSFSDYYWNWIRQPPGKGLEWIGEINHNGNTNSNPSLKSRVTLSLDTSKNQFSLKLRSVTAADTAVYYCAFGYSDYEYNWFDPWGQGTLVTVSS

SEQ ID NO: 21813 - protein, 5 aa, Artificial Sequence
  Description of Artificial Sequence: Synthetic peptide
  XENP016436 vhCDR1
DYYWN

SEQ ID NO: 21814 - protein, 16 aa, Artificial Sequence
  Description of Artificial Sequence: Synthetic peptide
  XENP016436 vhCDR2
EINHNGNTNSNPSLKS

SEQ ID NO: 21815 - protein, 12 aa, Artificial Sequence
  Description of Artificial Sequence: Synthetic peptide
  XENP016436 vhCDR3
GYSDYEYNWFDP

SEQ ID NO: 21816 - protein, 214 aa, Artificial Sequence
  Description of Artificial Sequence: Synthetic polypeptide
  XENP016436 25F7_H0L0_IgG1_PVA_/S267K Light Chain
EIVLTQSPATLSLSPGERATLSCRASQSISSYLAWYQQKPGQAPRLLIYDASNRATGIPARFSGSGSGTDFTLTISSLEPEDFAVYYCQQRSNWPLTFGQGTNLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 21817 - protein, 107 aa, Artificial Sequence; identical to SEQ ID NO: 3821
  Description of Artificial Sequence: Synthetic polypeptide
  VL of XENP016436

SEQ ID NO: 21818 - protein, 11 aa, Artificial Sequence
  Description of Artificial Sequence: Synthetic peptide
  XENP016436 vlCDR1
RASQSISSYLA

SEQ ID NO: 21819 - protein, 7 aa, Artificial Sequence
  Description of Artificial Sequence: Synthetic peptide
  XENP016436 vlCDR2
DASNRAT

SEQ ID NO: 21820 - protein, 9 aa, Artificial Sequence
  Description of Artificial Sequence: Synthetic peptide
  XENP016436 vlCDR3
QQRSNWPLT

SEQ ID NO: 21821 - protein, 447 aa, Artificial Sequence
  Description of Artificial Sequence: Synthetic polypeptide
  XENP019353 1H11_H0L0_IgG1_PVA_/S267K Heavy Chain
QIQLVQSGPELKKPGETVKISCKASGYTFTNYGMNWVKQAPGKGLKWMGWINTYTGEPTYADDFKGRFAFSLETSASTAYLQINNLKNEDTATYFCARGRGMGYFDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 21822 - protein, 118 aa, Artificial Sequence
  Description of Artificial Sequence: Synthetic polypeptide
  VH of XENP019353
QIQLVQSGPELKKPGETVKISCKASGYTFTNYGMNWVKQAPGKGLKWMGWINTYTGEPTYADDFKGRFAFSLETSASTAYLQINNLKNEDTATYFCARGRGMGYFDYWGQGTTLTVSS

SEQ ID NO: 21823 - protein, 5 aa, Artificial Sequence
  Description of Artificial Sequence: Synthetic peptide
  XENP019353 vhCDR1
NYGMN

SEQ ID NO: 21824 - protein, 17 aa, Artificial Sequence
  Description of Artificial Sequence: Synthetic peptide
  XENP019353 vhCDR2
WINTYTGEPTYADDFKG

SEQ ID NO: 21825 - protein, 9 aa, Artificial Sequence
  Description of Artificial Sequence: Synthetic peptide
  XENP019353 vhCDR3
GRGMGYFDY

SEQ ID NO: 21826 - protein, 214 aa, Artificial Sequence
  Description of Artificial Sequence: Synthetic polypeptide
  XENP019353 1H11_H0L0_IgG1_PVA_/S267K Light Chain
DIQMTQSPASLSVSVGETVTITCRASENIYSNLAWYQQKQGKSPQLLVYAATNLADGVPSRFSGSGSGTQYSLKINSLQSGDFGNYYCQHFWTTPRTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 21827 - protein, 107 aa, Artificial Sequence
  Description of Artificial Sequence: Synthetic polypeptide
  VL of XENP019353
DIQMTQSPASLSVSVGETVTITCRASENIYSNLAWYQQKQGKSPQLLVYAATNLADGVPSRFSGSGSGTQYSLKINSLQSGDFGNYYCQHFWTTPRTFGGGTKLEIK

SEQ ID NO: 21828 - protein, 11 aa, Artificial Sequence
  Description of Artificial Sequence: Synthetic peptide
  XENP019353 vlCDR1
RASENIYSNLA

SEQ ID NO: 21829 - protein, 7 aa, Artificial Sequence
  Description of Artificial Sequence: Synthetic peptide
  XENP019353 vlCDR2
AATNLAD

SEQ ID NO: 21830 - protein, 9 aa, Artificial Sequence
  Description of Artificial Sequence: Synthetic peptide
  XENP019353 vlCDR3
QHFWTTPRT

SEQ ID NO: 21831 - protein, 447 aa, Artificial Sequence
  Description of Artificial Sequence: Synthetic polypeptide
  XENP019354 1H11_H1L1_IgG1_PVA_/S267K Heavy Chain
QIQLVQSGAEVKKPGASVKVSCKASGYTFTNYGMNWVRQAPGQGLEWMGWINTYTGEPTYADKFQGRVTMTLDTSTSTAYMELSSLRSEDTAVYFCARGRGMGYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 21832 - protein, 118 aa, Artificial Sequence
  Description of Artificial Sequence: Synthetic polypeptide
  VH of XENP019354
QIQLVQSGAEVKKPGASVKVSCKASGYTFTNYGMNWVRQAPGQGLEWMGWINTYTGEPTYADKFQGRVTMTLDTSTSTAYMELSSLRSEDTAVYFCARGRGMGYFDYWGQGTLVTVSS

SEQ ID NO: 21833 - protein, 5 aa, Artificial Sequence
  Description of Artificial Sequence: Synthetic peptide
  XENP019354 vhCDR1
NYGMN

SEQ ID NO: 21834 - protein, 17 aa, Artificial Sequence
  Description of Artificial Sequence: Synthetic peptide
  XENP019354 vhCDR2
WINTYTGEPTYADKFQG

SEQ ID NO: 21835 - protein, 9 aa, Artificial Sequence
  Description of Artificial Sequence: Synthetic peptide
  XENP019354 vhCDR3
GRGMGYFDY

SEQ ID NO: 21836 - protein, 214 aa, Artificial Sequence
  Description of Artificial Sequence: Synthetic polypeptide
  XENP019354 1H11_H1L1_IgG1_PVA_/S267K Light Chain
DIQMTQSPSSLSASVGDRVTITCRASENIYSNLAWYQQKPGKSPKLLVYAATNLADGVPSRFSGSGSGTDYTLTISSLQPEDFATYYCQHFWTTPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 21837 - protein, 107 aa, Artificial Sequence
  Description of Artificial Sequence: Synthetic polypeptide
  VL of XENP019354
DIQMTQSPSSLSASVGDRVTITCRASENIYSNLAWYQQKPGKSPKLLVYAATNLADGVPSRFSGSGSGTDYTLTISSLQPEDFATYYCQHFWTTPRTFGGGTKVEIK

SEQ ID NO: 21838 - protein, 11 aa, Artificial Sequence
  Description of Artificial Sequence: Synthetic peptide
  XENP019354 vlCDR1
RASENIYSNLA

SEQ ID NO: 21839 - protein, 7 aa, Artificial Sequence
  Description of Artificial Sequence: Synthetic peptide
  XENP019354 vlCDR2
AATNLAD

SEQ ID NO: 21840 - protein, 9 aa, Artificial Sequence
  Description of Artificial Sequence: Synthetic peptide
  XENP019354 vlCDR3
QHFWTTPRT

SEQ ID NO: 21841 - protein, 447 aa, Artificial Sequence; identical to SEQ ID NO: 21831
  Description of Artificial Sequence: Synthetic polypeptide
  XENP019355 1H11_H1L2_IgG1_PVA_/S267K Heavy Chain

SEQ ID NO: 21842 - protein, 118 aa, Artificial Sequence; identical to SEQ ID NO: 21832
  Description of Artificial Sequence: Synthetic polypeptide
  VH of XENP019355

SEQ ID NO: 21843 - protein, 5 aa, Artificial Sequence
  Description of Artificial Sequence: Synthetic peptide
  XENP019355 vhCDR1
NYGMN

SEQ ID NO: 21844 - protein, 17 aa, Artificial Sequence
  Description of Artificial Sequence: Synthetic peptide
  XENP019355 vhCDR2
WINTYTGEPTYADKFQG

SEQ ID NO: 21845 - protein, 9 aa, Artificial Sequence
  Description of Artificial Sequence: Synthetic peptide
  XENP019355 vhCDR3
GRGMGYFDY

SEQ ID NO: 21846 - protein, 214 aa, Artificial Sequence
  Description of Artificial Sequence: Synthetic polypeptide
  XENP019355 1H11_H1L2_IgG1_PVA_/S267K Light Chain
DIQMTQSPATLSVSPGERATLSCRASENIYSNLAWYQQKPGQSPRLLVYAATNLADGVPSRFSGSGSGTEYTLTISSLQSEDFAVYYCQHFWTTPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 21847 - protein, 107 aa, Artificial Sequence
  Description of Artificial Sequence: Synthetic polypeptide
  VL of XENP019355
DIQMTQSPATLSVSPGERATLSCRASENIYSNLAWYQQKPGQSPRLLVYAATNLADGVPSRFSGSGSGTEYTLTISSLQSEDFAVYYCQHFWTTPRTFGGGTKVEIK

SEQ ID NO: 21848 - protein, 11 aa, Artificial Sequence
  Description of Artificial Sequence: Synthetic peptide
  XENP019355 vlCDR1
RASENIYSNLA

SEQ ID NO: 21849 - protein, 7 aa, Artificial Sequence
  Description of Artificial Sequence: Synthetic peptide
  XENP019355 vlCDR2
AATNLAD

SEQ ID NO: 21850 - protein, 9 aa, Artificial Sequence
  Description of Artificial Sequence: Synthetic peptide
  XENP019355 vlCDR3
QHFWTTPRT

SEQ ID NO: 21851 - protein, 447 aa, Artificial Sequence
  Description of Artificial Sequence: Synthetic polypeptide
  XENP019356 1H11_H2L1_IgG1_PVA_/S267K Heavy Chain
QIQLVQSGSELKKPGASVKVSCKASGYTFTNYGMNWVRQAPGQGLEWMGWINTYTGEPTYADGFTGRFVFSLDTSVSTAYLQISSLKAEDTAVYFCARGRGMGYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 21852 - protein, 118 aa, Artificial Sequence
  Description of Artificial Sequence: Synthetic polypeptide
  VH of XENP019356
QIQLVQSGSELKKPGASVKVSCKASGYTFTNYGMNWVRQAPGQGLEWMGWINTYTGEPTYADGFTGRFVFSLDTSVSTAYLQISSLKAEDTAVYFCARGRGMGYFDYWGQGTLVTVSS

SEQ ID NO: 21853 - protein, 5 aa, Artificial Sequence
  Description of Artificial Sequence: Synthetic peptide
  XENP019356 vhCDR1
NYGMN

SEQ ID NO: 21854 - protein, 17 aa, Artificial Sequence
  Description of Artificial Sequence: Synthetic peptide
  XENP019356 vhCDR2
WINTYTGEPTYADGFTG

SEQ ID NO: 21855 - protein, 9 aa, Artificial Sequence
  Description of Artificial Sequence: Synthetic peptide
  XENP019356 vhCDR3
GRGMGYFDY

SEQ ID NO: 21856 - protein, 214 aa, Artificial Sequence; identical to SEQ ID NO: 21836
  Description of Artificial Sequence: Synthetic polypeptide
  XENP019356 1H11_H2L1_IgG1_PVA_/S267K Light Chain

SEQ ID NO: 21857 - protein, 107 aa, Artificial Sequence; identical to SEQ ID NO: 21837
  Description of Artificial Sequence: Synthetic polypeptide
  VL of XENP019356

SEQ ID NO: 21858 - protein, 11 aa, Artificial Sequence
  Description of Artificial Sequence: Synthetic peptide
  XENP019356 vlCDR1
RASENIYSNLA

SEQ ID NO: 21859 - protein, 7 aa, Artificial Sequence
  Description of Artificial Sequence: Synthetic peptide
  XENP019356 vlCDR2
AATNLAD

SEQ ID NO: 21860 - protein, 9 aa, Artificial Sequence
  Description of Artificial Sequence: Synthetic peptide
  XENP019356 vlCDR3
QHFWTTPRT

SEQ ID NO: 21861 - protein, 447 aa, Artificial Sequence; identical to SEQ ID NO: 21851
  Description of Artificial Sequence: Synthetic polypeptide
  XENP019357 1H11_H2L2_IgG1_PVA_/S267K Heavy Chain

SEQ ID NO: 21862 - protein, 118 aa, Artificial Sequence; identical to SEQ ID NO: 21852
  Description of Artificial Sequence: Synthetic polypeptide
  VH of XENP019357

SEQ ID NO: 21863 - protein, 5 aa, Artificial Sequence
  Description of Artificial Sequence: Synthetic peptide
  XENP019357 vhCDR1
NYGMN

SEQ ID NO: 21864 - protein, 17 aa, Artificial Sequence
  Description of Artificial Sequence: Synthetic peptide
  XENP019357 vhCDR2
WINTYTGEPTYADGFTG

SEQ ID NO: 21865 - protein, 9 aa, Artificial Sequence
  Description of Artificial Sequence: Synthetic peptide
  XENP019357 vhCDR3
GRGMGYFDY

SEQ ID NO: 21866 - protein, 214 aa, Artificial Sequence; identical to SEQ ID NO: 21846
  Description of Artificial Sequence: Synthetic polypeptide
  XENP019357 1H11_H2L2_IgG1_PVA_/S267K Light Chain

SEQ ID NO: 21867 - protein, 107 aa, Artificial Sequence; identical to SEQ ID NO: 21847
  Description of Artificial Sequence: Synthetic polypeptide
  VL of XENP019357

SEQ ID NO: 21868 - protein, 11 aa, Artificial Sequence
  Description of Artificial Sequence: Synthetic peptide
  XENP019357 vlCDR1
RASENIYSNLA

SEQ ID NO: 21869 - protein, 7 aa, Artificial Sequence
  Description of Artificial Sequence: Synthetic peptide
  XENP019357 vlCDR2
AATNLAD

SEQ ID NO: 21870 - protein, 9 aa, Artificial Sequence
  Description of Artificial Sequence: Synthetic peptide
  XENP019357 vlCDR3
QHFWTTPRT

SEQ ID NO: 21871 - protein, 450 aa, Artificial Sequence
  Description of Artificial Sequence: Synthetic polypeptide
  XENP019358 3C11_H1L1_IgG1_PVA_/S267K Heavy Chain
QVQLQESGPGLVKPSETLSLTCTVSGYSITSDYAWNWIRQPPGKKLEWIGYISYSSTSYNPSLKSRVTISRDTSKNQFSLKLSSVTAADTAVYFCARNNLLWSYYYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 21872 - protein, 121 aa, Artificial Sequence
  Description of Artificial Sequence: Synthetic polypeptide
  VH of XENP019358
QVQLQESGPGLVKPSETLSLTCTVSGYSITSDYAWNWIRQPPGKKLEWIGYISYSSTSYNPSLKSRVTISRDTSKNQFSLKLSSVTAADTAVYFCARNNLLWSYYYAMDYWGQGTLVTVSS

SEQ ID NO: 21873 - protein, 6 aa, Artificial Sequence
  Description of Artificial Sequence: Synthetic peptide
  XENP019358 vhCDR1
SDYAWN

SEQ ID NO: 21874 - protein, 15 aa, Artificial Sequence
  Description of Artificial Sequence: Synthetic peptide
  XENP019358 vhCDR2
YISYSSTSYNPSLKS

SEQ ID NO: 21875 - protein, 13 aa, Artificial Sequence
  Description of Artificial Sequence: Synthetic peptide
  XENP019358 vhCDR3
NNLLWSYYYAMDY

SEQ ID NO: 21876 - protein, 218 aa, Artificial Sequence
  Description of Artificial Sequence: Synthetic polypeptide
  XENP019358 3C11_H1L1_IgG1_PVA_/S267K Light Chain
DIVLTQSPATLSLSPGERATLSCRASESVDSYGNSFMHWYQQKPGQPPRLLIYRASNLESGIPARFSGSGSGTDFTLTISSLEPEDFAVYYCQQSNEDPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 21877 - protein, 111 aa, Artificial Sequence
  Description of Artificial Sequence: Synthetic polypeptide
  VL of XENP019358
DIVLTQSPATLSLSPGERATLSCRASESVDSYGNSFMHWYQQKPGQPPRLLIYRASNLESGIPARFSGSGSGTDFTLTISSLEPEDFAVYYCQQSNEDPYTFGGGTKVEIK

SEQ ID NO: 21878 - protein, 15 aa, Artificial Sequence
  Description of Artificial Sequence: Synthetic peptide
  XENP019358 vlCDR1
RASESVDSYGNSFMH

SEQ ID NO: 21879 - protein, 7 aa, Artificial Sequence
  Description of Artificial Sequence: Synthetic peptide
  XENP019358 vlCDR2
RASNLES

SEQ ID NO: 21880 - protein, 9 aa, Artificial Sequence
  Description of Artificial Sequence: Synthetic peptide
  XENP019358 vlCDR3
QQSNEDPYT

SEQ ID NO: 21881 - protein, 447 aa, Artificial Sequence; identical to SEQ ID NO: 21831
  Description of Artificial Sequence: Synthetic polypeptide
  XENP019359 1H11_H1_5D8_L1_IgG1_PVA_/S267K Heavy Chain

SEQ ID NO: 21882 - protein, 118 aa, Artificial Sequence; identical to SEQ ID NO: 21832
  Description of Artificial Sequence: Synthetic polypeptide
  VH of XENP019359

SEQ ID NO: 21883 - protein, 5 aa, Artificial Sequence
  Description of Artificial Sequence: Synthetic peptide
  XENP019359 vhCDR1
NYGMN

SEQ ID NO: 21884 - protein, 17 aa, Artificial Sequence
  Description of Artificial Sequence: Synthetic peptide
  XENP019359 vhCDR2
WINTYTGEPTYADKFQG

SEQ ID NO: 21885 - protein, 9 aa, Artificial Sequence
  Description of Artificial Sequence: Synthetic peptide
  XENP019359 vhCDR3
GRGMGYFDY

SEQ ID NO: 21886 - protein, 214 aa, Artificial Sequence
  Description of Artificial Sequence: Synthetic polypeptide
  XENP019359 1H11_H1_5D8_L1_IgG1_PVA_/S267K Light Chain
DIQMTQSPSSLSASVGDRVTITCRASENIYSNLAWYQQKPGKSPKLLVYAATNLGDGVPSRFSGSGSGTDYTLTISSLQPEDFATYYCQHFWATPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 21887 - protein, 107 aa, Artificial Sequence
  Description of Artificial Sequence: Synthetic polypeptide
  VL of XENP019359
DIQMTQSPSSLSASVGDRVTITCRASENIYSNLAWYQQKPGKSPKLLVYAATNLGDGVPSRFSGSGSGTDYTLTISSLQPEDFATYYCQHFWATPRTFGGGTKVEIK

SEQ ID NO: 21888 - protein, 11 aa, Artificial Sequence
  Description of Artificial Sequence: Synthetic peptide
  XENP019359 vlCDR1
RASENIYSNLA

SEQ ID NO: 21889 - protein, 7 aa, Artificial Sequence
  Description of Artificial Sequence: Synthetic peptide
  XENP019359 vlCDR2
AATNLGD

SEQ ID NO: 21890 - protein, 9 aa, Artificial Sequence
  Description of Artificial Sequence: Synthetic peptide
  XENP019359 vlCDR3
QHFWATPRT

SEQ ID NO: 21891 - protein, 444 aa, Artificial Sequence
  Description of Artificial Sequence: Synthetic polypeptide
  XENP019360 8D7_H1L1_IgG1_PVA_/S267K Heavy Chain
QVTLKESGPVLVKPTETLTLTCTVSGFSLSSYGVHWVRQPPGKGLEWLAVIWSGSTDYNPSLKSRLTISKDNSKSQVVLTMTNMDPVDTATYYCARTYYYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 21892 - protein, 115 aa, Artificial Sequence
  Description of Artificial Sequence: Synthetic polypeptide
  VH of XENP019360
QVTLKESGPVLVKPTETLTLTCTVSGFSLSSYGVHWVRQPPGKGLEWLAVIWSGSTDYNPSLKSRLTISKDNSKSQVVLTMTNMDPVDTATYYCARTYYYAMDYWGQGTLVTVSS

SEQ ID NO: 21893 - protein, 5 aa, Artificial Sequence
  Description of Artificial Sequence: Synthetic peptide
  XENP019360 vhCDR1
SYGVH

SEQ ID NO: 21894 - protein, 15 aa, Artificial Sequence
  Description of Artificial Sequence: Synthetic peptide
  XENP019360 vhCDR2
VIWSGSTDYNPSLKS

SEQ ID NO: 21895 - protein, 8 aa, Artificial Sequence
  Description of Artificial Sequence: Synthetic peptide
  XENP019360 vhCDR3
TYYYAMDY

SEQ ID NO: 21896 - protein, 214 aa, Artificial Sequence
  Description of Artificial Sequence: Synthetic polypeptide
  XENP019360 8D7_H1L1_IgG1_PVA_/S267K Light Chain
DIQMTQSPSSLSASVGDRVTITCRASENIYSNLAWYQQKPGKSPKFLIYAATNLADGVPSRFSGSGSGTDYTLTISSLQPEDFATYYCQHFWGTPWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 21897 - protein, 107 aa, Artificial Sequence
  Description of Artificial Sequence: Synthetic polypeptide
  VL of XENP019360
DIQMTQSPSSLSASVGDRVTITCRASENIYSNLAWYQQKPGKSPKFLIYAATNLADGVPSRFSGSGSGTDYTLTISSLQPEDFATYYCQHFWGTPWTFGGGTKVEIK

SEQ ID NO: 21898 - protein, 11 aa, Artificial Sequence
  Description of Artificial Sequence: Synthetic peptide
  XENP019360 vlCDR1
RASENIYSNLA

SEQ ID NO: 21899 - protein, 7 aa, Artificial Sequence
  Description of Artificial Sequence: Synthetic peptide
  XENP019360 vlCDR2
AATNLAD

SEQ ID NO: 21900 - protein, 9 aa, Artificial Sequence
  Description of Artificial Sequence: Synthetic peptide
  XENP019360 vlCDR3
QHFWGTPWT

SEQ ID NO: 21901 - protein, 447 aa, Artificial Sequence
  Description of Artificial Sequence: Synthetic polypeptide
  XENP019361 2A11_H0L0_IgG1_PVA_/S267K Heavy Chain
EVQLQQSGAELVRSGASVKLSCTASGFNIKDYYMHWVKQRPEQGLEWIGWIDPENGDTEYAPKFQGKATMTADTSSNTAYLQLSSLTSEDTAVYYCYARGVRQALDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 21902 - protein, 118 aa, Artificial Sequence
  Description of Artificial Sequence: Synthetic polypeptide
  VH of XENP019361
EVQLQQSGAELVRSGASVKLSCTASGFNIKDYYMHWVKQRPEQGLEWIGWIDPENGDTEYAPKFQGKATMTADTSSNTAYLQLSSLTSEDTAVYYCYARGVRQALDYWGQGTSVTVSS

SEQ ID NO: 21903 - protein, 5 aa, Artificial Sequence
  Description of Artificial Sequence: Synthetic peptide
  XENP019361 vhCDR1
DYYMH

SEQ ID NO: 21904 - protein, 17 aa, Artificial Sequence
  Description of Artificial Sequence: Synthetic peptide
  XENP019361 vhCDR2
WIDPENGDTEYAPKFQG

SEQ ID NO: 21905 - protein, 9 aa, Artificial Sequence
  Description of Artificial Sequence: Synthetic peptide
  XENP019361 vhCDR3
RGVRQALDY

SEQ ID NO: 21906 - protein, 214 aa, Artificial Sequence
  Description of Artificial Sequence: Synthetic polypeptide
  XENP019361 2A11_H0L0_IgG1_PVA_/S267K Light Chain
DIQMTQTTSSLSASLGDRVTISCRASQDIGNYLNWFQQKPDGTVKLLIYYTSRLHSGVPSRFSGSGSGTDYSLTISNLEQEDIATYFCQQGNTLPYTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 21907 - protein, 107 aa, Artificial Sequence
  Description of Artificial Sequence: Synthetic polypeptide
  VL of XENP019361
DIQMTQTTSSLSASLGDRVTISCRASQDIGNYLNWFQQKPDGTVKLLIYYTSRLHSGVPSRFSGSGSGTDYSLTISNLEQEDIATYFCQQGNTLPYTFGGGTKLEIK

SEQ ID NO: 21908 - protein, 11 aa, Artificial Sequence
  Description of Artificial Sequence: Synthetic peptide
  XENP019361 vlCDR1
RASQDIGNYLN

SEQ ID NO: 21909 - protein, 7 aa, Artificial Sequence
  Description of Artificial Sequence: Synthetic peptide
  XENP019361 vlCDR2
YTSRLHS

SEQ ID NO: 21910 - protein, 9 aa, Artificial Sequence
  Description of Artificial Sequence: Synthetic peptide
  XENP019361 vlCDR3
QQGNTLPYT

SEQ ID NO: 21911 - protein, 447 aa, Artificial Sequence; identical to SEQ ID NO: 2885
  Description of Artificial Sequence: Synthetic polypeptide
  XENP019362 2A11_H1L1_IgG1_PVA_/S267K Heavy Chain

SEQ ID NO: 21912 - protein, 118 aa, Artificial Sequence; identical to SEQ ID NO: 2686
  Description of Artificial Sequence: Synthetic polypeptide
  VH of XENP019362

SEQ ID NO: 21913 - protein, 5 aa, Artificial Sequence
  Description of Artificial Sequence: Synthetic peptide
  XENP019362 vhCDR1
DYYMH

SEQ ID NO: 21914 - protein, 17 aa, Artificial Sequence
  Description of Artificial Sequence: Synthetic peptide
  XENP019362 vhCDR2
WIDPENGDTEYAPKFQG

SEQ ID NO: 21915 - protein, 9 aa, Artificial Sequence
  Description of Artificial Sequence: Synthetic peptide
  XENP019362 vhCDR3
RGVRQALDY

SEQ ID NO: 21916 - protein, 214 aa, Artificial Sequence
  Description of Artificial Sequence: Synthetic polypeptide
  XENP019362 2A11_H1L1_IgG1_PVA_/S267K Light Chain
DIQMTQSPSSLSASVGDRVTITCRASQDIGNYLNWFQQKPGKTVKLLIYYTSRLHSGVPSRFSGSGSGTDYTLTISSLQPEDFATYFCQQGNTLPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 21917 - protein, 107 aa, Artificial Sequence
  Description of Artificial Sequence: Synthetic polypeptide
  VL of XENP019362
DIQMTQSPSSLSASVGDRVTITCRASQDIGNYLNWFQQKPGKTVKLLIYYTSRLHSGVPSRFSGSGSGTDYTLTISSLQPEDFATYFCQQGNTLPYTFGGGTKVEIK

SEQ ID NO: 21918 - protein, 11 aa, Artificial Sequence
  Description of Artificial Sequence: Synthetic peptide
  XENP019362 vlCDR1
RASQDIGNYLN

SEQ ID NO: 21919 - protein, 7 aa, Artificial Sequence
  Description of Artificial Sequence: Synthetic peptide
  XENP019362 vlCDR2
YTSRLHS

SEQ ID NO: 21920 - protein, 9 aa, Artificial Sequence
  Description of Artificial Sequence: Synthetic peptide
  XENP019362 vlCDR3
QQGNTLPYT

SEQ ID NO: 21921 - protein, 447 aa, Artificial Sequence; identical to SEQ ID NO: 2885
  Description of Artificial Sequence: Synthetic polypeptide
  XENP019363 2A11_H1L2_IgG1_PVA_/S267K Heavy Chain

SEQ ID NO: 21922 - protein, 118 aa, Artificial Sequence; identical to SEQ ID NO: 2686
  Description of Artificial Sequence: Synthetic polypeptide
  VH of XENP019363

SEQ ID NO: 21923 - protein, 5 aa, Artificial Sequence
  Description of Artificial Sequence: Synthetic peptide
  XENP019363 vhCDR1
DYYMH

SEQ ID NO: 21924 - protein, 17 aa, Artificial Sequence
  Description of Artificial Sequence: Synthetic peptide
  XENP019363 vhCDR2
WIDPENGDTEYAPKFQG

SEQ ID NO: 21925 - protein, 9 aa, Artificial Sequence
  Description of Artificial Sequence: Synthetic peptide
  XENP019363 vhCDR3
RGVRQALDY

SEQ ID NO: 21926 - protein, 214 aa, Artificial Sequence; identical to SEQ ID NO: 2880
  Description of Artificial Sequence: Synthetic polypeptide
  XENP019363 2A11_H1L2_IgG1_PVA_/S267K Light Chain

SEQ ID NO: 21927 - protein, 107 aa, Artificial Sequence; identical to SEQ ID NO: 2881
  Description of Artificial Sequence: Synthetic polypeptide
  VL of XENP019363

SEQ ID NO: 21928 - protein, 11 aa, Artificial Sequence
  Description of Artificial Sequence: Synthetic peptide
  XENP019363 vlCDR1
QASQDIGNYLN

SEQ ID NO: 21929 - protein, 7 aa, Artificial Sequence
  Description of Artificial Sequence: Synthetic peptide
  XENP019363 vlCDR2
YTSRLHS

SEQ ID NO: 21930 - protein, 9 aa, Artificial Sequence
  Description of Artificial Sequence: Synthetic peptide
  XENP019363 vlCDR3
QQGNTLPYT

SEQ ID NO: 21931 - protein, 446 aa, Artificial Sequence
  Description of Artificial Sequence: Synthetic polypeptide
  XENP019364 2A11_H2L1_IgG1_PVA_/S267K Heavy Chain
EVQLVQSGAEVKKPGATVKISCKASGFNIKDYYMHWVQQAPGKGLEWMGWIDPENGDTEYAPKFQGRVTITADTSTNTAYMELSSLRSEDTAVYYCARGVRQALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 21932 - protein, 117 aa, Artificial Sequence
  Description of Artificial Sequence: Synthetic polypeptide
  VH of XENP019364
EVQLVQSGAEVKKPGATVKISCKASGFNIKDYYMHWVQQAPGKGLEWMGWIDPENGDTEYAPKFQGRVTITADTSTNTAYMELSSLRSEDTAVYYCARGVRQALDYWGQGTLVTVSS

SEQ ID NO: 21933 - protein, 5 aa, Artificial Sequence
  Description of Artificial Sequence: Synthetic peptide
  XENP019364 vhCDR1
DYYMH

SEQ ID NO: 21934 - protein, 17 aa, Artificial Sequence
  Description of Artificial Sequence: Synthetic peptide
  XENP019364 vhCDR2
WIDPENGDTEYAPKFQG

SEQ ID NO: 21935 - protein, 8 aa, Artificial Sequence
  Description of Artificial Sequence: Synthetic peptide
  XENP019364 vhCDR3
GVRQALDY

SEQ ID NO: 21936 - protein, 214 aa, Artificial Sequence; identical to SEQ ID NO: 21916
  Description of Artificial Sequence: Synthetic polypeptide
  XENP019364 2A11_H2L1_IgG1_PVA_/S267K Light Chain

SEQ ID NO: 21937 - protein, 107 aa, Artificial Sequence; identical to SEQ ID NO: 21917
  Description of Artificial Sequence: Synthetic polypeptide
  VL of XENP019364

SEQ ID NO: 21938 - protein, 11 aa, Artificial Sequence
  Description of Artificial Sequence: Synthetic peptide
  XENP019364 vlCDR1
RASQDIGNYLN

SEQ ID NO: 21939 - protein, 7 aa, Artificial Sequence
  Description of Artificial Sequence: Synthetic peptide
  XENP019364 vlCDR2
YTSRLHS

SEQ ID NO: 21940 - protein, 9 aa, Artificial Sequence
  Description of Artificial Sequence: Synthetic peptide
  XENP019364 vlCDR3
QQGNTLPYT

SEQ ID NO: 21941 - protein, 446 aa, Artificial Sequence; identical to SEQ ID NO: 21931
  Description of Artificial Sequence: Synthetic polypeptide
  XENP019365 2A11_H2L2_IgG1_PVA_/S267K Heavy Chain

SEQ ID NO: 21942 - protein, 117 aa, Artificial Sequence; identical to SEQ ID NO: 21932
  Description of Artificial Sequence: Synthetic polypeptide
  VH of XENP019365

SEQ ID NO: 21943 - protein, 5 aa, Artificial Sequence
  Description of Artificial Sequence: Synthetic peptide
  XENP019365 vhCDR1
DYYMH

SEQ ID NO: 21944 - protein, 17 aa, Artificial Sequence
  Description of Artificial Sequence: Synthetic peptide
  XENP019365 vhCDR2
WIDPENGDTEYAPKFQG

SEQ ID NO: 21945 - protein, 8 aa, Artificial Sequence
  Description of Artificial Sequence: Synthetic peptide
  XENP019365 vhCDR3
GVRQALDY

SEQ ID NO: 21946 - protein, 214 aa, Artificial Sequence; identical to SEQ ID NO: 2880
  Description of Artificial Sequence: Synthetic polypeptide
  XENP019365 2A11_H2L2_IgG1_PVA_/S267K Light Chain

SEQ ID NO: 21947 - protein, 107 aa, Artificial Sequence; identical to SEQ ID NO: 2881
  Description of Artificial Sequence: Synthetic polypeptide
  VL of XENP019365

SEQ ID NO: 21948 - protein, 11 aa, Artificial Sequence
  Description of Artificial Sequence: Synthetic peptide
  XENP019365 vlCDR1
QASQDIGNYLN

SEQ ID NO: 21949 - protein, 7 aa, Artificial Sequence
  Description of Artificial Sequence: Synthetic peptide
  XENP019365 vlCDR2
YTSRLHS

SEQ ID NO: 21950 - protein, 9 aa, Artificial Sequence
  Description of Artificial Sequence: Synthetic peptide
  XENP019365 vlCDR3
QQGNTLPYT

SEQ ID NO: 21951 - protein, 447 aa, Artificial Sequence
  Description of Artificial Sequence: Synthetic polypeptide
  XENP019366 2A11_H3L1_IgG1_PVA_/S267K Heavy Chain
EVQLVESGGGVVQPGGSLRLSCAASGFNIKDYYMHWVRQAPGKGLEWVSWIDPENGDTEYAPSVKGRFTISADTSKNSAYLQMNSLRTEDTALYYCYARGVRQALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 21952 - protein, 118 aa, Artificial Sequence
  Description of Artificial Sequence: Synthetic polypeptide
  VH of XENP019366
EVQLVESGGGVVQPGGSLRLSCAASGFNIKDYYMHWVRQAPGKGLEWVSWIDPENGDTEYAPSVKGRFTISADTSKNSAYLQMNSLRTEDTALYYCYARGVRQALDYWGQGTLVTVSS

SEQ ID NO: 21953 - protein, 5 aa, Artificial Sequence
  Description of Artificial Sequence: Synthetic peptide
  XENP019366 vhCDR1
DYYMH

SEQ ID NO: 21954 - protein, 17 aa, Artificial Sequence
  Description of Artificial Sequence: Synthetic peptide
  XENP019366 vhCDR2
WIDPENGDTEYAPSVKG

SEQ ID NO: 21955 - protein, 9 aa, Artificial Sequence
  Description of Artificial Sequence: Synthetic peptide
  XENP019366 vhCDR3
RGVRQALDY

SEQ ID NO: 21956 - protein, 214 aa, Artificial Sequence; identical to SEQ ID NO: 21916
  Description of Artificial Sequence: Synthetic polypeptide
  XENP019366 2A11_H3L1_IgG1_PVA_/S267K Light Chain

SEQ ID NO: 21957 - protein, 107 aa, Artificial Sequence; identical to SEQ ID NO: 21917
  Description of Artificial Sequence: Synthetic polypeptide
  VL of XENP019366

SEQ ID NO: 21958 - protein, 11 aa, Artificial Sequence
  Description of Artificial Sequence: Synthetic peptide
  XENP019366 vlCDR1
RASQDIGNYLN

SEQ ID NO: 21959 - protein, 7 aa, Artificial Sequence
  Description of Artificial Sequence: Synthetic peptide
  XENP019366 vlCDR2
YTSRLHS

SEQ ID NO: 21960 - protein, 9 aa, Artificial Sequence
  Description of Artificial Sequence: Synthetic peptide
  XENP019366 vlCDR3
QQGNTLPYT

SEQ ID NO: 21961 - protein, 447 aa, Artificial Sequence; identical to SEQ ID NO: 21951
  Description of Artificial Sequence: Synthetic polypeptide
  XENP019367 2A11_H3L2_IgG1_PVA_/S267K Heavy Chain

SEQ ID NO: 21962 - protein, 118 aa, Artificial Sequence; identical to SEQ ID NO: 21952
  Description of Artificial Sequence: Synthetic polypeptide
  VH of XENP019367

SEQ ID NO: 21963 - protein, 5 aa, Artificial Sequence
  Description of Artificial Sequence: Synthetic peptide
  XENP019367 vhCDR1
DYYMH

SEQ ID NO: 21964 - protein, 17 aa, Artificial Sequence
  Description of Artificial Sequence: Synthetic peptide
  XENP019367 vhCDR2
WIDPENGDTEYAPSVKG

SEQ ID NO: 21965 - protein, 9 aa, Artificial Sequence
  Description of Artificial Sequence: Synthetic peptide
  XENP019367 vhCDR3
RGVRQALDY

SEQ ID NO: 21966 - protein, 214 aa, Artificial Sequence; identical to SEQ ID NO: 2880
  Description of Artificial Sequence: Synthetic polypeptide
  XENP019367 2A11_H3L2_IgG1_PVA_/S267K Light Chain

SEQ ID NO: 21967 - protein, 107 aa, Artificial Sequence; identical to SEQ ID NO: 2881
  Description of Artificial Sequence: Synthetic polypeptide
  VL of XENP019367

SEQ ID NO: 21968 - protein, 11 aa, Artificial Sequence
  Description of Artificial Sequence: Synthetic peptide
  XENP019367 vlCDR1
QASQDIGNYLN

SEQ ID NO: 21969 - protein, 7 aa, Artificial Sequence
  Description of Artificial Sequence: Synthetic peptide
  XENP019367 vlCDR2
YTSRLHS

SEQ ID NO: 21970 - protein, 9 aa, Artificial Sequence
  Description of Artificial Sequence: Synthetic peptide
  XENP019367 vlCDR3
QQGNTLPYT

SEQ ID NO: 21971 - protein, 446 aa, Artificial Sequence
  Description of Artificial Sequence: Synthetic polypeptide
  XENP019368 2A11_H4L1_IgG1_PVA_/S267K Heavy Chain
EVQLVESGGGVVQPGGSLRLSCAASGFNIKDYYMHWVRQAPGKGLEWVSWIDPENGDTEYAPSVKGRFTISADTSKNSAYLQMNSLRTEDTALYYCARGVRQALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 21972 - protein, 117 aa, Artificial Sequence
  Description of Artificial Sequence: Synthetic polypeptide
  VH of XENP019368
EVQLVESGGGVVQPGGSLRLSCAASGFNIKDYYMHWVRQAPGKGLEWVSWIDPENGDTEYAPSVKGRFTISADTSKNSAYLQMNSLRTEDTALYYCARGVRQALDYWGQGTLVTVSS

SEQ ID NO: 21973 - protein, 5 aa, Artificial Sequence
  Description of Artificial Sequence: Synthetic peptide
  XENP019368 vhCDR1
DYYMH

SEQ ID NO: 21974 - protein, 17 aa, Artificial Sequence
  Description of Artificial Sequence: Synthetic peptide
  XENP019368 vhCDR2
WIDPENGDTEYAPSVKG

SEQ ID NO: 21975 - protein, 8 aa, Artificial Sequence
  Description of Artificial Sequence: Synthetic peptide
  XENP019368 vhCDR3
GVRQALDY

SEQ ID NO: 21976 - protein, 214 aa, Artificial Sequence; identical to SEQ ID NO: 21916
  Description of Artificial Sequence: Synthetic polypeptide
  XENP019368 2A11_H4L1_IgG1_PVA_/S267K Light Chain

SEQ ID NO: 21977 - protein, 107 aa, Artificial Sequence; identical to SEQ ID NO: 21917
  Description of Artificial Sequence: Synthetic polypeptide
  VL of XENP019368

SEQ ID NO: 21978 - protein, 11 aa, Artificial Sequence
  Description of Artificial Sequence: Synthetic peptide
  XENP019368 vlCDR1
RASQDIGNYLN

SEQ ID NO: 21979 - protein, 7 aa, Artificial Sequence
  Description of Artificial Sequence: Synthetic peptide
  XENP019368 vlCDR2
YTSRLHS

SEQ ID NO: 21980 - protein, 9 aa, Artificial Sequence
  Description of Artificial Sequence: Synthetic peptide
  XENP019368 vlCDR3
QQGNTLPYT

SEQ ID NO: 21981 - protein, 446 aa, Artificial Sequence; identical to SEQ ID NO: 21971
  Description of Artificial Sequence: Synthetic polypeptide
  XENP019369 2A11_H4L2_IgG1_PVA_/S267K Heavy Chain

SEQ ID NO: 21982 - protein, 117 aa, Artificial Sequence; identical to SEQ ID NO: 21972
  Description of Artificial Sequence: Synthetic polypeptide
  VH of XENP019369

SEQ ID NO: 21983 - protein, 5 aa, Artificial Sequence
  Description of Artificial Sequence: Synthetic peptide
  XENP019369 vhCDR1
DYYMH

SEQ ID NO: 21984 - protein, 17 aa, Artificial Sequence
  Description of Artificial Sequence: Synthetic peptide
  XENP019369 vhCDR2
WIDPENGDTEYAPSVKG

SEQ ID NO: 21985 - protein, 8 aa, Artificial Sequence
  Description of Artificial Sequence: Synthetic peptide
  XENP019369 vhCDR3
GVRQALDY

SEQ ID NO: 21986 - protein, 214 aa, Artificial Sequence; identical to SEQ ID NO: 2880
  Description of Artificial Sequence: Synthetic polypeptide
  XENP019369 2A11_H4L2_IgG1_PVA_/S267K Light Chain

SEQ ID NO: 21987 - protein, 107 aa, Artificial Sequence; identical to SEQ ID NO: 2881
  Description of Artificial Sequence: Synthetic polypeptide
  VL of XENP019369

SEQ ID NO: 21988 - protein, 11 aa, Artificial Sequence
  Description of Artificial Sequence: Synthetic peptide
  XENP019369 vlCDR1
QASQDIGNYLN

SEQ ID NO: 21989 - protein, 7 aa, Artificial Sequence
  Description of Artificial Sequence: Synthetic peptide
  XENP019369 vlCDR2
YTSRLHS

SEQ ID NO: 21990 - protein, 9 aa, Artificial Sequence
  Description of Artificial Sequence: Synthetic peptide
  XENP019369 vlCDR3
QQGNTLPYT

SEQ ID NO: 21991 - protein, 445 aa, Artificial Sequence
  Description of Artificial Sequence: Synthetic polypeptide
  XENP019370 3F9_H1_7A6_L2_IgG1_PVA_/S267K Heavy Chain
QVQLQESGPGLVKPSQTLSLTCTVSDFSITSAYYWNWIRQPPGKKLEWIGYISYDSNYYNPSLKSRVTISRDTSKNQFSLKLSSVTAADTAVYYCARGGITTFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 21992 - protein, 116 aa, Artificial Sequence
  Description of Artificial Sequence: Synthetic polypeptide
  VH of XENP019370
QVQLQESGPGLVKPSQTLSLTCTVSDFSITSAYYWNWIRQPPGKKLEWIGYISYDSNYYNPSLKSRVTISRDTSKNQFSLKLSSVTAADTAVYYCARGGITTFDYWGQGTLVTVSS

SEQ ID NO: 21993 - protein, 6 aa, Artificial Sequence
  Description of Artificial Sequence: Synthetic peptide
  XENP019370 vhCDR1
SAYYWN

SEQ ID NO: 21994 - protein, 15 aa, Artificial Sequence
  Description of Artificial Sequence: Synthetic peptide
  XENP019370 vhCDR2
YISYDSNYYNPSLKS

SEQ ID NO: 21995 - protein, 8 aa, Artificial Sequence
  Description of Artificial Sequence: Synthetic peptide
  XENP019370 vhCDR3
GGITTFDY

SEQ ID NO: 21996 - protein, 218 aa, Artificial Sequence
  Description of Artificial Sequence: Synthetic polypeptide
  XENP019370 3F9_H1_7A6_L2_IgG1_PVA_/S267K Light Chain
DIVLTQSPATLSLSPGERATLSCRASQSVDYDGDSYMNWYQQKPGQPPRLLIYAASNLESGIPARFSGSGSGTDFTLTISSLEPEDFAVYYCQQSNEDPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 21997 - protein, 111 aa, Artificial Sequence
  Description of Artificial Sequence: Synthetic polypeptide
  VL of XENP019370
DIVLTQSPATLSLSPGERATLSCRASQSVDYDGDSYMNWYQQKPGQPPRLLIYAASNLESGIPARFSGSGSGTDFTLTISSLEPEDFAVYYCQQSNEDPRTFGGGTKVEIK

SEQ ID NO: 21998 - protein, 15 aa, Artificial Sequence
  Description of Artificial Sequence: Synthetic peptide
  XENP019370 vlCDR1
RASQSVDYDGDSYMN

SEQ ID NO: 21999 - protein, 7 aa, Artificial Sequence
  Description of Artificial Sequence: Synthetic peptide
  XENP019370 vlCDR2
AASNLES

SEQ ID NO: 22000 - protein, 9 aa, Artificial Sequence
  Description of Artificial Sequence: Synthetic peptide
  XENP019370 vlCDR3
QQSNEDPRT

SEQ ID NO: 22001 - protein, 444 aa, Artificial Sequence
  Description of Artificial Sequence: Synthetic polypeptide
  XENP019371 6A6_H1L1_IgG1_PVA_/S267K Heavy Chain
EVQLVQSGAEVKKPGATVKISCKASGFNIKDYYMHWVQQAPGKGLEWMGWIDPENGDTEYAPKFQGRVTITADTSTNTAYMELSSLRSEDTAVYYCARAAAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 22002 - protein, 115 aa, Artificial Sequence
  Description of Artificial Sequence: Synthetic polypeptide
  VH of XENP019371
EVQLVQSGAEVKKPGATVKISCKASGFNIKDYYMHWVQQAPGKGLEWMGWIDPENGDTEYAPKFQGRVTITADTSTNTAYMELSSLRSEDTAVYYCARAAAMDYWGQGTLVTVSS

SEQ ID NO: 22003 - protein, 5 aa, Artificial Sequence
  Description of Artificial Sequence: Synthetic peptide
  XENP019371 vhCDR1
DYYMH

SEQ ID NO: 22004 - protein, 17 aa, Artificial Sequence
  Description of Artificial Sequence: Synthetic peptide
  XENP019371 vhCDR2
WIDPENGDTEYAPKFQG

SEQ ID NO: 22005 - protein, 6 aa, Artificial Sequence
  Description of Artificial Sequence: Synthetic peptide
  XENP019371 vhCDR3
AAAMDY

SEQ ID NO: 22006 - protein, 214 aa, Artificial Sequence
  Description of Artificial Sequence: Synthetic polypeptide
  XENP019371 6A6_H1L1_IgG1_PVA_/S267K Light Chain
DIQMTQSPSSLSASVGDRVTITCRASQDISNYLNWFQQKPGKTFKLLIYYTSRLHSGVPSRFSGSGSGTDYTLTISSLQPEDFATYFCQQGNTLPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 22007 - protein, 107 aa, Artificial Sequence
  Description of Artificial Sequence: Synthetic polypeptide
  VL of XENP019371
DIQMTQSPSSLSASVGDRVTITCRASQDISNYLNWFQQKPGKTFKLLIYYTSRLHSGVPSRFSGSGSGTDYTLTISSLQPEDFATYFCQQGNTLPYTFGGGTKVEIK

SEQ ID NO: 22008 - protein, 11 aa, Artificial Sequence
  Description of Artificial Sequence: Synthetic peptide
  XENP019371 vlCDR1
RASQDISNYLN

SEQ ID NO: 22009 - protein, 7 aa, Artificial Sequence
  Description of Artificial Sequence: Synthetic peptide
  XENP019371 vlCDR2
YTSRLHS

SEQ ID NO: 22010 - protein, 9 aa, Artificial Sequence
  Description of Artificial Sequence: Synthetic peptide
  XENP019371 vlCDR3
QQGNTLPYT

SEQ ID NO: 22011 - protein, 444 aa, Artificial Sequence
  Description of Artificial Sequence: Synthetic polypeptide
  XENP019372 9E7_H0L0_IgG1_PVA_/S267K Heavy Chain
QVQLKQSGPGLVQPSQSLSITCTVSGFSLTRYGIHWVRQSPGKGLEWLGVIWSGVTDYNAAFISRLSISKDNSKSQVFFKLNSLQANDTAIYYCARPYYYAMDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 22012 - protein, 115 aa, Artificial Sequence
  Description of Artificial Sequence: Synthetic polypeptide
  VH of XENP019372
QVQLKQSGPGLVQPSQSLSITCTVSGFSLTRYGIHWVRQSPGKGLEWLGVIWSGVTDYNAAFISRLSISKDNSKSQVFFKLNSLQANDTAIYYCARPYYYAMDYWGQGTSVTVSS

SEQ ID NO: 22013 - protein, 5 aa, Artificial Sequence
  Description of Artificial Sequence: Synthetic peptide
  XENP019372 vhCDR1
RYGIH

SEQ ID NO: 22014 - protein, 15 aa, Artificial Sequence
  Description of Artificial Sequence: Synthetic peptide
  XENP019372 vhCDR2
VIWSGVTDYNAAFIS

SEQ ID NO: 22015 - protein, 8 aa, Artificial Sequence
  Description of Artificial Sequence: Synthetic peptide
  XENP019372 vhCDR3
PYYYAMDY

SEQ ID NO: 22016 - protein, 214 aa, Artificial Sequence
  Description of Artificial Sequence: Synthetic polypeptide
  XENP019372 9E7_H0L0_IgG1_PVA_/S267K Light Chain
DIQMTQSPASLSVSVGETVTITCRASENIYSNLAWYQQKQGKSPQLLVYAATTLADGVPSRFSGSGSGTQYSLKINSLQSEDFGSYYCQHFWGTPWTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 22017 - protein, 107 aa, Artificial Sequence
  Description of Artificial Sequence: Synthetic polypeptide
  VL of XENP019372
DIQMTQSPASLSVSVGETVTITCRASENIYSNLAWYQQKQGKSPQLLVYAATTLADGVPSRFSGSGSGTQYSLKINSLQSEDFGSYYCQHFWGTPWTFGGGTKLEIK

SEQ ID NO: 22018 - protein, 11 aa, Artificial Sequence
  Description of Artificial Sequence: Synthetic peptide
  XENP019372 vlCDR1
RASENIYSNLA

SEQ ID NO: 22019 - protein, 7 aa, Artificial Sequence
  Description of Artificial Sequence: Synthetic peptide
  XENP019372 vlCDR2
AATTLAD

SEQ ID NO: 22020 - protein, 9 aa, Artificial Sequence
  Description of Artificial Sequence: Synthetic peptide
  XENP019372 vlCDR3
QHFWGTPWT

SEQ ID NO: 22021 - protein, 444 aa, Artificial Sequence
  Description of Artificial Sequence: Synthetic polypeptide
  XENP019373 9E7_H1L1_IgG1_PVA_/S267K Heavy Chain
QVQLVQSGAEVKKPGASVKVSCKVSGFSLTRYGIHWVRQAPGQGLEWMGVIWSGVTDYNAKFQGRVTMTKDNSKSTVYMELSSLRSEDTAVYYCARPYYYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 22022 - protein, 115 aa, Artificial Sequence
  Description of Artificial Sequence: Synthetic polypeptide
  VH of XENP019373
QVQLVQSGAEVKKPGASVKVSCKVSGFSLTRYGIHWVRQAPGQGLEWMGVIWSGVTDYNAKFQGRVTMTKDNSKSTVYMELSSLRSEDTAVYYCARPYYYAMDYWGQGTLVTVSS

SEQ ID NO: 22023 - protein, 5 aa, Artificial Sequence
  Description of Artificial Sequence: Synthetic peptide
  XENP019373 vhCDR1
RYGIH

SEQ ID NO: 22024 - protein, 15 aa, Artificial Sequence
  Description of Artificial Sequence: Synthetic peptide
  XENP019373 vhCDR2
VIWSGVTDYNAKFQG

SEQ ID NO: 22025 - protein, 8 aa, Artificial Sequence
  Description of Artificial Sequence: Synthetic peptide
  XENP019373 vhCDR3
PYYYAMDY

SEQ ID NO: 22026 - protein, 214 aa, Artificial Sequence
  Description of Artificial Sequence: Synthetic polypeptide
  XENP019373 9E7_H1L1_IgG1_PVA_/S267K Light Chain
DIQMTQSPSSLSASVGDRVTITCRASENIYSNLAWYQQKPGKSPKLLVYAATTLADGVPSRFSGSGSGTDYTLTISSLQPEDFATYYCQHFWGTPWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 22027 - protein, 107 aa, Artificial Sequence
  Description of Artificial Sequence: Synthetic polypeptide
  VL of XENP019373
DIQMTQSPSSLSASVGDRVTITCRASENIYSNLAWYQQKPGKSPKLLVYAATTLADGVPSRFSGSGSGTDYTLTISSLQPEDFATYYCQHFWGTPWTFGGGTKVEIK

SEQ ID NO: 22028 - protein, 11 aa, Artificial Sequence
  Description of Artificial Sequence: Synthetic peptide
  XENP019373 vlCDR1
RASENIYSNLA

SEQ ID NO: 22029 - protein, 7 aa, Artificial Sequence
  Description of Artificial Sequence: Synthetic peptide
  XENP019373 vlCDR2
AATTLAD

SEQ ID NO: 22030 - protein, 9 aa, Artificial Sequence
  Description of Artificial Sequence: Synthetic peptide
  XENP019373 vlCDR3
QHFWGTPWT

SEQ ID NO: 22031 - protein, 444 aa, Artificial Sequence; identical to SEQ ID NO: 22021
  Description of Artificial Sequence: Synthetic polypeptide
  XENP019374 9E7_H1L2_IgG1_PVA_/S267K Heavy Chain

SEQ ID NO: 22032 - protein, 115 aa, Artificial Sequence; identical to SEQ ID NO: 22022
  Description of Artificial Sequence: Synthetic polypeptide
  VH of XENP019374

SEQ ID NO: 22033 - protein, 5 aa, Artificial Sequence
  Description of Artificial Sequence: Synthetic peptide
  XENP019374 vhCDR1
RYGIH

SEQ ID NO: 22034 - protein, 15 aa, Artificial Sequence
  Description of Artificial Sequence: Synthetic peptide
  XENP019374 vhCDR2
VIWSGVTDYNAKFQG

SEQ ID NO: 22035 - protein, 8 aa, Artificial Sequence
  Description of Artificial Sequence: Synthetic peptide
  XENP019374 vhCDR3
PYYYAMDY

SEQ ID NO: 22036 - protein, 214 aa, Artificial Sequence
  Description of Artificial Sequence: Synthetic polypeptide
  XENP019374 9E7_H1L2_IgG1_PVA_/S267K Light Chain
DIQMTQSPATLSVSPGERATLSCRASENIYSNLAWYQQKPGQSPRLLVYAATTLADGVPSRFSGSGSGTEYTLTISSLQSEDFAVYYCQHFWGTPWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 22037 - protein, 107 aa, Artificial Sequence
  Description of Artificial Sequence: Synthetic polypeptide
  VL of XENP019374
DIQMTQSPATLSVSPGERATLSCRASENIYSNLAWYQQKPGQSPRLLVYAATTLADGVPSRFSGSGSGTEYTLTISSLQSEDFAVYYCQHFWGTPWTFGGGTKVEIK

SEQ ID NO: 22038 - protein, 11 aa, Artificial Sequence
  Description of Artificial Sequence: Synthetic peptide
  XENP019374 vlCDR1
RASENIYSNLA

SEQ ID NO: 22039 - protein, 7 aa, Artificial Sequence
  Description of Artificial Sequence: Synthetic peptide
  XENP019374 vlCDR2
AATTLAD

SEQ ID NO: 22040 - protein, 9 aa, Artificial Sequence
  Description of Artificial Sequence: Synthetic peptide
  XENP019374 vlCDR3
QHFWGTPWT

SEQ ID NO: 22041 - protein, 444 aa, Artificial Sequence
  Description of Artificial Sequence: Synthetic polypeptide
  XENP019375 9E7_H2L1_IgG1_PVA_/S267K Heavy Chain
QVTLKESGPVLVKPTETLTLTCTVSGFSLTRYGIHWVRQPPGKGLEWLAVIWSGVTDYNPSLKSRLTISKDNSKSQVVLTMTNMDPVDTATYYCARPYYYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 22042 - protein, 115 aa, Artificial Sequence
  Description of Artificial Sequence: Synthetic polypeptide
  VH of XENP019375
QVTLKESGPVLVKPTETLTLTCTVSGFSLTRYGIHWVRQPPGKGLEWLAVIWSGVTDYNPSLKSRLTISKDNSKSQVVLTMTNMDPVDTATYYCARPYYYAMDYWGQGTLVTVSS

SEQ ID NO: 22043 - protein, 5 aa, Artificial Sequence
  Description of Artificial Sequence: Synthetic peptide
  XENP019375 vhCDR1
RYGIH

SEQ ID NO: 22044 - protein, 15 aa, Artificial Sequence
  Description of Artificial Sequence: Synthetic peptide
  XENP019375 vhCDR2
VIWSGVTDYNPSLKS

SEQ ID NO: 22045 - protein, 8 aa, Artificial Sequence
  Description of Artificial Sequence: Synthetic peptide
  XENP019375 vhCDR3
PYYYAMDY

SEQ ID NO: 22046 - protein, 214 aa, Artificial Sequence; identical to SEQ ID NO: 22026
  Description of Artificial Sequence: Synthetic polypeptide
  XENP019375 9E7_H2L1_IgG1_PVA_/S267K Light Chain

SEQ ID NO: 22047 - protein, 107 aa, Artificial Sequence; identical to SEQ ID NO: 22027
  Description of Artificial Sequence: Synthetic polypeptide
  VL of XENP019375

SEQ ID NO: 22048 - protein, 11 aa, Artificial Sequence
  Description of Artificial Sequence: Synthetic peptide
  XENP019375 vlCDR1
RASENIYSNLA

SEQ ID NO: 22049 - protein, 7 aa, Artificial Sequence
  Description of Artificial Sequence: Synthetic peptide
  XENP019375 vlCDR2
AATTLAD

SEQ ID NO: 22050 - protein, 9 aa, Artificial Sequence
  Description of Artificial Sequence: Synthetic peptide
  XENP019375 vlCDR3
QHFWGTPWT

SEQ ID NO: 22051 - protein, 444 aa, Artificial Sequence; identical to SEQ ID NO: 22041
  Description of Artificial Sequence: Synthetic polypeptide
  XENP019376 9E7_H2L2_IgG1_PVA_/S267K Heavy Chain

SEQ ID NO: 22052 - protein, 115 aa, Artificial Sequence; identical to SEQ ID NO: 22042
  Description of Artificial Sequence: Synthetic polypeptide
  VH of XENP019376

SEQ ID NO: 22053 - protein, 5 aa, Artificial Sequence
  Description of Artificial Sequence: Synthetic peptide
  XENP019376 vhCDR1
RYGIH

SEQ ID NO: 22054 - protein, 15 aa, Artificial Sequence
  Description of Artificial Sequence: Synthetic peptide
  XENP019376 vhCDR2
VIWSGVTDYNPSLKS

SEQ ID NO: 22055 - protein, 8 aa, Artificial Sequence
  Description of Artificial Sequence: Synthetic peptide
  XENP019376 vhCDR3
PYYYAMDY

SEQ ID NO: 22056 - protein, 214 aa, Artificial Sequence; identical to SEQ ID NO: 22036
  Description of Artificial Sequence: Synthetic polypeptide
  XENP019376 9E7_H2L2_IgG1_PVA_/S267K Light Chain

SEQ ID NO: 22057 - protein, 107 aa, Artificial Sequence; identical to SEQ ID NO: 22037
  Description of Artificial Sequence: Synthetic polypeptide
  VL of XENP019376

SEQ ID NO: 22058 - protein, 11 aa, Artificial Sequence
  Description of Artificial Sequence: Synthetic peptide
  XENP019376 vlCDR1
RASENIYSNLA

SEQ ID NO: 22059 - protein, 7 aa, Artificial Sequence
  Description of Artificial Sequence: Synthetic peptide
  XENP019376 vlCDR2
AATTLAD

SEQ ID NO: 22060 - protein, 9 aa, Artificial Sequence
  Description of Artificial Sequence: Synthetic peptide
  XENP019376 vlCDR3
QHFWGTPWT

SEQ ID NO: 22061 - protein, 444 aa, Artificial Sequence
  Description of Artificial Sequence: Synthetic polypeptide
  XENP019377 9E7_H3L1_IgG1_PVA_/S267K Heavy Chain
EVQLVESGGGLVQPGGSLRLSCAVSGFSLTRYGIHWVRQAPGKGLEWVSVIWSGVTDYNPSVKGRFTISKDNSKSTVYLQMNSLRAEDTAVYYCARPYYYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 22062 - protein, 115 aa, Artificial Sequence
  Description of Artificial Sequence: Synthetic polypeptide
  VH of XENP019377
EVQLVESGGGLVQPGGSLRLSCAVSGFSLTRYGIHWVRQAPGKGLEWVSVIWSGVTDYNPSVKGRFTISKDNSKSTVYLQMNSLRAEDTAVYYCARPYYYAMDYWGQGTLVTVSS

SEQ ID NO: 22063 - protein, 5 aa, Artificial Sequence
  Description of Artificial Sequence: Synthetic peptide
  XENP019377 vhCDR1
RYGIH

SEQ ID NO: 22064 - protein, 15 aa, Artificial Sequence
  Description of Artificial Sequence: Synthetic peptide
  XENP019377 vhCDR2
VIWSGVTDYNPSVKG

SEQ ID NO: 22065 - protein, 8 aa, Artificial Sequence
  Description of Artificial Sequence: Synthetic peptide
  XENP019377 vhCDR3
PYYYAMDY

SEQ ID NO: 22066 - protein, 214 aa, Artificial Sequence; identical to SEQ ID NO: 22026
  Description of Artificial Sequence: Synthetic polypeptide
  XENP019377 9E7_H3L1_IgG1_PVA_/S267K Light Chain

SEQ ID NO: 22067 - protein, 107 aa, Artificial Sequence; identical to SEQ ID NO: 22027
  Description of Artificial Sequence: Synthetic polypeptide
  VL of XENP019377

SEQ ID NO: 22068 - protein, 11 aa, Artificial Sequence
  Description of Artificial Sequence: Synthetic peptide
  XENP019377 vlCDR1
RASENIYSNLA

SEQ ID NO: 22069 - protein, 7 aa, Artificial Sequence
  Description of Artificial Sequence: Synthetic peptide
  XENP019377 vlCDR2
AATTLAD

SEQ ID NO: 22070 - protein, 9 aa, Artificial Sequence
  Description of Artificial Sequence: Synthetic peptide
  XENP019377 vlCDR3
QHFWGTPWT

SEQ ID NO: 22071 - protein, 444 aa, Artificial Sequence; identical to SEQ ID NO: 22061
  Description of Artificial Sequence: Synthetic polypeptide
  XENP019378 9E7_H3L2_IgG1_PVA_/S267K Heavy Chain

SEQ ID NO: 22072 - protein, 115 aa, Artificial Sequence; identical to SEQ ID NO: 22062
  Description of Artificial Sequence: Synthetic polypeptide
  VH of XENP019378

SEQ ID NO: 22073 - protein, 5 aa, Artificial Sequence
  Description of Artificial Sequence: Synthetic peptide
  XENP019378 vhCDR1
RYGIH

SEQ ID NO: 22074 - protein, 15 aa, Artificial Sequence
  Description of Artificial Sequence: Synthetic peptide
  XENP019378 vhCDR2
VIWSGVTDYNPSVKG

SEQ ID NO: 22075 - protein, 8 aa, Artificial Sequence
  Description of Artificial Sequence: Synthetic peptide
  XENP019378 vhCDR3
PYYYAMDY

SEQ ID NO: 22076 - protein, 214 aa, Artificial Sequence; identical to SEQ ID NO: 22036
  Description of Artificial Sequence: Synthetic polypeptide
  XENP019378 9E7_H3L2_IgG1_PVA_/S267K Light Chain

SEQ ID NO: 22077 - protein, 107 aa, Artificial Sequence; identical to SEQ ID NO: 22037
  Description of Artificial Sequence: Synthetic polypeptide
  VL of XENP019378

SEQ ID NO: 22078 - protein, 11 aa, Artificial Sequence
  Description of Artificial Sequence: Synthetic peptide
  XENP019378 vlCDR1
RASENIYSNLA

SEQ ID NO: 22079 - protein, 7 aa, Artificial Sequence
  Description of Artificial Sequence: Synthetic peptide
  XENP019378 vlCDR2
AATTLAD

SEQ ID NO: 22080 - protein, 9 aa, Artificial Sequence
  Description of Artificial Sequence: Synthetic peptide
  XENP019378 vlCDR3
QHFWGTPWT

SEQ ID NO: 22081 - protein, 444 aa, Artificial Sequence
  Description of Artificial Sequence: Synthetic polypeptide
  XENP019379 9E7_H4L1_IgG1_PVA_/S267K Heavy Chain
EVQLVQSGAEVKKPGESLKISCKVSGFSLTRYGIHWVRQMPGKGLEWMGVIWSGVTDYNPSFQGQVTISKDNSISTVYLQWSSLKASDTAMYYCARPYYYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 22082 - protein, 115 aa, Artificial Sequence
  Description of Artificial Sequence: Synthetic polypeptide
  VH of XENP019379
EVQLVQSGAEVKKPGESLKISCKVSGFSLTRYGIHWVRQMPGKGLEWMGVIWSGVTDYNPSFQGQVTISKDNSISTVYLQWSSLKASDTAMYYCARPYYYAMDYWGQGTLVTVSS

SEQ ID NO: 22083 - protein, 5 aa, Artificial Sequence
  Description of Artificial Sequence: Synthetic peptide
  XENP019379 vhCDR1
RYGIH

SEQ ID NO: 22084 - protein, 15 aa, Artificial Sequence
  Description of Artificial Sequence: Synthetic peptide
  XENP019379 vhCDR2
VIWSGVTDYNPSFQG

SEQ ID NO: 22085 - protein, 8 aa, Artificial Sequence
  Description of Artificial Sequence: Synthetic peptide
  XENP019379 vhCDR3
PYYYAMDY

SEQ ID NO: 22086 - protein, 214 aa, Artificial Sequence; identical to SEQ ID NO: 22026
  Description of Artificial Sequence: Synthetic polypeptide
  XENP019379 9E7_H4L1_IgG1_PVA_/S267K Light Chain

SEQ ID NO: 22087 - protein, 107 aa, Artificial Sequence; identical to SEQ ID NO: 22027
  Description of Artificial Sequence: Synthetic polypeptide
  VL of XENP019379

SEQ ID NO: 22088 - protein, 11 aa, Artificial Sequence
  Description of Artificial Sequence: Synthetic peptide
  XENP019379 vlCDR1
RASENIYSNLA

SEQ ID NO: 22089 - protein, 7 aa, Artificial Sequence
  Description of Artificial Sequence: Synthetic peptide
  XENP019379 vlCDR2
AATTLAD

SEQ ID NO: 22090 - protein, 9 aa, Artificial Sequence
  Description of Artificial Sequence: Synthetic peptide
  XENP019379 vlCDR3
QHFWGTPWT

SEQ ID NO: 22091 - protein, 444 aa, Artificial Sequence; identical to SEQ ID NO: 22081
  Description of Artificial Sequence: Synthetic polypeptide
  XENP019380 9E7_H4L2_IgG1_PVA_/S267K Heavy Chain

SEQ ID NO: 22092 - protein, 115 aa, Artificial Sequence; identical to SEQ ID NO: 22082
  Description of Artificial Sequence: Synthetic polypeptide
  VH of XENP019380

SEQ ID NO: 22093 - protein, 5 aa, Artificial Sequence
  Description of Artificial Sequence: Synthetic peptide
  XENP019380 vhCDR1
RYGIH

SEQ ID NO: 22094 - protein, 15 aa, Artificial Sequence
  Description of Artificial Sequence: Synthetic peptide
  XENP019380 vhCDR2
VIWSGVTDYNPSFQG

SEQ ID NO: 22095 - protein, 8 aa, Artificial Sequence
  Description of Artificial Sequence: Synthetic peptide
  XENP019380 vhCDR3
PYYYAMDY

SEQ ID NO: 22096 - protein, 214 aa, Artificial Sequence; identical to SEQ ID NO: 22036
  Description of Artificial Sequence: Synthetic polypeptide
  XENP019380 9E7_H4L2_IgG1_PVA_/S267K Light Chain

SEQ ID NO: 22097 - protein, 107 aa, Artificial Sequence; identical to SEQ ID NO: 22037
  Description of Artificial Sequence: Synthetic polypeptide
  VL of XENP019380

SEQ ID NO: 22098 - protein, 11 aa, Artificial Sequence
  Description of Artificial Sequence: Synthetic peptide
  XENP019380 vlCDR1
RASENIYSNLA

SEQ ID NO: 22099 - protein, 7 aa, Artificial Sequence
  Description of Artificial Sequence: Synthetic peptide
  XENP019380 vlCDR2
AATTLAD

SEQ ID NO: 22100 - protein, 9 aa, Artificial Sequence
  Description of Artificial Sequence: Synthetic peptide
  XENP019380 vlCDR3
QHFWGTPWT

SEQ ID NO: 22101 - protein, 447 aa, Artificial Sequence
  Description of Artificial Sequence: Synthetic polypeptide
  XENP019381 2A12_H1L1_IgG1_PVA_/S267K Heavy Chain
QIQLVQSGSELKKPGASVKVSCKASGYTFTNYGMNWVRQAPGQGLEWMGWINTYTGEPTYADGFTGRFVFSLDTSVSTAYLQISSLKAEDTAVYFCARLEAIYGSDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 22102 - protein, 118 aa, Artificial Sequence
  Description of Artificial Sequence: Synthetic polypeptide
  VH of XENP019381
QIQLVQSGSELKKPGASVKVSCKASGYTFTNYGMNWVRQAPGQGLEWMGWINTYTGEPTYADGFTGRFVFSLDTSVSTAYLQISSLKAEDTAVYFCARLEAIYGSDYWGQGTLVTVSS

SEQ ID NO: 22103 - protein, 5 aa, Artificial Sequence
  Description of Artificial Sequence: Synthetic peptide
  XENP019381 vhCDR1
NYGMN

SEQ ID NO: 22104 - protein, 17 aa, Artificial Sequence
  Description of Artificial Sequence: Synthetic peptide
  XENP019381 vhCDR2
WINTYTGEPTYADGFTG

SEQ ID NO: 22105 - protein, 9 aa, Artificial Sequence
  Description of Artificial Sequence: Synthetic peptide
  XENP019381 vhCDR3
LEAIYGSDY

SEQ ID NO: 22106 - protein, 214 aa, Artificial Sequence
  Description of Artificial Sequence: Synthetic polypeptide
  XENP019381 2A12_H1L1_IgG1_PVA_/S267K Light Chain
DIQMTQSPSSLSASVGDRVTITCRASQEISGYLSWLQQKPGKTIKRLIYAASTLDSGVPKRFSDSRSGSDYTLTISSLQPEDFATYYCLQYTSYPFTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 22107 - protein, 107 aa, Artificial Sequence
  Description of Artificial Sequence: Synthetic polypeptide
  VL of XENP019381
DIQMTQSPSSLSASVGDRVTITCRASQEISGYLSWLQQKPGKTIKRLIYAASTLDSGVPKRFSDSRSGSDYTLTISSLQPEDFATYYCLQYTSYPFTFGSGTKLEIK

SEQ ID NO: 22108 - protein, 11 aa, Artificial Sequence
  Description of Artificial Sequence: Synthetic peptide
  XENP019381 vlCDR1
RASQEISGYLS

SEQ ID NO: 22109 - protein, 7 aa, Artificial Sequence
  Description of Artificial Sequence: Synthetic peptide
  XENP019381 vlCDR2
AASTLDS

SEQ ID NO: 22110 - protein, 9 aa, Artificial Sequence
  Description of Artificial Sequence: Synthetic peptide
  XENP019381 vlCDR3
LQYTSYPFT

SEQ ID NO: 22111 - protein, 449 aa, Artificial Sequence
  Description of Artificial Sequence: Synthetic polypeptide
  XENP019382 4C8_H1L1_IgG1_PVA_/S267K Heavy Chain
QVQLVQSGAEVKKPGASVKVSCKASGYTFTDYNMHWVRQAPGQSLEWMGYIYPYTGGTGYNQKFQGRVTMTVDNSISTAYMELSRLRSDDTAVYYCARSDDGYSYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 22112 - protein, 120 aa, Artificial Sequence
  Description of Artificial Sequence: Synthetic polypeptide
  VH of XENP019382
QVQLVQSGAEVKKPGASVKVSCKASGYTFTDYNMHWVRQAPGQSLEWMGYIYPYTGGTGYNQKFQGRVTMTVDNSISTAYMELSRLRSDDTAVYYCARSDDGYSYAMDYWGQGTLVTVSS

SEQ ID NO: 22113 - protein, 5 aa, Artificial Sequence
  Description of Artificial Sequence: Synthetic peptide
  XENP019382 vhCDR1
DYNMH

SEQ ID NO: 22114 - protein, 17 aa, Artificial Sequence
  Description of Artificial Sequence: Synthetic peptide
  XENP019382 vhCDR2
YIYPYTGGTGYNQKFQG

SEQ ID NO: 22115 - protein, 11 aa, Artificial Sequence
  Description of Artificial Sequence: Synthetic peptide
  XENP019382 vhCDR3
SDDGYSYAMDY

SEQ ID NO: 22116 - protein, 213 aa, Artificial Sequence
  Description of Artificial Sequence: Synthetic polypeptide
  XENP019382 4C8_H1L1_IgG1_PVA_/S267K Light Chain
DIQMTQSPSSLSASVGDRVTITCQASQDISNYLNWYQQKPGKTVKLLIYYTSRLHSGVPSRFSGSGSGTDYTFTISSLQPEDIATYFCQQGNTLWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 22117 - protein, 106 aa, Artificial Sequence
  Description of Artificial Sequence: Synthetic polypeptide
  VL of XENP019382
DIQMTQSPSSLSASVGDRVTITCQASQDISNYLNWYQQKPGKTVKLLIYYTSRLHSGVPSRFSGSGSGTDYTFTISSLQPEDIATYFCQQGNTLWTFGGGTKVEIK

SEQ ID NO: 22118 - protein, 11 aa, Artificial Sequence
  Description of Artificial Sequence: Synthetic peptide
  XENP019382 vlCDR1
QASQDISNYLN

SEQ ID NO: 22119 - protein, 7 aa, Artificial Sequence
  Description of Artificial Sequence: Synthetic peptide
  XENP019382 vlCDR2
YTSRLHS

SEQ ID NO: 22120 - protein, 8 aa, Artificial Sequence
  Description of Artificial Sequence: Synthetic peptide
  XENP019382 vlCDR3
QQGNTLWT

SEQ ID NO: 22121 - protein, 445 aa, Artificial Sequence
  Description of Artificial Sequence: Synthetic polypeptide
  XENP019383 7A6_H0L0_IgG1_PVA_/S267K Heavy Chain
DVQLQESGPGLVKPSQSLSLTCSVTGYSITSGYFWNWIRQFPGNKLEWMGYISYDSNYYNPSLKNRISITRDTSKNQFFLKLNSVTTEDTATYYCARGGITTFDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 22122 - protein, 116 aa, Artificial Sequence
  Description of Artificial Sequence: Synthetic polypeptide
  VH of XENP019383
DVQLQESGPGLVKPSQSLSLTCSVTGYSITSGYFWNWIRQFPGNKLEWMGYISYDSNYYNPSLKNRISITRDTSKNQFFLKLNSVTTEDTATYYCARGGITTFDYWGQGTTLTVSS

SEQ ID NO: 22123 - protein, 6 aa, Artificial Sequence
  Description of Artificial Sequence: Synthetic peptide
  XENP019383 vhCDR1
SGYFWN

SEQ ID NO: 22124 - protein, 15 aa, Artificial Sequence
  Description of Artificial Sequence: Synthetic peptide
  XENP019383 vhCDR2
YISYDSNYYNPSLKN

SEQ ID NO: 22125 - protein, 8 aa, Artificial Sequence
  Description of Artificial Sequence: Synthetic peptide
  XENP019383 vhCDR3
GGITTFDY

SEQ ID NO: 22126 - protein, 218 aa, Artificial Sequence
  Description of Artificial Sequence: Synthetic polypeptide
  XENP019383 7A6_H0L0_IgG1_PVA_/S267K Light Chain
DIVLTQSPASLAVSLGQRATISCKASQSVDYDGDSYMNWYQQKPGQPPKLLIYAASNLESGIPARFSGSGSGTDFTLNIHPVEEEDAATYYCQQSNEDPRTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 22127 - protein, 111 aa, Artificial Sequence
  Description of Artificial Sequence: Synthetic polypeptide
  VL of XENP019383
DIVLTQSPASLAVSLGQRATISCKASQSVDYDGDSYMNWYQQKPGQPPKLLIYAASNLESGIPARFSGSGSGTDFTLNIHPVEEEDAATYYCQQSNEDPRTFGGGTKLEIK

SEQ ID NO: 22128 - protein, 15 aa, Artificial Sequence
  Description of Artificial Sequence: Synthetic peptide
  XENP019383 vlCDR1
KASQSVDYDGDSYMN

SEQ ID NO: 22129 - protein, 7 aa, Artificial Sequence
  Description of Artificial Sequence: Synthetic peptide
  XENP019383 vlCDR2
AASNLES

SEQ ID NO: 22130 - protein, 9 aa, Artificial Sequence
  Description of Artificial Sequence: Synthetic peptide
  XENP019383 vlCDR3
QQSNEDPRT

SEQ ID NO: 22131 - protein, 445 aa, Artificial Sequence
  Description of Artificial Sequence: Synthetic polypeptide
  XENP019384 7A6_H1L1_IgG1_PVA_/S267K Heavy Chain
QVQLVESGGGVVQPGRSLRLSCAVSGYSITSGYFWNWIRQAPGKKLEWVAYISYDSNYYNPSVKGRFTISRDTSKNTFYLQMNSLRAEDTAVYYCARGGITTFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 22132 - protein, 116 aa, Artificial Sequence
  Description of Artificial Sequence: Synthetic polypeptide
  VH of XENP019384
QVQLVESGGGVVQPGRSLRLSCAVSGYSITSGYFWNWIRQAPGKKLEWVAYISYDSNYYNPSVKGRFTISRDTSKNTFYLQMNSLRAEDTAVYYCARGGITTFDYWGQGTLVTVSS

SEQ ID NO: 22133 - protein, 6 aa, Artificial Sequence
  Description of Artificial Sequence: Synthetic peptide
  XENP019384 vhCDR1
SGYFWN

SEQ ID NO: 22134 - protein, 15 aa, Artificial Sequence
  Description of Artificial Sequence: Synthetic peptide
  XENP019384 vhCDR2
YISYDSNYYNPSVKG

SEQ ID NO: 22135 - protein, 8 aa, Artificial Sequence
  Description of Artificial Sequence: Synthetic peptide
  XENP019384 vhCDR3
GGITTFDY

SEQ ID NO: 22136 - protein, 218 aa, Artificial Sequence
  Description of Artificial Sequence: Synthetic polypeptide
  XENP019384 7A6_H1L1_IgG1_PVA_/S267K Light Chain
DIVLTQSPSSLSASVGDRVTITCRASQSVDYDGDSYMNWYQQKPGKPPKLLIYAASNLESGIPARFSGSGSGTDFTLTISSLQPEDFATYYCQQSNEDPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 22137 - protein, 111 aa, Artificial Sequence
  Description of Artificial Sequence: Synthetic polypeptide
  VL of XENP019384
DIVLTQSPSSLSASVGDRVTITCRASQSVDYDGDSYMNWYQQKPGKPPKLLIYAASNLESGIPARFSGSGSGTDFTLTISSLQPEDFATYYCQQSNEDPRTFGGGTKVEIK

SEQ ID NO: 22138 - protein, 15 aa, Artificial Sequence
  Description of Artificial Sequence: Synthetic peptide
  XENP019384 vlCDR1
RASQSVDYDGDSYMN

SEQ ID NO: 22139 - protein, 7 aa, Artificial Sequence
  Description of Artificial Sequence: Synthetic peptide
  XENP019384 vlCDR2
AASNLES

SEQ ID NO: 22140 - protein, 9 aa, Artificial Sequence
  Description of Artificial Sequence: Synthetic peptide
  XENP019384 vlCDR3
QQSNEDPRT

SEQ ID NO: 22141 - protein, 445 aa, Artificial Sequence; identical to SEQ ID NO: 22131
  Description of Artificial Sequence: Synthetic polypeptide
  XENP019385 7A6_H1L2_IgG1_PVA_/S267K Heavy Chain

SEQ ID NO: 22142 - protein, 116 aa, Artificial Sequence; identical to SEQ ID NO: 22132
  Description of Artificial Sequence: Synthetic polypeptide
  VH of XENP019385

SEQ ID NO: 22143 - protein, 6 aa, Artificial Sequence
  Description of Artificial Sequence: Synthetic peptide
  XENP019385 vhCDR1
SGYFWN

SEQ ID NO: 22144 - protein, 15 aa, Artificial Sequence
  Description of Artificial Sequence: Synthetic peptide
  XENP019385 vhCDR2
YISYDSNYYNPSVKG

SEQ ID NO: 22145 - protein, 8 aa, Artificial Sequence
  Description of Artificial Sequence: Synthetic peptide
  XENP019385 vhCDR3
GGITTFDY

SEQ ID NO: 22146 - protein, 218 aa, Artificial Sequence; identical to SEQ ID NO: 21996
  Description of Artificial Sequence: Synthetic polypeptide
  XENP019385 7A6_H1L2_IgG1_PVA_/S267K Light Chain

SEQ ID NO: 22147 - protein, 111 aa, Artificial Sequence; identical to SEQ ID NO: 21997
  Description of Artificial Sequence: Synthetic polypeptide
  VL of XENP019385

SEQ ID NO: 22148 - protein, 15 aa, Artificial Sequence
  Description of Artificial Sequence: Synthetic peptide
  XENP019385 vlCDR1
RASQSVDYDGDSYMN

SEQ ID NO: 22149 - protein, 7 aa, Artificial Sequence
  Description of Artificial Sequence: Synthetic peptide
  XENP019385 vlCDR2
AASNLES

SEQ ID NO: 22150 - protein, 9 aa, Artificial Sequence
  Description of Artificial Sequence: Synthetic peptide
  XENP019385 vlCDR3
QQSNEDPRT

SEQ ID NO: 22151 - protein, 445 aa, Artificial Sequence; identical to SEQ ID NO: 22131
  Description of Artificial Sequence: Synthetic polypeptide
  XENP019386 7A6_H1L3_IgG1_PVA_/S267K Heavy Chain

SEQ ID NO: 22152 - protein, 116 aa, Artificial Sequence; identical to SEQ ID NO: 22132
  Description of Artificial Sequence: Synthetic polypeptide
  VH of XENP019386

SEQ ID NO: 22153 - protein, 6 aa, Artificial Sequence
  Description of Artificial Sequence: Synthetic peptide
  XENP019386 vhCDR1
SGYFWN

SEQ ID NO: 22154 - protein, 15 aa, Artificial Sequence
  Description of Artificial Sequence: Synthetic peptide
  XENP019386 vhCDR2
YISYDSNYYNPSVKG

SEQ ID NO: 22155 - protein, 8 aa, Artificial Sequence
  Description of Artificial Sequence: Synthetic peptide
  XENP019386 vhCDR3
GGITTFDY

SEQ ID NO: 22156 - protein, 218 aa, Artificial Sequence
  Description of Artificial Sequence: Synthetic polypeptide
  XENP019386 7A6_H1L3_IgG1_PVA_/S267K Light Chain
DIVLTQSPDSLAVSLGERATINCKASQSVDYDGDSYMNWYQQKPGQPPKLLIYAASNLESGIPARFSGSGSGTDFTLTISSLQAEDVAVYYCQQSNEDPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 22157 - protein, 111 aa, Artificial Sequence
  Description of Artificial Sequence: Synthetic polypeptide
  VL of XENP019386
DIVLTQSPDSLAVSLGERATINCKASQSVDYDGDSYMNWYQQKPGQPPKLLIYAASNLESGIPARFSGSGSGTDFTLTISSLQAEDVAVYYCQQSNEDPRTFGGGTKVEIK

SEQ ID NO: 22158 - protein, 15 aa, Artificial Sequence
  Description of Artificial Sequence: Synthetic peptide
  XENP019386 vlCDR1
KASQSVDYDGDSYMN

SEQ ID NO: 22159 - protein, 7 aa, Artificial Sequence
  Description of Artificial Sequence: Synthetic peptide
  XENP019386 vlCDR2
AASNLES

SEQ ID NO: 22160 - protein, 9 aa, Artificial Sequence
  Description of Artificial Sequence: Synthetic peptide
  XENP019386 vlCDR3
QQSNEDPRT

SEQ ID NO: 22161 - protein, 445 aa, Artificial Sequence
  Description of Artificial Sequence: Synthetic polypeptide
  XENP019387 7A6_H2L1_IgG1_PVA_/S267K Heavy Chain
QVQLQESGPGLVKPSQTLSLTCTVSGYSITSGYFWNWIRQHPGKKLEWIGYISYDSNYYNPSLKSLVTISRDTSKNQFSLKLSSVTAADTAVYYCARGGITTFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 22162 - protein, 116 aa, Artificial Sequence
  Description of Artificial Sequence: Synthetic polypeptide
  VH of XENP019387
QVQLQESGPGLVKPSQTLSLTCTVSGYSITSGYFWNWIRQHPGKKLEWIGYISYDSNYYNPSLKSLVTISRDTSKNQFSLKLSSVTAADTAVYYCARGGITTFDYWGQGTLVTVSS

SEQ ID NO: 22163 - protein, 6 aa, Artificial Sequence
  Description of Artificial Sequence: Synthetic peptide
  XENP019387 vhCDR1
SGYFWN

SEQ ID NO: 22164 - protein, 15 aa, Artificial Sequence
  Description of Artificial Sequence: Synthetic peptide
  XENP019387 vhCDR2
YISYDSNYYNPSLKS

SEQ ID NO: 22165 - protein, 8 aa, Artificial Sequence
  Description of Artificial Sequence: Synthetic peptide
  XENP019387 vhCDR3
GGITTFDY

SEQ ID NO: 22166 - protein, 218 aa, Artificial Sequence; identical to SEQ ID NO: 22136
  Description of Artificial Sequence: Synthetic polypeptide
  XENP019387 7A6_H2L1_IgG1_PVA_/S267K Light Chain

SEQ ID NO: 22167 - protein, 111 aa, Artificial Sequence; identical to SEQ ID NO: 22137
  Description of Artificial Sequence: Synthetic polypeptide
  VL of XENP019387

SEQ ID NO: 22168 - protein, 15 aa, Artificial Sequence
  Description of Artificial Sequence: Synthetic peptide
  XENP019387 vlCDR1
RASQSVDYDGDSYMN

SEQ ID NO: 22169 - protein, 7 aa, Artificial Sequence
  Description of Artificial Sequence: Synthetic peptide
  XENP019387 vlCDR2
AASNLES

SEQ ID NO: 22170 - protein, 9 aa, Artificial Sequence
  Description of Artificial Sequence: Synthetic peptide
  XENP019387 vlCDR3
QQSNEDPRT

SEQ ID NO: 22171 - protein, 445 aa, Artificial Sequence; identical to SEQ ID NO: 22161
  Description of Artificial Sequence: Synthetic polypeptide
  XENP019388 7A6_H2L2_IgG1_PVA_/S267K Heavy Chain

SEQ ID NO: 22172 - protein, 116 aa, Artificial Sequence; identical to SEQ ID NO: 22162
  Description of Artificial Sequence: Synthetic polypeptide
  VH of XENP019388

SEQ ID NO: 22173 - protein, 6 aa, Artificial Sequence
  Description of Artificial Sequence: Synthetic peptide
  XENP019388 vhCDR1
SGYFWN

SEQ ID NO: 22174 - protein, 15 aa, Artificial Sequence
  Description of Artificial Sequence: Synthetic peptide
  XENP019388 vhCDR2
YISYDSNYYNPSLKS

SEQ ID NO: 22175 - protein, 8 aa, Artificial Sequence
  Description of Artificial Sequence: Synthetic peptide
  XENP019388 vhCDR3
GGITTFDY

SEQ ID NO: 22176 - protein, 218 aa, Artificial Sequence; identical to SEQ ID NO: 21996
  Description of Artificial Sequence: Synthetic polypeptide
  XENP019388 7A6_H2L2_IgG1_PVA_/S267K Light Chain

SEQ ID NO: 22177 - protein, 111 aa, Artificial Sequence; identical to SEQ ID NO: 21997
  Description of Artificial Sequence: Synthetic polypeptide
  VL of XENP019388

SEQ ID NO: 22178 - protein, 15 aa, Artificial Sequence
  Description of Artificial Sequence: Synthetic peptide
  XENP019388 vlCDR1
RASQSVDYDGDSYMN

SEQ ID NO: 22179 - protein, 7 aa, Artificial Sequence
  Description of Artificial Sequence: Synthetic peptide
  XENP019388 vlCDR2
AASNLES

SEQ ID NO: 22180 - protein, 9 aa, Artificial Sequence
  Description of Artificial Sequence: Synthetic peptide
  XENP019388 vlCDR3
QQSNEDPRT

SEQ ID NO: 22181 - protein, 445 aa, Artificial Sequence; identical to SEQ ID NO: 22161
  Description of Artificial Sequence: Synthetic polypeptide
  XENP019389 7A6_H2L3_IgG1_PVA_/S267K Heavy Chain

SEQ ID NO: 22182 - protein, 116 aa, Artificial Sequence; identical to SEQ ID NO: 22162
  Description of Artificial Sequence: Synthetic polypeptide
  VH of XENP019389

SEQ ID NO: 22183 - protein, 6 aa, Artificial Sequence
  Description of Artificial Sequence: Synthetic peptide
  XENP019389 vhCDR1
SGYFWN

SEQ ID NO: 22184 - protein, 15 aa, Artificial Sequence
  Description of Artificial Sequence: Synthetic peptide
  XENP019389 vhCDR2
YISYDSNYYNPSLKS

SEQ ID NO: 22185 - protein, 8 aa, Artificial Sequence
  Description of Artificial Sequence: Synthetic peptide
  XENP019389 vhCDR3
GGITTFDY

SEQ ID NO: 22186 - protein, 218 aa, Artificial Sequence; identical to SEQ ID NO: 22156
  Description of Artificial Sequence: Synthetic polypeptide
  XENP019389 7A6_H2L3_IgG1_PVA_/S267K Light Chain

SEQ ID NO: 22187 - protein, 111 aa, Artificial Sequence; identical to SEQ ID NO: 22157
  Description of Artificial Sequence: Synthetic polypeptide
  VL of XENP019389

SEQ ID NO: 22188 - protein, 15 aa, Artificial Sequence
  Description of Artificial Sequence: Synthetic peptide
  XENP019389 vlCDR1
KASQSVDYDGDSYMN

SEQ ID NO: 22189 - protein, 7 aa, Artificial Sequence
  Description of Artificial Sequence: Synthetic peptide
  XENP019389 vlCDR2
AASNLES

SEQ ID NO: 22190 - protein, 9 aa, Artificial Sequence
  Description of Artificial Sequence: Synthetic peptide
  XENP019389 vlCDR3
QQSNEDPRT

SEQ ID NO: 22191 - protein, 445 aa, Artificial Sequence
  Description of Artificial Sequence: Synthetic polypeptide
  XENP019390 7A6_H3L1_IgG1_PVA_/S267K Heavy Chain
QVQLQQSGPGLVKPSQTLSLTCAVSGYSITSGYFWNWIRQSPSRKLEWLGYISYDSNYYNPSVKSRITINRDTSKNQFSLQLNSVTPEDTAVYYCARGGITTFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 22192 - protein, 116 aa, Artificial Sequence
  Description of Artificial Sequence: Synthetic polypeptide
  VH of XENP019390
QVQLQQSGPGLVKPSQTLSLTCAVSGYSITSGYFWNWIRQSPSRKLEWLGYISYDSNYYNPSVKSRITINRDTSKNQFSLQLNSVTPEDTAVYYCARGGITTFDYWGQGTLVTVSS

SEQ ID NO: 22193 - protein, 6 aa, Artificial Sequence
  Description of Artificial Sequence: Synthetic peptide
  XENP019390 vhCDR1
SGYFWN

SEQ ID NO: 22194 - protein, 15 aa, Artificial Sequence
  Description of Artificial Sequence: Synthetic peptide
  XENP019390 vhCDR2
YISYDSNYYNPSVKS

SEQ ID NO: 22195 - protein, 8 aa, Artificial Sequence
  Description of Artificial Sequence: Synthetic peptide
  XENP019390 vhCDR3
GGITTFDY

SEQ ID NO: 22196 - protein, 218 aa, Artificial Sequence; identical to SEQ ID NO: 22136
  Description of Artificial Sequence: Synthetic polypeptide
  XENP019390 7A6_H3L1_IgG1_PVA_/S267K Light Chain

SEQ ID NO: 22197 - protein, 111 aa, Artificial Sequence; identical to SEQ ID NO: 22137
  Description of Artificial Sequence: Synthetic polypeptide
  VL of XENP019390

SEQ ID NO: 22198 - protein, 15 aa, Artificial Sequence
  Description of Artificial Sequence: Synthetic peptide
  XENP019390 vlCDR1
RASQSVDYDGDSYMN

SEQ ID NO: 22199 - protein, 7 aa, Artificial Sequence
  Description of Artificial Sequence: Synthetic peptide
  XENP019390 vlCDR2
AASNLES

SEQ ID NO: 22200 - protein, 9 aa, Artificial Sequence
  Description of Artificial Sequence: Synthetic peptide
  XENP019390 vlCDR3
QQSNEDPRT

SEQ ID NO: 22201 - protein, 445 aa, Artificial Sequence; identical to SEQ ID NO: 22191
  Description of Artificial Sequence: Synthetic polypeptide
  XENP019391 7A6_H3L2_IgG1_PVA_/S267K Heavy Chain

SEQ ID NO: 22202 - protein, 116 aa, Artificial Sequence; identical to SEQ ID NO: 22192
  Description of Artificial Sequence: Synthetic polypeptide
  VH of XENP019391

SEQ ID NO: 22203 - protein, 6 aa, Artificial Sequence
  Description of Artificial Sequence: Synthetic peptide
  XENP019391 vhCDR1
SGYFWN

SEQ ID NO: 22204 - protein, 15 aa, Artificial Sequence
  Description of Artificial Sequence: Synthetic peptide
  XENP019391 vhCDR2
YISYDSNYYNPSVKS

SEQ ID NO: 22205 - protein, 8 aa, Artificial Sequence
  Description of Artificial Sequence: Synthetic peptide
  XENP019391 vhCDR3
GGITTFDY

SEQ ID NO: 22206 - protein, 218 aa, Artificial Sequence; identical to SEQ ID NO: 21996
  Description of Artificial Sequence: Synthetic polypeptide
  XENP019391 7A6_H3L2_IgG1_PVA_/S267K Light Chain

SEQ ID NO: 22207 - protein, 111 aa, Artificial Sequence; identical to SEQ ID NO: 21997
  Description of Artificial Sequence: Synthetic polypeptide
  VL of XENP019391

SEQ ID NO: 22208 - protein, 15 aa, Artificial Sequence
  Description of Artificial Sequence: Synthetic peptide
  XENP019391 vlCDR1
RASQSVDYDGDSYMN

SEQ ID NO: 22209 - protein, 7 aa, Artificial Sequence
  Description of Artificial Sequence: Synthetic peptide
  XENP019391 vlCDR2
AASNLES

SEQ ID NO: 22210 - protein, 9 aa, Artificial Sequence
  Description of Artificial Sequence: Synthetic peptide
  XENP019391 vlCDR3
QQSNEDPRT

SEQ ID NO: 22211 - protein, 445 aa, Artificial Sequence; identical to SEQ ID NO: 22191
  Description of Artificial Sequence: Synthetic polypeptide
  XENP019392 7A6_H3L3_IgG1_PVA_/S267K Heavy Chain

SEQ ID NO: 22212 - protein, 116 aa, Artificial Sequence; identical to SEQ ID NO: 22192
  Description of Artificial Sequence: Synthetic polypeptide
  VH of XENP019392

SEQ ID NO: 22213 - protein, 6 aa, Artificial Sequence
  Description of Artificial Sequence: Synthetic peptide
  XENP019392 vhCDR1
SGYFWN

SEQ ID NO: 22214 - protein, 15 aa, Artificial Sequence
  Description of Artificial Sequence: Synthetic peptide
  XENP019392 vhCDR2
YISYDSNYYNPSVKS

SEQ ID NO: 22215 - protein, 8 aa, Artificial Sequence
  Description of Artificial Sequence: Synthetic peptide
  XENP019392 vhCDR3
GGITTFDY

SEQ ID NO: 22216 - protein, 218 aa, Artificial Sequence; identical to SEQ ID NO: 22156
  Description of Artificial Sequence: Synthetic polypeptide
  XENP019392 7A6_H3L3_IgG1_PVA_/S267K Light Chain

SEQ ID NO: 22217 - protein, 111 aa, Artificial Sequence; identical to SEQ ID NO: 22157
  Description of Artificial Sequence: Synthetic polypeptide
  VL of XENP019392

SEQ ID NO: 22218 - protein, 15 aa, Artificial Sequence
  Description of Artificial Sequence: Synthetic peptide
  XENP019392 vlCDR1
KASQSVDYDGDSYMN

SEQ ID NO: 22219 - protein, 7 aa, Artificial Sequence
  Description of Artificial Sequence: Synthetic peptide
  XENP019392 vlCDR2
AASNLES

SEQ ID NO: 22220 - protein, 9 aa, Artificial Sequence
  Description of Artificial Sequence: Synthetic peptide
  XENP019392 vlCDR3
QQSNEDPRT

SEQ ID NO: 22221 - protein, 447 aa, Artificial Sequence
  Description of Artificial Sequence: Synthetic polypeptide
  XENP019393 11B2_H1_1H11_L1_IgG1_PVA_/S267K Heavy Chain
QIQLVQSGSELKKPGASVKVSCKTSGYTFTNYGMNWVRQAPGQGLEWMGWINTYTGEPTYADGFTGRFVFSLDTSVSTAYLQISSLKAEDTAVYFCARGRGMGYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 22222 - protein, 118 aa, Artificial Sequence
  Description of Artificial Sequence: Synthetic polypeptide
  VH of XENP019393
QIQLVQSGSELKKPGASVKVSCKTSGYTFTNYGMNWVRQAPGQGLEWMGWINTYTGEPTYADGFTGRFVFSLDTSVSTAYLQISSLKAEDTAVYFCARGRGMGYFDYWGQGTLVTVSS

SEQ ID NO: 22223 - protein, 5 aa, Artificial Sequence
  Description of Artificial Sequence: Synthetic peptide
  XENP019393 vhCDR1
NYGMN

SEQ ID NO: 22224 - protein, 17 aa, Artificial Sequence
  Description of Artificial Sequence: Synthetic peptide
  XENP019393 vhCDR2
WINTYTGEPTYADGFTG

SEQ ID NO: 22225 - protein, 9 aa, Artificial Sequence
  Description of Artificial Sequence: Synthetic peptide
  XENP019393 vhCDR3
GRGMGYFDY

SEQ ID NO: 22226 - protein, 214 aa, Artificial Sequence; identical to SEQ ID NO: 21836
  Description of Artificial Sequence: Synthetic polypeptide
  XENP019393 11B2_H1_1H11_L1_IgG1_PVA_/S267K Light Chain

SEQ ID NO: 22227 - protein, 107 aa, Artificial Sequence; identical to SEQ ID NO: 21837
  Description of Artificial Sequence: Synthetic polypeptide
  VL of XENP019393

SEQ ID NO: 22228 - protein, 11 aa, Artificial Sequence
  Description of Artificial Sequence: Synthetic peptide
  XENP019393 vlCDR1
RASENIYSNLA

SEQ ID NO: 22229 - protein, 7 aa, Artificial Sequence
  Description of Artificial Sequence: Synthetic peptide
  XENP019393 vlCDR2
AATNLAD

SEQ ID NO: 22230 - protein, 9 aa, Artificial Sequence
  Description of Artificial Sequence: Synthetic peptide
  XENP019393 vlCDR3
QHFWTTPRT

SEQ ID NO: 22231 - protein, 447 aa, Artificial Sequence
  Description of Artificial Sequence: Synthetic polypeptide
  XENP019394 2D4_H1L1_IgG1_PVA_/S267K Heavy Chain
QIQLVQSGSELKKPGASVKVSCKASGYTFTNYGMNWVRQAPGQGLEWMGWINTYTGEPTYADGFTGRFVFSLDTSVSTAYLQISSLKAEDTAVYFCARGRGTGYFDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 22232 - protein, 118 aa, Artificial Sequence
  Description of Artificial Sequence: Synthetic polypeptide
  VH of XENP019394
QIQLVQSGSELKKPGASVKVSCKASGYTFTNYGMNWVRQAPGQGLEWMGWINTYTGEPTYADGFTGRFVFSLDTSVSTAYLQISSLKAEDTAVYFCARGRGTGYFDNWGQGTLVTVSS

SEQ ID NO: 22233 - protein, 5 aa, Artificial Sequence
  Description of Artificial Sequence: Synthetic peptide
  XENP019394 vhCDR1
NYGMN

SEQ ID NO: 22234 - protein, 17 aa, Artificial Sequence
  Description of Artificial Sequence: Synthetic peptide
  XENP019394 vhCDR2
WINTYTGEPTYADGFTG

SEQ ID NO: 22235 - protein, 9 aa, Artificial Sequence
  Description of Artificial Sequence: Synthetic peptide
  XENP019394 vhCDR3
GRGTGYFDN

SEQ ID NO: 22236 - protein, 214 aa, Artificial Sequence
  Description of Artificial Sequence: Synthetic polypeptide
  XENP019394 2D4_H1L1_IgG1_PVA_/S267K Light Chain
DIQMTQSPSSLSASVGDRVTITCRASENIYSNLAWYQQKPGKSPKLLVYAATNLADGVPSRFSGSGSGTDYTLTISSLQPEDFATYYCQHFWVTPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 22237 - protein, 107 aa, Artificial Sequence
  Description of Artificial Sequence: Synthetic polypeptide
  VL of XENP019394
DIQMTQSPSSLSASVGDRVTITCRASENIYSNLAWYQQKPGKSPKLLVYAATNLADGVPSRFSGSGSGTDYTLTISSLQPEDFATYYCQHFWVTPRTFGGGTKVEIK

SEQ ID NO: 22238 - protein, 11 aa, Artificial Sequence
  Description of Artificial Sequence: Synthetic peptide
  XENP019394 vlCDR1
RASENIYSNLA

SEQ ID NO: 22239 - protein, 7 aa, Artificial Sequence
  Description of Artificial Sequence: Synthetic peptide
  XENP019394 vlCDR2
AATNLAD

SEQ ID NO: 22240 - protein, 9 aa, Artificial Sequence
  Description of Artificial Sequence: Synthetic peptide
  XENP019394 vlCDR3
QHFWVTPRT

SEQ ID NO: 22241 - protein, 447 aa, Artificial Sequence
  Description of Artificial Sequence: Synthetic polypeptide
  XENP019395 4H9_H1L1_IgG1_PVA_/S267K Heavy Chain
QIQLVQSGSELKKPGASVKVSCKASEYAFINYGMNWVRQAPGQGLEWMGWINTYTGEPTYADGFTGRFVFSLDTSVSTAYLQISSLKAEDTAVYFCARGRGTGYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 22242 - protein, 118 aa, Artificial Sequence
  Description of Artificial Sequence: Synthetic polypeptide
  VH of XENP019395
QIQLVQSGSELKKPGASVKVSCKASEYAFINYGMNWVRQAPGQGLEWMGWINTYTGEPTYADGFTGRFVFSLDTSVSTAYLQISSLKAEDTAVYFCARGRGTGYFDYWGQGTLVTVSS

SEQ ID NO: 22243 - protein, 5 aa, Artificial Sequence
  Description of Artificial Sequence: Synthetic peptide
  XENP019395 vhCDR1
NYGMN

SEQ ID NO: 22244 - protein, 17 aa, Artificial Sequence
  Description of Artificial Sequence: Synthetic peptide
  XENP019395 vhCDR2
WINTYTGEPTYADGFTG

SEQ ID NO: 22245 - protein, 9 aa, Artificial Sequence
  Description of Artificial Sequence: Synthetic peptide
  XENP019395 vhCDR3
GRGTGYFDY

SEQ ID NO: 22246 - protein, 214 aa, Artificial Sequence
  Description of Artificial Sequence: Synthetic polypeptide
  XENP019395 4H9_H1L1_IgG1_PVA_/S267K Light Chain
DIVMTQSPSSLSASVGDRVTITCRASQDVSTAVAWYQQKPGKSPKLLIYSASYRYTGVPDRFSGSGSGTDFTLTISSLQPEDFATYSCQQHYSTSRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 22247 - protein, 107 aa, Artificial Sequence
  Description of Artificial Sequence: Synthetic polypeptide
  VL of XENP019395
DIVMTQSPSSLSASVGDRVTITCRASQDVSTAVAWYQQKPGKSPKLLIYSASYRYTGVPDRFSGSGSGTDFTLTISSLQPEDFATYSCQQHYSTSRTFGGGTKVEIK

SEQ ID NO: 22248 - protein, 11 aa, Artificial Sequence
  Description of Artificial Sequence: Synthetic peptide
  XENP019395 vlCDR1
RASQDVSTAVA

SEQ ID NO: 22249 - protein, 7 aa, Artificial Sequence
  Description of Artificial Sequence: Synthetic peptide
  XENP019395 vlCDR2
SASYRYT

SEQ ID NO: 22250 - protein, 9 aa, Artificial Sequence
  Description of Artificial Sequence: Synthetic peptide
  XENP019395 vlCDR3
QQHYSTSRT

SEQ ID NO: 22251 - protein, 447 aa, Artificial Sequence; identical to SEQ ID NO: 22241
  Description of Artificial Sequence: Synthetic polypeptide
  XENP019396 4H9_H1L2_IgG1_PVA_/S267K Heavy Chain

SEQ ID NO: 22252 - protein, 118 aa, Artificial Sequence; identical to SEQ ID NO: 22242
  Description of Artificial Sequence: Synthetic polypeptide
  VH of XENP019396

SEQ ID NO: 22253 - protein, 5 aa, Artificial Sequence
  Description of Artificial Sequence: Synthetic peptide
  XENP019396 vhCDR1
NYGMN

SEQ ID NO: 22254 - protein, 17 aa, Artificial Sequence
  Description of Artificial Sequence: Synthetic peptide
  XENP019396 vhCDR2
WINTYTGEPTYADGFTG

SEQ ID NO: 22255 - protein, 9 aa, Artificial Sequence
  Description of Artificial Sequence: Synthetic peptide
  XENP019396 vhCDR3
GRGTGYFDY

SEQ ID NO: 22256 - protein, 214 aa, Artificial Sequence
  Description of Artificial Sequence: Synthetic polypeptide
  XENP019396 4H9_H1L2_IgG1_PVA_/S267K Light Chain
DIVMTQSPDSLAVSLGERATINCKASQDVSTAVAWYQQKPGQSPKLLIYSASYRYTGVPDRFSGSGSGTDFTLTISSLQAEDVAVYSCQQHYSTSRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 22257 - protein, 107 aa, Artificial Sequence
  Description of Artificial Sequence: Synthetic polypeptide
  VL of XENP019396
DIVMTQSPDSLAVSLGERATINCKASQDVSTAVAWYQQKPGQSPKLLIYSASYRYTGVPDRFSGSGSGTDFTLTISSLQAEDVAVYSCQQHYSTSRTFGGGTKVEIK

SEQ ID NO: 22258 - protein, 11 aa, Artificial Sequence
  Description of Artificial Sequence: Synthetic peptide
  XENP019396 vlCDR1
KASQDVSTAVA

SEQ ID NO: 22259 - protein, 7 aa, Artificial Sequence
  Description of Artificial Sequence: Synthetic peptide
  XENP019396 vlCDR2
SASYRYT

SEQ ID NO: 22260 - protein, 9 aa, Artificial Sequence
  Description of Artificial Sequence: Synthetic peptide
  XENP019396 vlCDR3
QQHYSTSRT

SEQ ID NO: 22261 - protein, 450 aa, Artificial Sequence
  Description of Artificial Sequence: Synthetic polypeptide
  XENP019401 7G8_H0L0_IgG1_PVA_/S267K Heavy Chain
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 22262 - protein, 121 aa, Artificial Sequence
  Description of Artificial Sequence: Synthetic polypeptide
  VH of XENP019401
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLANWDWYFDVWGAGTTVTVSS

SEQ ID NO: 22263 - protein, 5 aa, Artificial Sequence
  Description of Artificial Sequence: Synthetic peptide
  XENP019401 vhCDR1
DAWMD

SEQ ID NO: 22264 - protein, 19 aa, Artificial Sequence
  Description of Artificial Sequence: Synthetic peptide
  XENP019401 vhCDR2
EIRTKANNHATYYAESVKG

SEQ ID NO: 22265 - protein, 10 aa, Artificial Sequence
  Description of Artificial Sequence: Synthetic peptide
  XENP019401 vhCDR3
LANWDWYFDV

SEQ ID NO: 22266 - protein, 218 aa, Artificial Sequence
  Description of Artificial Sequence: Synthetic polypeptide
  XENP019401 7G8_H0L0_IgG1_PVA_/S267K Light Chain
DTVLTQSPASLAVSLGQRATISCKASQSVDYDGDSYMNWYQQKPGQPPKLLIYAASNLESGIPARLSGSGSGTDFTLNIHPVEEEDAATYYCQQSNEDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 22267 - protein, 111 aa, Artificial Sequence
  Description of Artificial Sequence: Synthetic polypeptide
  VL of XENP019401
DTVLTQSPASLAVSLGQRATISCKASQSVDYDGDSYMNWYQQKPGQPPKLLIYAASNLESGIPARLSGSGSGTDFTLNIHPVEEEDAATYYCQQSNEDPFTFGSGTKLEVK

SEQ ID NO: 22268 - protein, 15 aa, Artificial Sequence
  Description of Artificial Sequence: Synthetic peptide
  XENP019401 vlCDR1
KASQSVDYDGDSYMN

SEQ ID NO: 22269 - protein, 7 aa, Artificial Sequence
  Description of Artificial Sequence: Synthetic peptide
  XENP019401 vlCDR2
AASNLES

SEQ ID NO: 22270 - protein, 9 aa, Artificial Sequence
  Description of Artificial Sequence: Synthetic peptide
  XENP019401 vlCDR3
QQSNEDPFT

SEQ ID NO: 22271 - protein, 450 aa, Artificial Sequence
  Description of Artificial Sequence: Synthetic polypeptide
  XENP019402 7G8_H1L1_IgG1_PVA_/S267K Heavy Chain
QVQLVQSGAEVKKPGASVKVSCKASGFTFSDAWMDWVRQAPGQGLEWMGEIRTKANNHATYYAEKFQGRVTMTRDDSTSTVYMELSSLRSEDTAVYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 22272 - protein, 121 aa, Artificial Sequence
  Description of Artificial Sequence: Synthetic polypeptide
  VH of XENP019402
QVQLVQSGAEVKKPGASVKVSCKASGFTFSDAWMDWVRQAPGQGLEWMGEIRTKANNHATYYAEKFQGRVTMTRDDSTSTVYMELSSLRSEDTAVYYCTRLANWDWYFDVWGAGTTVTVSS

SEQ ID NO: 22273 - protein, 5 aa, Artificial Sequence
  Description of Artificial Sequence: Synthetic peptide
  XENP019402 vhCDR1
DAWMD

SEQ ID NO: 22274 - protein, 19 aa, Artificial Sequence
  Description of Artificial Sequence: Synthetic peptide
  XENP019402 vhCDR2
EIRTKANNHATYYAEKFQG

SEQ ID NO: 22275 - protein, 10 aa, Artificial Sequence
  Description of Artificial Sequence: Synthetic peptide
  XENP019402 vhCDR3
LANWDWYFDV

SEQ ID NO: 22276 - protein, 218 aa, Artificial Sequence
  Description of Artificial Sequence: Synthetic polypeptide
  XENP019402 7G8_H1L1_IgG1_PVA_/S267K Light Chain
DTVLTQSPSSLSASVGDRVTITCRASQSVDYDGDSYMNWYQQKPGKPPKLLIYAASNLESGIPARLSGSGSGTDFTLTISSLQPEDFATYYCQQSNEDPFTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 22277 - protein, 111 aa, Artificial Sequence
  Description of Artificial Sequence: Synthetic polypeptide
  VL of XENP019402
DTVLTQSPSSLSASVGDRVTITCRASQSVDYDGDSYMNWYQQKPGKPPKLLIYAASNLESGIPARLSGSGSGTDFTLTISSLQPEDFATYYCQQSNEDPFTFGSGTKLEIK

SEQ ID NO: 22278 - protein, 15 aa, Artificial Sequence
  Description of Artificial Sequence: Synthetic peptide
  XENP019402 vlCDR1
RASQSVDYDGDSYMN

SEQ ID NO: 22279 - protein, 7 aa, Artificial Sequence
  Description of Artificial Sequence: Synthetic peptide
  XENP019402 vlCDR2
AASNLES

SEQ ID NO: 22280 - protein, 9 aa, Artificial Sequence
  Description of Artificial Sequence: Synthetic peptide
  XENP019402 vlCDR3
QQSNEDPFT

SEQ ID NO: 22281 - protein, 450 aa, Artificial Sequence; identical to SEQ ID NO: 22271
  Description of Artificial Sequence: Synthetic polypeptide
  XENP019403 7G8_H1L2_IgG1_PVA_/S267K Heavy Chain

SEQ ID NO: 22282 - protein, 121 aa, Artificial Sequence; identical to SEQ ID NO: 22272
  Description of Artificial Sequence: Synthetic polypeptide
  VH of XENP019403

SEQ ID NO: 22283 - protein, 5 aa, Artificial Sequence
  Description of Artificial Sequence: Synthetic peptide
  XENP019403 vhCDR1
DAWMD

SEQ ID NO: 22284 - protein, 19 aa, Artificial Sequence
  Description of Artificial Sequence: Synthetic peptide
  XENP019403 vhCDR2
EIRTKANNHATYYAEKFQG

SEQ ID NO: 22285 - protein, 10 aa, Artificial Sequence
  Description of Artificial Sequence: Synthetic peptide
  XENP019403 vhCDR3
LANWDWYFDV

SEQ ID NO: 22286 - protein, 218 aa, Artificial Sequence
  Description of Artificial Sequence: Synthetic polypeptide
  XENP019403 7G8_H1L2_IgG1_PVA_/S267K Light Chain
DTVLTQSPATLSLSPGERATLSCRASQSVDYDGDSYMNWYQQKPGQPPRLLIYAASNLESGIPARLSGSGSGTDFTLTISSLEPEDFAVYYCQQSNEDPFTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 22287 - protein, 111 aa, Artificial Sequence
  Description of Artificial Sequence: Synthetic polypeptide
  VL of XENP019403
DTVLTQSPATLSLSPGERATLSCRASQSVDYDGDSYMNWYQQKPGQPPRLLIYAASNLESGIPARLSGSGSGTDFTLTISSLEPEDFAVYYCQQSNEDPFTFGSGTKLEIK

SEQ ID NO: 22288 - protein, 15 aa, Artificial Sequence
  Description of Artificial Sequence: Synthetic peptide
  XENP019403 vlCDR1
RASQSVDYDGDSYMN

SEQ ID NO: 22289 - protein, 7 aa, Artificial Sequence
  Description of Artificial Sequence: Synthetic peptide
  XENP019403 vlCDR2
AASNLES

SEQ ID NO: 22290 - protein, 9 aa, Artificial Sequence
  Description of Artificial Sequence: Synthetic peptide
  XENP019403 vlCDR3
QQSNEDPFT

SEQ ID NO: 22291 - protein, 450 aa, Artificial Sequence; identical to SEQ ID NO: 22271
  Description of Artificial Sequence: Synthetic polypeptide
  XENP019404 7G8_H1L3_IgG1_PVA_/S267K Heavy Chain

SEQ ID NO: 22292 - protein, 121 aa, Artificial Sequence; identical to SEQ ID NO: 22272
  Description of Artificial Sequence: Synthetic polypeptide
  VH of XENP019404

SEQ ID NO: 22293 - protein, 5 aa, Artificial Sequence
  Description of Artificial Sequence: Synthetic peptide
  XENP019404 vhCDR1
DAWMD

SEQ ID NO: 22294 - protein, 19 aa, Artificial Sequence
  Description of Artificial Sequence: Synthetic peptide
  XENP019404 vhCDR2
EIRTKANNHATYYAEKFQG

SEQ ID NO: 22295 - protein, 10 aa, Artificial Sequence
  Description of Artificial Sequence: Synthetic peptide
  XENP019404 vhCDR3
LANWDWYFDV

SEQ ID NO: 22296 - protein, 218 aa, Artificial Sequence
  Description of Artificial Sequence: Synthetic polypeptide
  XENP019404 7G8_H1L3_IgG1_PVA_/S267K Light Chain
DTVLTQSPDSLAVSLGERATINCKASQSVDYDGDSYMNWYQQKPGQPPKLLIYAASNLESGIPARLSGSGSGTDFTLTISSLQAEDVAVYYCQQSNEDPFTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 22297 - protein, 111 aa, Artificial Sequence
  Description of Artificial Sequence: Synthetic polypeptide
  VL of XENP019404
DTVLTQSPDSLAVSLGERATINCKASQSVDYDGDSYMNWYQQKPGQPPKLLIYAASNLESGIPARLSGSGSGTDFTLTISSLQAEDVAVYYCQQSNEDPFTFGSGTKLEIK

SEQ ID NO: 22298 - protein, 15 aa, Artificial Sequence
  Description of Artificial Sequence: Synthetic peptide
  XENP019404 vlCDR1
KASQSVDYDGDSYMN

SEQ ID NO: 22299 - protein, 7 aa, Artificial Sequence
  Description of Artificial Sequence: Synthetic peptide
  XENP019404 vlCDR2
AASNLES

SEQ ID NO: 22300 - protein, 9 aa, Artificial Sequence
  Description of Artificial Sequence: Synthetic peptide
  XENP019404 vlCDR3
QQSNEDPFT

SEQ ID NO: 22301 - protein, 450 aa, Artificial Sequence
  Description of Artificial Sequence: Synthetic polypeptide
  XENP019405 7G8_H2L1_IgG1_PVA_/S267K Heavy Chain
EVQLVESGGGLVQPGGSLRLSCAASGFTFSDAWMDWVRQAPGKGLEWVGEIRTKANNHATYYAESVKGRFTISRDDSKSSVYLQMNSLKTEDTAVYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 22302 - protein, 121 aa, Artificial Sequence
  Description of Artificial Sequence: Synthetic polypeptide
  VH of XENP019405
EVQLVESGGGLVQPGGSLRLSCAASGFTFSDAWMDWVRQAPGKGLEWVGEIRTKANNHATYYAESVKGRFTISRDDSKSSVYLQMNSLKTEDTAVYYCTRLANWDWYFDVWGAGTTVTVSS

SEQ ID NO: 22303 - protein, 5 aa, Artificial Sequence
  Description of Artificial Sequence: Synthetic peptide
  XENP019405 vhCDR1
DAWMD

SEQ ID NO: 22304 - protein, 19 aa, Artificial Sequence
  Description of Artificial Sequence: Synthetic peptide
  XENP019405 vhCDR2
EIRTKANNHATYYAESVKG

SEQ ID NO: 22305 - protein, 10 aa, Artificial Sequence
  Description of Artificial Sequence: Synthetic peptide
  XENP019405 vhCDR3
LANWDWYFDV

SEQ ID NO: 22306 - protein, 218 aa, Artificial Sequence; identical to SEQ ID NO: 22276
  Description of Artificial Sequence: Synthetic polypeptide
  XENP019405 7G8_H2L1_IgG1_PVA_/S267K Light Chain

SEQ ID NO: 22307 - protein, 111 aa, Artificial Sequence; identical to SEQ ID NO: 22277
  Description of Artificial Sequence: Synthetic polypeptide
  VL of XENP019405

SEQ ID NO: 22308 - protein, 15 aa, Artificial Sequence
  Description of Artificial Sequence: Synthetic peptide
  XENP019405 vlCDR1
RASQSVDYDGDSYMN

SEQ ID NO: 22309 - protein, 7 aa, Artificial Sequence
  Description of Artificial Sequence: Synthetic peptide
  XENP019405 vlCDR2
AASNLES

SEQ ID NO: 22310 - protein, 9 aa, Artificial Sequence
  Description of Artificial Sequence: Synthetic peptide
  XENP019405 vlCDR3
QQSNEDPFT

SEQ ID NO: 22311 - protein, 450 aa, Artificial Sequence; identical to SEQ ID NO: 22301
  Description of Artificial Sequence: Synthetic polypeptide
  XENP019406 7G8_H2L2_IgG1_PVA_/S267K Heavy Chain

SEQ ID NO: 22312 - protein, 121 aa, Artificial Sequence; identical to SEQ ID NO: 22302
  Description of Artificial Sequence: Synthetic polypeptide
  VH of XENP019406

SEQ ID NO: 22313 - protein, 5 aa, Artificial Sequence
  Description of Artificial Sequence: Synthetic peptide
  XENP019406 vhCDR1
DAWMD

SEQ ID NO: 22314 - protein, 19 aa, Artificial Sequence
  Description of Artificial Sequence: Synthetic peptide
  XENP019406 vhCDR2
EIRTKANNHATYYAESVKG

SEQ ID NO: 22315 - protein, 10 aa, Artificial Sequence
  Description of Artificial Sequence: Synthetic peptide
  XENP019406 vhCDR3
LANWDWYFDV

SEQ ID NO: 22316 - protein, 218 aa, Artificial Sequence; identical to SEQ ID NO: 22286
  Description of Artificial Sequence: Synthetic polypeptide
  XENP019406 7G8_H2L2_IgG1_PVA_/S267K Light Chain

SEQ ID NO: 22317 - protein, 111 aa, Artificial Sequence; identical to SEQ ID NO: 22287
  Description of Artificial Sequence: Synthetic polypeptide
  VL of XENP019406

SEQ ID NO: 22318 - protein, 15 aa, Artificial Sequence
  Description of Artificial Sequence: Synthetic peptide
  XENP019406 vlCDR1
RASQSVDYDGDSYMN

SEQ ID NO: 22319 - protein, 7 aa, Artificial Sequence
  Description of Artificial Sequence: Synthetic peptide
  XENP019406 vlCDR2
AASNLES

SEQ ID NO: 22320 - protein, 9 aa, Artificial Sequence
  Description of Artificial Sequence: Synthetic peptide
  XENP019406 vlCDR3
QQSNEDPFT

SEQ ID NO: 22321 - protein, 450 aa, Artificial Sequence; identical to SEQ ID NO: 22301
  Description of Artificial Sequence: Synthetic polypeptide
  XENP019407 7G8_H2L3_IgG1_PVA_/S267K Heavy Chain

SEQ ID NO: 22322 - protein, 121 aa, Artificial Sequence; identical to SEQ ID NO: 22302
  Description of Artificial Sequence: Synthetic polypeptide
  VH of XENP019407

SEQ ID NO: 22323 - protein, 5 aa, Artificial Sequence
  Description of Artificial Sequence: Synthetic peptide
  XENP019407 vhCDR1
DAWMD

SEQ ID NO: 22324 - protein, 19 aa, Artificial Sequence
  Description of Artificial Sequence: Synthetic peptide
  XENP019407 vhCDR2
EIRTKANNHATYYAESVKG

SEQ ID NO: 22325 - protein, 10 aa, Artificial Sequence
  Description of Artificial Sequence: Synthetic peptide
  XENP019407 vhCDR3
LANWDWYFDV

SEQ ID NO: 22326 - protein, 218 aa, Artificial Sequence; identical to SEQ ID NO: 22296
  Description of Artificial Sequence: Synthetic polypeptide
  XENP019407 7G8_H2L3_IgG1_PVA_/S267K Light Chain

SEQ ID NO: 22327 - protein, 111 aa, Artificial Sequence; identical to SEQ ID NO: 22297
  Description of Artificial Sequence: Synthetic polypeptide
  VL of XENP019407

SEQ ID NO: 22328 - protein, 15 aa, Artificial Sequence
  Description of Artificial Sequence: Synthetic peptide
  XENP019407 vlCDR1
KASQSVDYDGDSYMN

SEQ ID NO: 22329 - protein, 7 aa, Artificial Sequence
  Description of Artificial Sequence: Synthetic peptide
  XENP019407 vlCDR2
AASNLES

SEQ ID NO: 22330 - protein, 9 aa, Artificial Sequence
  Description of Artificial Sequence: Synthetic peptide
  XENP019407 vlCDR3
QQSNEDPFT

SEQ ID NO: 22331 - protein, 446 aa, Artificial Sequence
  Description of Artificial Sequence: Synthetic polypeptide
  XENP019408 11C12_H1L1_IgG1_PVA_/S267K Heavy Chain
EVQLVESGGGLVQPGGSLRLSCAASGFTFSSFGMHWVRQAPGKGLEWVSYISSDSSTFSYADSVKGRFTISRDNAKNSLYLQMNSLRAEDTAVYYCARYYYGYVDFWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 22332 - protein, 117 aa, Artificial Sequence
  Description of Artificial Sequence: Synthetic polypeptide
  VH of XENP019408
EVQLVESGGGLVQPGGSLRLSCAASGFTFSSFGMHWVRQAPGKGLEWVSYISSDSSTFSYADSVKGRFTISRDNAKNSLYLQMNSLRAEDTAVYYCARYYYGYVDFWGQGTTVTVSS

SEQ ID NO: 22333 - protein, 5 aa, Artificial Sequence
  Description of Artificial Sequence: Synthetic peptide
  XENP019408 vhCDR1
SFGMH

SEQ ID NO: 22334 - protein, 17 aa, Artificial Sequence
  Description of Artificial Sequence: Synthetic peptide
  XENP019408 vhCDR2
YISSDSSTFSYADSVKG

SEQ ID NO: 22335 - protein, 8 aa, Artificial Sequence
  Description of Artificial Sequence: Synthetic peptide
  XENP019408 vhCDR3
YYYGYVDF

SEQ ID NO: 22336 - protein, 214 aa, Artificial Sequence
  Description of Artificial Sequence: Synthetic polypeptide
  XENP019408 11C12_H1L1_IgG1_PVA_/S267K Light Chain
DIQMTQSPSSLSASVGDRVTITCRASEDIYNRLAWYQQKPGKAPKLLISGATSFETGVPSRFSGSGSGKDYTLTISSLQPEDFATYYCQQYWSTPWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 22337 - protein, 107 aa, Artificial Sequence
  Description of Artificial Sequence: Synthetic polypeptide
  VL of XENP019408
DIQMTQSPSSLSASVGDRVTITCRASEDIYNRLAWYQQKPGKAPKLLISGATSFETGVPSRFSGSGSGKDYTLTISSLQPEDFATYYCQQYWSTPWTFGGGTKVEIK

SEQ ID NO: 22338 - protein, 11 aa, Artificial Sequence
  Description of Artificial Sequence: Synthetic peptide
  XENP019408 vlCDR1
RASEDIYNRLA

SEQ ID NO: 22339 - protein, 7 aa, Artificial Sequence
  Description of Artificial Sequence: Synthetic peptide
  XENP019408 vlCDR2
GATSFET

SEQ ID NO: 22340 - protein, 9 aa, Artificial Sequence
  Description of Artificial Sequence: Synthetic peptide
  XENP019408 vlCDR3
QQYWSTPWT

SEQ ID NO: 22341 - protein, 447 aa, Artificial Sequence; identical to SEQ ID NO: 2885
  Description of Artificial Sequence: Synthetic polypeptide
  XENP020023 2A11_H1L0_IgG1_PVA_/S267K Heavy Chain

SEQ ID NO: 22342 - protein, 118 aa, Artificial Sequence; identical to SEQ ID NO: 2686
  Description of Artificial Sequence: Synthetic polypeptide
  VH of XENP020023

SEQ ID NO: 22343 - protein, 5 aa, Artificial Sequence
  Description of Artificial Sequence: Synthetic peptide
  XENP020023 vhCDR1
DYYMH

SEQ ID NO: 22344 - protein, 17 aa, Artificial Sequence
  Description of Artificial Sequence: Synthetic peptide
  XENP020023 vhCDR2
WIDPENGDTEYAPKFQG

SEQ ID NO: 22345 - protein, 9 aa, Artificial Sequence
  Description of Artificial Sequence: Synthetic peptide
  XENP020023 vhCDR3
RGVRQALDY

SEQ ID NO: 22346 - protein, 214 aa, Artificial Sequence; identical to SEQ ID NO: 21906
  Description of Artificial Sequence: Synthetic polypeptide
  XENP020023 2A11_H1L0_IgG1_PVA_/S267K Light Chain

SEQ ID NO: 22347 - protein, 107 aa, Artificial Sequence; identical to SEQ ID NO: 21907
  Description of Artificial Sequence: Synthetic polypeptide
  VL of XENP020023

SEQ ID NO: 22348 - protein, 11 aa, Artificial Sequence
  Description of Artificial Sequence: Synthetic peptide
  XENP020023 vlCDR1
RASQDIGNYLN

SEQ ID NO: 22349 - protein, 7 aa, Artificial Sequence
  Description of Artificial Sequence: Synthetic peptide
  XENP020023 vlCDR2
YTSRLHS

SEQ ID NO: 22350 - protein, 9 aa, Artificial Sequence
  Description of Artificial Sequence: Synthetic peptide
  XENP020023 vlCDR3
QQGNTLPYT

SEQ ID NO: 22351 - protein, 447 aa, Artificial Sequence; identical to SEQ ID NO: 21901
  Description of Artificial Sequence: Synthetic polypeptide
  XENP020024 2A11_H0L1_IgG1_PVA_/S267K Heavy Chain

SEQ ID NO: 22352 - protein, 118 aa, Artificial Sequence; identical to SEQ ID NO: 21902
  Description of Artificial Sequence: Synthetic polypeptide
  VH of XENP020024

SEQ ID NO: 22353 - protein, 5 aa, Artificial Sequence
  Description of Artificial Sequence: Synthetic peptide
  XENP020024 vhCDR1
DYYMH

SEQ ID NO: 22354 - protein, 17 aa, Artificial Sequence
  Description of Artificial Sequence: Synthetic peptide
  XENP020024 vhCDR2
WIDPENGDTEYAPKFQG

SEQ ID NO: 22355 - protein, 9 aa, Artificial Sequence
  Description of Artificial Sequence: Synthetic peptide
  XENP020024 vhCDR3
RGVRQALDY

SEQ ID NO: 22356 - protein, 214 aa, Artificial Sequence; identical to SEQ ID NO: 21916
  Description of Artificial Sequence: Synthetic polypeptide
  XENP020024 2A11_H0L1_IgG1_PVA_/S267K Light Chain

SEQ ID NO: 22357 - protein, 107 aa, Artificial Sequence; identical to SEQ ID NO: 21917
  Description of Artificial Sequence: Synthetic polypeptide
  VL of XENP020024

SEQ ID NO: 22358 - protein, 11 aa, Artificial Sequence
  Description of Artificial Sequence: Synthetic peptide
  XENP020024 vlCDR1
RASQDIGNYLN

SEQ ID NO: 22359 - protein, 7 aa, Artificial Sequence
  Description of Artificial Sequence: Synthetic peptide
  XENP020024 vlCDR2
YTSRLHS

SEQ ID NO: 22360 - protein, 9 aa, Artificial Sequence
  Description of Artificial Sequence: Synthetic peptide
  XENP020024 vlCDR3
QQGNTLPYT

SEQ ID NO: 22361 - protein, 445 aa, Artificial Sequence; identical to SEQ ID NO: 22131
  Description of Artificial Sequence: Synthetic polypeptide
  XENP020025 7A6_H1L0_IgG1_PVA_/S267K Heavy Chain

SEQ ID NO: 22362 - protein, 116 aa, Artificial Sequence; identical to SEQ ID NO: 22132
  Description of Artificial Sequence: Synthetic polypeptide
  VH of XENP020025

SEQ ID NO: 22363 - protein, 6 aa, Artificial Sequence
  Description of Artificial Sequence: Synthetic peptide
  XENP020025 vhCDR1
SGYFWN

SEQ ID NO: 22364 - protein, 15 aa, Artificial Sequence
  Description of Artificial Sequence: Synthetic peptide
  XENP020025 vhCDR2
YISYDSNYYNPSVKG

SEQ ID NO: 22365 - protein, 8 aa, Artificial Sequence
  Description of Artificial Sequence: Synthetic peptide
  XENP020025 vhCDR3
GGITTFDY

SEQ ID NO: 22366 - protein, 218 aa, Artificial Sequence; identical to SEQ ID NO: 22126
  Description of Artificial Sequence: Synthetic polypeptide
  XENP020025 7A6_H1L0_IgG1_PVA_/S267K Light Chain

SEQ ID NO: 22367 - protein, 111 aa, Artificial Sequence; identical to SEQ ID NO: 22127
  Description of Artificial Sequence: Synthetic polypeptide
  VL of XENP020025

SEQ ID NO: 22368 - protein, 15 aa, Artificial Sequence
  Description of Artificial Sequence: Synthetic peptide
  XENP020025 vlCDR1
KASQSVDYDGDSYMN

SEQ ID NO: 22369 - protein, 7 aa, Artificial Sequence
  Description of Artificial Sequence: Synthetic peptide
  XENP020025 vlCDR2
AASNLES

SEQ ID NO: 22370 - protein, 9 aa, Artificial Sequence
  Description of Artificial Sequence: Synthetic peptide
  XENP020025 vlCDR3
QQSNEDPRT

SEQ ID NO: 22371 - protein, 445 aa, Artificial Sequence; identical to SEQ ID NO: 22121
  Description of Artificial Sequence: Synthetic polypeptide
  XENP020026 7A6_H0L1_IgG1_PVA_/S267K Heavy Chain

SEQ ID NO: 22372 - protein, 116 aa, Artificial Sequence; identical to SEQ ID NO: 22122
  Description of Artificial Sequence: Synthetic polypeptide
  VH of XENP020026

SEQ ID NO: 22373 - protein, 6 aa, Artificial Sequence
  Description of Artificial Sequence: Synthetic peptide
  XENP020026 vhCDR1
SGYFWN

SEQ ID NO: 22374 - protein, 15 aa, Artificial Sequence
  Description of Artificial Sequence: Synthetic peptide
  XENP020026 vhCDR2
YISYDSNYYNPSLKN

SEQ ID NO: 22375 - protein, 8 aa, Artificial Sequence
  Description of Artificial Sequence: Synthetic peptide
  XENP020026 vhCDR3
GGITTFDY

SEQ ID NO: 22376 - protein, 218 aa, Artificial Sequence; identical to SEQ ID NO: 22136
  Description of Artificial Sequence: Synthetic polypeptide
  XENP020026 7A6_H0L1_IgG1_PVA_/S267K Light Chain

SEQ ID NO: 22377 - protein, 111 aa, Artificial Sequence; identical to SEQ ID NO: 22137
  Description of Artificial Sequence: Synthetic polypeptide
  VL of XENP020026

SEQ ID NO: 22378 - protein, 15 aa, Artificial Sequence
  Description of Artificial Sequence: Synthetic peptide
  XENP020026 vlCDR1
RASQSVDYDGDSYMN

SEQ ID NO: 22379 - protein, 7 aa, Artificial Sequence
  Description of Artificial Sequence: Synthetic peptide
  XENP020026 vlCDR2
AASNLES

SEQ ID NO: 22380 - protein, 9 aa, Artificial Sequence
  Description of Artificial Sequence: Synthetic peptide
  XENP020026 vlCDR3
QQSNEDPRT

SEQ ID NO: 22381 - protein, 445 aa, Artificial Sequence; identical to SEQ ID NO: 22121
  Description of Artificial Sequence: Synthetic polypeptide
  XENP020027 7A6_H0L3_IgG1_PVA_/S267K Heavy Chain

SEQ ID NO: 22382 - protein, 116 aa, Artificial Sequence; identical to SEQ ID NO: 22122
  Description of Artificial Sequence: Synthetic polypeptide
  VH of XENP020027

SEQ ID NO: 22383 - protein, 6 aa, Artificial Sequence
  Description of Artificial Sequence: Synthetic peptide
  XENP020027 vhCDR1
SGYFWN

SEQ ID NO: 22384 - protein, 15 aa, Artificial Sequence
  Description of Artificial Sequence: Synthetic peptide
  XENP020027 vhCDR2
YISYDSNYYNPSLKN

SEQ ID NO: 22385 - protein, 8 aa, Artificial Sequence
  Description of Artificial Sequence: Synthetic peptide
  XENP020027 vhCDR3
GGITTFDY

SEQ ID NO: 22386 - protein, 218 aa, Artificial Sequence; identical to SEQ ID NO: 22156
  Description of Artificial Sequence: Synthetic polypeptide
  XENP020027 7A6_H0L3_IgG1_PVA_/S267K Light Chain

SEQ ID NO: 22387 - protein, 111 aa, Artificial Sequence; identical to SEQ ID NO: 22157
  Description of Artificial Sequence: Synthetic polypeptide
  VL of XENP020027

SEQ ID NO: 22388 - protein, 15 aa, Artificial Sequence
  Description of Artificial Sequence: Synthetic peptide
  XENP020027 vlCDR1
KASQSVDYDGDSYMN

SEQ ID NO: 22389 - protein, 7 aa, Artificial Sequence
  Description of Artificial Sequence: Synthetic peptide
  XENP020027 vlCDR2
AASNLES

SEQ ID NO: 22390 - protein, 9 aa, Artificial Sequence
  Description of Artificial Sequence: Synthetic peptide
  XENP020027 vlCDR3
QQSNEDPRT

SEQ ID NO: 22391 - protein, 450 aa, Artificial Sequence; identical to SEQ ID NO: 22271
  Description of Artificial Sequence: Synthetic polypeptide
  XENP020028 7G8_H1L0_IgG1_PVA_/S267K Heavy Chain

SEQ ID NO: 22392 - protein, 121 aa, Artificial Sequence; identical to SEQ ID NO: 22272
  Description of Artificial Sequence: Synthetic polypeptide
  VH of XENP020028

SEQ ID NO: 22393 - protein, 5 aa, Artificial Sequence
  Description of Artificial Sequence: Synthetic peptide
  XENP020028 vhCDR1
DAWMD

SEQ ID NO: 22394 - protein, 19 aa, Artificial Sequence
  Description of Artificial Sequence: Synthetic peptide
  XENP020028 vhCDR2
EIRTKANNHATYYAEKFQG

SEQ ID NO: 22395 - protein, 10 aa, Artificial Sequence
  Description of Artificial Sequence: Synthetic peptide
  XENP020028 vhCDR3
LANWDWYFDV

SEQ ID NO: 22396 - protein, 218 aa, Artificial Sequence; identical to SEQ ID NO: 22266
  Description of Artificial Sequence: Synthetic polypeptide
  XENP020028 7G8_H1L0_IgG1_PVA_/S267K Light Chain

SEQ ID NO: 22397 - protein, 111 aa, Artificial Sequence; identical to SEQ ID NO: 22267
  Description of Artificial Sequence: Synthetic polypeptide
  VL of XENP020028

SEQ ID NO: 22398 - protein, 15 aa, Artificial Sequence
  Description of Artificial Sequence: Synthetic peptide
  XENP020028 vlCDR1
KASQSVDYDGDSYMN

SEQ ID NO: 22399 - protein, 7 aa, Artificial Sequence
  Description of Artificial Sequence: Synthetic peptide
  XENP020028 vlCDR2
AASNLES

SEQ ID NO: 22400 - protein, 9 aa, Artificial Sequence
  Description of Artificial Sequence: Synthetic peptide
  XENP020028 vlCDR3
QQSNEDPFT

SEQ ID NO: 22401 - protein, 450 aa, Artificial Sequence; identical to SEQ ID NO: 22261
  Description of Artificial Sequence: Synthetic polypeptide
  XENP020029 7G8_H0L1_IgG1_PVA_/S267K Heavy Chain

SEQ ID NO: 22402 - protein, 121 aa, Artificial Sequence; identical to SEQ ID NO: 22262
  Description of Artificial Sequence: Synthetic polypeptide
  VH of XENP020029

SEQ ID NO: 22403 - protein, 5 aa, Artificial Sequence
  Description of Artificial Sequence: Synthetic peptide
  XENP020029 vhCDR1
DAWMD

SEQ ID NO: 22404 - protein, 19 aa, Artificial Sequence
  Description of Artificial Sequence: Synthetic peptide
  XENP020029 vhCDR2
EIRTKANNHATYYAESVKG

SEQ ID NO: 22405 - protein, 10 aa, Artificial Sequence
  Description of Artificial Sequence: Synthetic peptide
  XENP020029 vhCDR3
LANWDWYFDV

SEQ ID NO: 22406 - protein, 218 aa, Artificial Sequence; identical to SEQ ID NO: 22276
  Description of Artificial Sequence: Synthetic polypeptide
  XENP020029 7G8_H0L1_IgG1_PVA_/S267K Light Chain

SEQ ID NO: 22407 - protein, 111 aa, Artificial Sequence; identical to SEQ ID NO: 22277
  Description of Artificial Sequence: Synthetic polypeptide
  VL of XENP020029

SEQ ID NO: 22408 - protein, 15 aa, Artificial Sequence
  Description of Artificial Sequence: Synthetic peptide
  XENP020029 vlCDR1
RASQSVDYDGDSYMN

SEQ ID NO: 22409 - protein, 7 aa, Artificial Sequence
  Description of Artificial Sequence: Synthetic peptide
  XENP020029 vlCDR2
AASNLES

SEQ ID NO: 22410 - protein, 9 aa, Artificial Sequence
  Description of Artificial Sequence: Synthetic peptide
  XENP020029 vlCDR3
QQSNEDPFT

SEQ ID NO: 22411 - protein, 450 aa, Artificial Sequence; identical to SEQ ID NO: 22301
  Description of Artificial Sequence: Synthetic polypeptide
  XENP020262 7G8_H2L0_IgG1_PVA_/S267K Heavy Chain

SEQ ID NO: 22412 - protein, 121 aa, Artificial Sequence; identical to SEQ ID NO: 22302
  Description of Artificial Sequence: Synthetic polypeptide
  VH of XENP020262

SEQ ID NO: 22413 - protein, 5 aa, Artificial Sequence
  Description of Artificial Sequence: Synthetic peptide
  XENP020262 vhCDR1
DAWMD

SEQ ID NO: 22414 - protein, 19 aa, Artificial Sequence
  Description of Artificial Sequence: Synthetic peptide
  XENP020262 vhCDR2
EIRTKANNHATYYAESVKG

SEQ ID NO: 22415 - protein, 10 aa, Artificial Sequence
  Description of Artificial Sequence: Synthetic peptide
  XENP020262 vhCDR3
LANWDWYFDV

SEQ ID NO: 22416 - protein, 218 aa, Artificial Sequence; identical to SEQ ID NO: 22266
  Description of Artificial Sequence: Synthetic polypeptide
  XENP020262 7G8_H2L0_IgG1_PVA_/S267K Light Chain

SEQ ID NO: 22417 - protein, 111 aa, Artificial Sequence; identical to SEQ ID NO: 22267
  Description of Artificial Sequence: Synthetic polypeptide
  VL of XENP020262

SEQ ID NO: 22418 - protein, 15 aa, Artificial Sequence
  Description of Artificial Sequence: Synthetic peptide
  XENP020262 vlCDR1
KASQSVDYDGDSYMN

SEQ ID NO: 22419 - protein, 7 aa, Artificial Sequence
  Description of Artificial Sequence: Synthetic peptide
  XENP020262 vlCDR2
AASNLES

SEQ ID NO: 22420 - protein, 9 aa, Artificial Sequence
  Description of Artificial Sequence: Synthetic peptide
  XENP020262 vlCDR3
QQSNEDPFT

SEQ ID NO: 22421 - protein, 450 aa, Artificial Sequence; identical to SEQ ID NO: 22261
  Description of Artificial Sequence: Synthetic polypeptide
  XENP020263 7G8_H0L2_IgG1_PVA_/S267K Heavy Chain

SEQ ID NO: 22422 - protein, 121 aa, Artificial Sequence; identical to SEQ ID NO: 22262
  Description of Artificial Sequence: Synthetic polypeptide
  VH of XENP020263

SEQ ID NO: 22423 - protein, 5 aa, Artificial Sequence
  Description of Artificial Sequence: Synthetic peptide
  XENP020263 vhCDR1
DAWMD

SEQ ID NO: 22424 - protein, 19 aa, Artificial Sequence
  Description of Artificial Sequence: Synthetic peptide
  XENP020263 vhCDR2
EIRTKANNHATYYAESVKG

SEQ ID NO: 22425 - protein, 10 aa, Artificial Sequence
  Description of Artificial Sequence: Synthetic peptide
  XENP020263 vhCDR3
LANWDWYFDV

SEQ ID NO: 22426 - protein, 218 aa, Artificial Sequence; identical to SEQ ID NO: 22286
  Description of Artificial Sequence: Synthetic polypeptide
  XENP020263 7G8_H0L2_IgG1_PVA_/S267K Light Chain

SEQ ID NO: 22427 - protein, 111 aa, Artificial Sequence; identical to SEQ ID NO: 22287
  Description of Artificial Sequence: Synthetic polypeptide
  VL of XENP020263

SEQ ID NO: 22428 - protein, 15 aa, Artificial Sequence
  Description of Artificial Sequence: Synthetic peptide
  XENP020263 vlCDR1
RASQSVDYDGDSYMN

SEQ ID NO: 22429 - protein, 7 aa, Artificial Sequence
  Description of Artificial Sequence: Synthetic peptide
  XENP020263 vlCDR2
AASNLES

SEQ ID NO: 22430 - protein, 9 aa, Artificial Sequence
  Description of Artificial Sequence: Synthetic peptide
  XENP020263 vlCDR3
QQSNEDPFT

SEQ ID NO: 22431 - protein, 444 aa, Artificial Sequence
  Description of Artificial Sequence: Synthetic polypeptide
  XENP020412 8D7_H0L0_IgG1_PVA_/S267K Heavy Chain
QVQLKQSGPGLVQPSQSLSITCTVSGFSLSSYGVHWVRQSPGKGLEWLGVIWSGSTDYNAAFISRLSISKDNSKSQVFFKMNSLQPNDTAIYYCARTYYYAMDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 22432 - protein, 115 aa, Artificial Sequence
  Description of Artificial Sequence: Synthetic polypeptide
  VH of XENP020412
QVQLKQSGPGLVQPSQSLSITCTVSGFSLSSYGVHWVRQSPGKGLEWLGVIWSGSTDYNAAFISRLSISKDNSKSQVFFKMNSLQPNDTAIYYCARTYYYAMDYWGQGTSVTVSS

SEQ ID NO: 22433 - protein, 5 aa, Artificial Sequence
  Description of Artificial Sequence: Synthetic peptide
  XENP020412 vhCDR1
SYGVH

SEQ ID NO: 22434 - protein, 15 aa, Artificial Sequence
  Description of Artificial Sequence: Synthetic peptide
  XENP020412 vhCDR2
VIWSGSTDYNAAFIS

SEQ ID NO: 22435 - protein, 8 aa, Artificial Sequence
  Description of Artificial Sequence: Synthetic peptide
  XENP020412 vhCDR3
TYYYAMDY

SEQ ID NO: 22436 - protein, 214 aa, Artificial Sequence
  Description of Artificial Sequence: Synthetic polypeptide
  XENP020412 8D7_H0L0_IgG1_PVA_/S267K Light Chain
DIQMTQSPASLSVSVGETVTITCRASENIYSNLAWYQQKQGKSPQFLIYAATNLADGVPSRFSGSGSGTQYSLKINSLQSEDFGSYYCQHFWGTPWTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 22437 - protein, 107 aa, Artificial Sequence
  Description of Artificial Sequence: Synthetic polypeptide
  VL of XENP020412
DIQMTQSPASLSVSVGETVTITCRASENIYSNLAWYQQKQGKSPQFLIYAATNLADGVPSRFSGSGSGTQYSLKINSLQSEDFGSYYCQHFWGTPWTFGGGTKLEIK

SEQ ID NO: 22438 - protein, 11 aa, Artificial Sequence
  Description of Artificial Sequence: Synthetic peptide
  XENP020412 vlCDR1
RASENIYSNLA

SEQ ID NO: 22439 - protein, 7 aa, Artificial Sequence
  Description of Artificial Sequence: Synthetic peptide
  XENP020412 vlCDR2
AATNLAD

SEQ ID NO: 22440 - protein, 9 aa, Artificial Sequence
  Description of Artificial Sequence: Synthetic peptide
  XENP020412 vlCDR3
QHFWGTPWT

SEQ ID NO: 22441 - protein, 444 aa, Artificial Sequence
  Description of Artificial Sequence: Synthetic polypeptide
  XENP020413 8D7_H2L1_IgG1_PVA_/S267K Heavy Chain
QVQLVQSGAEVKKPGASVKVSCKVSGFSLSSYGVHWVRQAPGQGLEWLGVIWSGSTDYNAKFQGRVTITKDNSKSTVYFELSSLRSEDTAVYYCARTYYYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 22442 - protein, 115 aa, Artificial Sequence
  Description of Artificial Sequence: Synthetic polypeptide
  VH of XENP020413
QVQLVQSGAEVKKPGASVKVSCKVSGFSLSSYGVHWVRQAPGQGLEWLGVIWSGSTDYNAKFQGRVTITKDNSKSTVYFELSSLRSEDTAVYYCARTYYYAMDYWGQGTLVTVSS

SEQ ID NO: 22443 - protein, 5 aa, Artificial Sequence
  Description of Artificial Sequence: Synthetic peptide
  XENP020413 vhCDR1
SYGVH

SEQ ID NO: 22444 - protein, 15 aa, Artificial Sequence
  Description of Artificial Sequence: Synthetic peptide
  XENP020413 vhCDR2
VIWSGSTDYNAKFQG

SEQ ID NO: 22445 - protein, 8 aa, Artificial Sequence
  Description of Artificial Sequence: Synthetic peptide
  XENP020413 vhCDR3
TYYYAMDY

SEQ ID NO: 22446 - protein, 214 aa, Artificial Sequence; identical to SEQ ID NO: 21896
  Description of Artificial Sequence: Synthetic polypeptide
  XENP020413 8D7_H2L1_IgG1_PVA_/S267K Light Chain

SEQ ID NO: 22447 - protein, 107 aa, Artificial Sequence; identical to SEQ ID NO: 21897
  Description of Artificial Sequence: Synthetic polypeptide
  VL of XENP020413

SEQ ID NO: 22448 - protein, 11 aa, Artificial Sequence
  Description of Artificial Sequence: Synthetic peptide
  XENP020413 vlCDR1
RASENIYSNLA

SEQ ID NO: 22449 - protein, 7 aa, Artificial Sequence
  Description of Artificial Sequence: Synthetic peptide
  XENP020413 vlCDR2
AATNLAD

SEQ ID NO: 22450 - protein, 9 aa, Artificial Sequence
  Description of Artificial Sequence: Synthetic peptide
  XENP020413 vlCDR3
QHFWGTPWT

SEQ ID NO: 22451 - protein, 444 aa, Artificial Sequence
  Description of Artificial Sequence: Synthetic polypeptide
  XENP020414 8D7_H3L1_IgG1_PVA_/S267K Heavy Chain
QVQLVESGGGVVQPGRSLRLSCAVSGFSLSSYGVHWVRQAPGKGLEWVAVIWSGSTDYNAAVKGRFTISKDNSKSTVYLQMNSLRAEDTAVYYCARTYYYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 22452 - protein, 115 aa, Artificial Sequence
  Description of Artificial Sequence: Synthetic polypeptide
  VH of XENP020414
QVQLVESGGGVVQPGRSLRLSCAVSGFSLSSYGVHWVRQAPGKGLEWVAVIWSGSTDYNAAVKGRFTISKDNSKSTVYLQMNSLRAEDTAVYYCARTYYYAMDYWGQGTLVTVSS

SEQ ID NO: 22453 - protein, 5 aa, Artificial Sequence
  Description of Artificial Sequence: Synthetic peptide
  XENP020414 vhCDR1
SYGVH

SEQ ID NO: 22454 - protein, 15 aa, Artificial Sequence
  Description of Artificial Sequence: Synthetic peptide
  XENP020414 vhCDR2
VIWSGSTDYNAAVKG

SEQ ID NO: 22455 - protein, 8 aa, Artificial Sequence
  Description of Artificial Sequence: Synthetic peptide
  XENP020414 vhCDR3
TYYYAMDY

SEQ ID NO: 22456 - protein, 214 aa, Artificial Sequence; identical to SEQ ID NO: 21896
  Description of Artificial Sequence: Synthetic polypeptide
  XENP020414 8D7_H3L1_IgG1_PVA_/S267K Light Chain

SEQ ID NO: 22457 - protein, 107 aa, Artificial Sequence; identical to SEQ ID NO: 21897
  Description of Artificial Sequence: Synthetic polypeptide
  VL of XENP020414

SEQ ID NO: 22458 - protein, 11 aa, Artificial Sequence
  Description of Artificial Sequence: Synthetic peptide
  XENP020414 vlCDR1
RASENIYSNLA

SEQ ID NO: 22459 - protein, 7 aa, Artificial Sequence
  Description of Artificial Sequence: Synthetic peptide
  XENP020414 vlCDR2
AATNLAD

SEQ ID NO: 22460 - protein, 9 aa, Artificial Sequence
  Description of Artificial Sequence: Synthetic peptide
  XENP020414 vlCDR3
QHFWGTPWT

SEQ ID NO: 22461 - protein, 449 aa, Artificial Sequence
  Description of Artificial Sequence: Synthetic polypeptide
  XENP020415 4C8_H0L0_IgG1_PVA_/S267K Heavy Chain
EVQLQQSGPELVKPGASVKISCKASGYTFTDYNVHWVKQSHGKSLEWIGYIYPYTGGTGYNQKFKSKATLTVDNSSSTAYMELRSLTSEDSAVYYCARSDDGYSYAMDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 22462 - protein, 120 aa, Artificial Sequence
  Description of Artificial Sequence: Synthetic polypeptide
  VH of XENP020415
EVQLQQSGPELVKPGASVKISCKASGYTFTDYNVHWVKQSHGKSLEWIGYIYPYTGGTGYNQKFKSKATLTVDNSSSTAYMELRSLTSEDSAVYYCARSDDGYSYAMDYWGQGTSVTVSS

SEQ ID NO: 22463 - protein, 5 aa, Artificial Sequence
  Description of Artificial Sequence: Synthetic peptide
  XENP020415 vhCDR1
DYNVH

SEQ ID NO: 22464 - protein, 17 aa, Artificial Sequence
  Description of Artificial Sequence: Synthetic peptide
  XENP020415 vhCDR2
YIYPYTGGTGYNQKFKS

SEQ ID NO: 22465 - protein, 11 aa, Artificial Sequence
  Description of Artificial Sequence: Synthetic peptide
  XENP020415 vhCDR3
SDDGYSYAMDY

SEQ ID NO: 22466 - protein, 213 aa, Artificial Sequence
  Description of Artificial Sequence: Synthetic polypeptide
  XENP020415 4C8_H0L0_IgG1_PVA_/S267K Light Chain
DIQMTQTTSSLSASLGDRVTISCRASQDISNYLNWYQQKPDGTVKLLIYYTSRLHSGVPSRFSGSGSGTDYSLTISNLEQEDIATYFCQQGNTLWTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 22467 - protein, 106 aa, Artificial Sequence
  Description of Artificial Sequence: Synthetic polypeptide
  VL of XENP020415
DIQMTQTTSSLSASLGDRVTISCRASQDISNYLNWYQQKPDGTVKLLIYYTSRLHSGVPSRFSGSGSGTDYSLTISNLEQEDIATYFCQQGNTLWTFGGGTKLEIK

SEQ ID NO: 22468 - protein, 11 aa, Artificial Sequence
  Description of Artificial Sequence: Synthetic peptide
  XENP020415 vlCDR1
RASQDISNYLN

SEQ ID NO: 22469 - protein, 7 aa, Artificial Sequence
  Description of Artificial Sequence: Synthetic peptide
  XENP020415 vlCDR2
YTSRLHS

SEQ ID NO: 22470 - protein, 8 aa, Artificial Sequence
  Description of Artificial Sequence: Synthetic peptide
  XENP020415 vlCDR3
QQGNTLWT

SEQ ID NO: 22471 - protein, 449 aa, Artificial Sequence
  Description of Artificial Sequence: Synthetic polypeptide
  XENP020416 4C8_H2L1_IgG1_PVA_/S267K Heavy Chain
QVQLVQSGAEVKKPGASVKVSCKASGYTFTDYNVHWVRQAPGQGLEWIGYIYPYTGGTGYNQKFQGRVTLTVDNSISTAYMELSSLRSEDTAVYYCARSDDGYSYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 22472 - protein, 120 aa, Artificial Sequence
  Description of Artificial Sequence: Synthetic polypeptide
  VH of XENP020416
QVQLVQSGAEVKKPGASVKVSCKASGYTFTDYNVHWVRQAPGQGLEWIGYIYPYTGGTGYNQKFQGRVTLTVDNSISTAYMELSSLRSEDTAVYYCARSDDGYSYAMDYWGQGTLVTVSS

SEQ ID NO: 22473 - protein, 5 aa, Artificial Sequence
  Description of Artificial Sequence: Synthetic peptide
  XENP020416 vhCDR1
DYNVH

SEQ ID NO: 22474 - protein, 17 aa, Artificial Sequence
  Description of Artificial Sequence: Synthetic peptide
  XENP020416 vhCDR2
YIYPYTGGTGYNQKFQG

SEQ ID NO: 22475 - protein, 11 aa, Artificial Sequence
  Description of Artificial Sequence: Synthetic peptide
  XENP020416 vhCDR3
SDDGYSYAMDY

SEQ ID NO: 22476 - protein, 213 aa, Artificial Sequence; identical to SEQ ID NO: 22116
  Description of Artificial Sequence: Synthetic polypeptide
  XENP020416 4C8_H2L1_IgG1_PVA_/S267K Light Chain

SEQ ID NO: 22477 - protein, 106 aa, Artificial Sequence; identical to SEQ ID NO: 22117
  Description of Artificial Sequence: Synthetic polypeptide
  VL of XENP020416

SEQ ID NO: 22478 - protein, 11 aa, Artificial Sequence
  Description of Artificial Sequence: Synthetic peptide
  XENP020416 vlCDR1
QASQDISNYLN

SEQ ID NO: 22479 - protein, 7 aa, Artificial Sequence
  Description of Artificial Sequence: Synthetic peptide
  XENP020416 vlCDR2
YTSRLHS

SEQ ID NO: 22480 - protein, 8 aa, Artificial Sequence
  Description of Artificial Sequence: Synthetic peptide
  XENP020416 vlCDR3
QQGNTLWT

SEQ ID NO: 22481 - protein, 450 aa, Artificial Sequence
  Description of Artificial Sequence: Synthetic polypeptide
  XENP020417 7G8_H3L1_IgG1_PVA_/S267K Heavy Chain
EVQLVESGGGLVQPGGSLRLSCAASGFTFSDAWMDWVRQAPGKGLEWVAEIRTKANNHATYYAESVKGRFTISRDDSKSSVYLQMNSLRAEDTAVYYCTRLANWDWYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 22482 - protein, 121 aa, Artificial Sequence
  Description of Artificial Sequence: Synthetic polypeptide
  VH of XENP020417
EVQLVESGGGLVQPGGSLRLSCAASGFTFSDAWMDWVRQAPGKGLEWVAEIRTKANNHATYYAESVKGRFTISRDDSKSSVYLQMNSLRAEDTAVYYCTRLANWDWYFDVWGQGTTVTVSS

SEQ ID NO: 22483 - protein, 5 aa, Artificial Sequence
  Description of Artificial Sequence: Synthetic peptide
  XENP020417 vhCDR1
DAWMD

SEQ ID NO: 22484 - protein, 19 aa, Artificial Sequence
  Description of Artificial Sequence: Synthetic peptide
  XENP020417 vhCDR2
EIRTKANNHATYYAESVKG

SEQ ID NO: 22485 - protein, 10 aa, Artificial Sequence
  Description of Artificial Sequence: Synthetic peptide
  XENP020417 vhCDR3
LANWDWYFDV

SEQ ID NO: 22486 - protein, 218 aa, Artificial Sequence; identical to SEQ ID NO: 22276
  Description of Artificial Sequence: Synthetic polypeptide
  XENP020417 7G8_H3L1_IgG1_PVA_/S267K Light Chain

SEQ ID NO: 22487 - protein, 111 aa, Artificial Sequence; identical to SEQ ID NO: 22277
  Description of Artificial Sequence: Synthetic polypeptide
  VL of XENP020417

SEQ ID NO: 22488 - protein, 15 aa, Artificial Sequence
  Description of Artificial Sequence: Synthetic peptide
  XENP020417 vlCDR1
RASQSVDYDGDSYMN

SEQ ID NO: 22489 - protein, 7 aa, Artificial Sequence
  Description of Artificial Sequence: Synthetic peptide
  XENP020417 vlCDR2
AASNLES

SEQ ID NO: 22490 - protein, 9 aa, Artificial Sequence
  Description of Artificial Sequence: Synthetic peptide
  XENP020417 vlCDR3
QQSNEDPFT

SEQ ID NO: 22491 - protein, 450 aa, Artificial Sequence; identical to SEQ ID NO: 22481
  Description of Artificial Sequence: Synthetic polypeptide
  XENP020418 7G8_H3L2_IgG1_PVA_/S267K Heavy Chain

SEQ ID NO: 22492 - protein, 121 aa, Artificial Sequence; identical to SEQ ID NO: 22482
  Description of Artificial Sequence: Synthetic polypeptide
  VH of XENP020418

SEQ ID NO: 22493 - protein, 5 aa, Artificial Sequence
  Description of Artificial Sequence: Synthetic peptide
  XENP020418 vhCDR1
DAWMD

SEQ ID NO: 22494 - protein, 19 aa, Artificial Sequence
  Description of Artificial Sequence: Synthetic peptide
  XENP020418 vhCDR2
EIRTKANNHATYYAESVKG

SEQ ID NO: 22495 - protein, 10 aa, Artificial Sequence
  Description of Artificial Sequence: Synthetic peptide
  XENP020418 vhCDR3
LANWDWYFDV

SEQ ID NO: 22496 - protein, 218 aa, Artificial Sequence; identical to SEQ ID NO: 22286
  Description of Artificial Sequence: Synthetic polypeptide
  XENP020418 7G8_H3L2_IgG1_PVA_/S267K Light Chain

SEQ ID NO: 22497 - protein, 111 aa, Artificial Sequence; identical to SEQ ID NO: 22287
  Description of Artificial Sequence: Synthetic polypeptide
  VL of XENP020418

SEQ ID NO: 22498 - protein, 15 aa, Artificial Sequence
  Description of Artificial Sequence: Synthetic peptide
  XENP020418 vlCDR1
RASQSVDYDGDSYMN

SEQ ID NO: 22499 - protein, 7 aa, Artificial Sequence
  Description of Artificial Sequence: Synthetic peptide
  XENP020418 vlCDR2
AASNLES

SEQ ID NO: 22500 - protein, 9 aa, Artificial Sequence
  Description of Artificial Sequence: Synthetic peptide
  XENP020418 vlCDR3
QQSNEDPFT

SEQ ID NO: 22501 - protein, 450 aa, Artificial Sequence; identical to SEQ ID NO: 22481
  Description of Artificial Sequence: Synthetic polypeptide
  XENP020419 7G8_H3L3_IgG1_PVA_/S267K Heavy Chain

SEQ ID NO: 22502 - protein, 121 aa, Artificial Sequence; identical to SEQ ID NO: 22482
  Description of Artificial Sequence: Synthetic polypeptide
  VH of XENP020419

SEQ ID NO: 22503 - protein, 5 aa, Artificial Sequence
  Description of Artificial Sequence: Synthetic peptide
  XENP020419 vhCDR1
DAWMD

SEQ ID NO: 22504 - protein, 19 aa, Artificial Sequence
  Description of Artificial Sequence: Synthetic peptide
  XENP020419 vhCDR2
EIRTKANNHATYYAESVKG

SEQ ID NO: 22505 - protein, 10 aa, Artificial Sequence
  Description of Artificial Sequence: Synthetic peptide
  XENP020419 vhCDR3
LANWDWYFDV

SEQ ID NO: 22506 - protein, 218 aa, Artificial Sequence; identical to SEQ ID NO: 22296
  Description of Artificial Sequence: Synthetic polypeptide
  XENP020419 7G8_H3L3_IgG1_PVA_/S267K Light Chain

SEQ ID NO: 22507 - protein, 111 aa, Artificial Sequence; identical to SEQ ID NO: 22297
  Description of Artificial Sequence: Synthetic polypeptide
  VL of XENP020419

SEQ ID NO: 22508 - protein, 15 aa, Artificial Sequence
  Description of Artificial Sequence: Synthetic peptide
  XENP020419 vlCDR1
KASQSVDYDGDSYMN

SEQ ID NO: 22509 - protein, 7 aa, Artificial Sequence
  Description of Artificial Sequence: Synthetic peptide
  XENP020419 vlCDR2
AASNLES

SEQ ID NO: 22510 - protein, 9 aa, Artificial Sequence
  Description of Artificial Sequence: Synthetic peptide
  XENP020419 vlCDR3
QQSNEDPFT

SEQ ID NO: 22511 - protein, 444 aa, Artificial Sequence; identical to SEQ ID NO: 22431
  Description of Artificial Sequence: Synthetic polypeptide
  XENP020412 8D7_H0L0_IgG1_PVA_/S267K Heavy Chain

SEQ ID NO: 22512 - protein, 115 aa, Artificial Sequence; identical to SEQ ID NO: 22432
  Description of Artificial Sequence: Synthetic polypeptide
  VH of XENP020412

SEQ ID NO: 22513 - protein, 5 aa, Artificial Sequence
  Description of Artificial Sequence: Synthetic peptide
  XENP020412 vhCDR1
SYGVH

SEQ ID NO: 22514 - protein, 15 aa, Artificial Sequence
  Description of Artificial Sequence: Synthetic peptide
  XENP020412 vhCDR2
VIWSGSTDYNAAFIS

SEQ ID NO: 22515 - protein, 8 aa, Artificial Sequence
  Description of Artificial Sequence: Synthetic peptide
  XENP020412 vhCDR3
TYYYAMDY

SEQ ID NO: 22516 - protein, 214 aa, Artificial Sequence; identical to SEQ ID NO: 22436
  Description of Artificial Sequence: Synthetic polypeptide
  XENP020412 8D7_H0L0_IgG1_PVA_/S267K Light Chain

SEQ ID NO: 22517 - protein, 107 aa, Artificial Sequence; identical to SEQ ID NO: 22437
  Description of Artificial Sequence: Synthetic polypeptide
  VL of XENP020412

SEQ ID NO: 22518 - protein, 11 aa, Artificial Sequence
  Description of Artificial Sequence: Synthetic peptide
  XENP020412 vlCDR1
RASENIYSNLA

SEQ ID NO: 22519 - protein, 7 aa, Artificial Sequence
  Description of Artificial Sequence: Synthetic peptide
  XENP020412 vlCDR2
AATNLAD

SEQ ID NO: 22520 - protein, 9 aa, Artificial Sequence
  Description of Artificial Sequence: Synthetic peptide
  XENP020412 vlCDR3
QHFWGTPWT

SEQ ID NO: 22521 - protein, 444 aa, Artificial Sequence; identical to SEQ ID NO: 22441
  Description of Artificial Sequence: Synthetic polypeptide
  XENP020413 8D7_H2L1_IgG1_PVA_/S267K Heavy Chain

SEQ ID NO: 22522 - protein, 115 aa, Artificial Sequence; identical to SEQ ID NO: 22442
  Description of Artificial Sequence: Synthetic polypeptide
  VH of XENP020413

SEQ ID NO: 22523 - protein, 5 aa, Artificial Sequence
  Description of Artificial Sequence: Synthetic peptide
  XENP020413 vhCDR1
SYGVH

SEQ ID NO: 22524 - protein, 15 aa, Artificial Sequence
  Description of Artificial Sequence: Synthetic peptide
  XENP020413 vhCDR2
VIWSGSTDYNAKFQG

SEQ ID NO: 22525 - protein, 8 aa, Artificial Sequence
  Description of Artificial Sequence: Synthetic peptide
  XENP020413 vhCDR3
TYYYAMDY

SEQ ID NO: 22526 - protein, 214 aa, Artificial Sequence; identical to SEQ ID NO: 21896
  Description of Artificial Sequence: Synthetic polypeptide
  XENP020413 8D7_H2L1_IgG1_PVA_/S267K Light Chain

SEQ ID NO: 22527 - protein, 107 aa, Artificial Sequence; identical to SEQ ID NO: 21897
  Description of Artificial Sequence: Synthetic polypeptide
  VL of XENP020413

SEQ ID NO: 22528 - protein, 11 aa, Artificial Sequence
  Description of Artificial Sequence: Synthetic peptide
  XENP020413 vlCDR1
RASENIYSNLA

SEQ ID NO: 22529 - protein, 7 aa, Artificial Sequence
  Description of Artificial Sequence: Synthetic peptide
  XENP020413 vlCDR2
AATNLAD

SEQ ID NO: 22530 - protein, 9 aa, Artificial Sequence
  Description of Artificial Sequence: Synthetic peptide
  XENP020413 vlCDR3
QHFWGTPWT

SEQ ID NO: 22531 - protein, 444 aa, Artificial Sequence; identical to SEQ ID NO: 22451
  Description of Artificial Sequence: Synthetic polypeptide
  XENP020414 8D7_H3L1_IgG1_PVA_/S267K Heavy Chain

SEQ ID NO: 22532 - protein, 115 aa, Artificial Sequence; identical to SEQ ID NO: 22452
  Description of Artificial Sequence: Synthetic polypeptide
  VH of XENP020414

SEQ ID NO: 22533 - protein, 5 aa, Artificial Sequence
  Description of Artificial Sequence: Synthetic peptide
  XENP020414 vhCDR1
SYGVH

SEQ ID NO: 22534 - protein, 15 aa, Artificial Sequence
  Description of Artificial Sequence: Synthetic peptide
  XENP020414 vhCDR2
VIWSGSTDYNAAVKG

SEQ ID NO: 22535 - protein, 8 aa, Artificial Sequence
  Description of Artificial Sequence: Synthetic peptide
  XENP020414 vhCDR3
TYYYAMDY

SEQ ID NO: 22536 - protein, 214 aa, Artificial Sequence; identical to SEQ ID NO: 21896
  Description of Artificial Sequence: Synthetic polypeptide
  XENP020414 8D7_H3L1_IgG1_PVA_/S267K Light Chain

SEQ ID NO: 22537 - protein, 107 aa, Artificial Sequence; identical to SEQ ID NO: 21897
  Description of Artificial Sequence: Synthetic polypeptide
  VL of XENP020414

SEQ ID NO: 22538 - protein, 11 aa, Artificial Sequence
  Description of Artificial Sequence: Synthetic peptide
  XENP020414 vlCDR1
RASENIYSNLA

SEQ ID NO: 22539 - protein, 7 aa, Artificial Sequence
  Description of Artificial Sequence: Synthetic peptide
  XENP020414 vlCDR2
AATNLAD

SEQ ID NO: 22540 - protein, 9 aa, Artificial Sequence
  Description of Artificial Sequence: Synthetic peptide
  XENP020414 vlCDR3
QHFWGTPWT

SEQ ID NO: 22541 - protein, 449 aa, Artificial Sequence; identical to SEQ ID NO: 22461
  Description of Artificial Sequence: Synthetic polypeptide
  XENP020415 4C8_H0L0_IgG1_PVA_/S267K Heavy Chain

SEQ ID NO: 22542 - protein, 120 aa, Artificial Sequence; identical to SEQ ID NO: 22462
  Description of Artificial Sequence: Synthetic polypeptide
  VH of XENP020415

SEQ ID NO: 22543 - protein, 5 aa, Artificial Sequence
  Description of Artificial Sequence: Synthetic peptide
  XENP020415 vhCDR1
DYNVH

SEQ ID NO: 22544 - protein, 17 aa, Artificial Sequence
  Description of Artificial Sequence: Synthetic peptide
  XENP020415 vhCDR2
YIYPYTGGTGYNQKFKS

SEQ ID NO: 22545 - protein, 11 aa, Artificial Sequence
  Description of Artificial Sequence: Synthetic peptide
  XENP020415 vhCDR3
SDDGYSYAMDY

SEQ ID NO: 22546 - protein, 213 aa, Artificial Sequence; identical to SEQ ID NO: 22466
  Description of Artificial Sequence: Synthetic polypeptide
  XENP020415 4C8_H0L0_IgG1_PVA_/S267K Light Chain

SEQ ID NO: 22547 - protein, 106 aa, Artificial Sequence; identical to SEQ ID NO: 22467
  Description of Artificial Sequence: Synthetic polypeptide
  VL of XENP020415

SEQ ID NO: 22548 - protein, 11 aa, Artificial Sequence
  Description of Artificial Sequence: Synthetic peptide
  XENP020415 vlCDR1
RASQDISNYLN

SEQ ID NO: 22549 - protein, 7 aa, Artificial Sequence
  Description of Artificial Sequence: Synthetic peptide
  XENP020415 vlCDR2
YTSRLHS

SEQ ID NO: 22550 - protein, 8 aa, Artificial Sequence
  Description of Artificial Sequence: Synthetic peptide
  XENP020415 vlCDR3
QQGNTLWT

SEQ ID NO: 22551 - protein, 449 aa, Artificial Sequence; identical to SEQ ID NO: 22471
  Description of Artificial Sequence: Synthetic polypeptide
  XENP020416 4C8_H2L1_IgG1_PVA_/S267K Heavy Chain

SEQ ID NO: 22552 - protein, 120 aa, Artificial Sequence; identical to SEQ ID NO: 22472
  Description of Artificial Sequence: Synthetic polypeptide
  VH of XENP020416

SEQ ID NO: 22553 - protein, 5 aa, Artificial Sequence
  Description of Artificial Sequence: Synthetic peptide
  XENP020416 vhCDR1
DYNVH

SEQ ID NO: 22554 - protein, 17 aa, Artificial Sequence
  Description of Artificial Sequence: Synthetic peptide
  XENP020416 vhCDR2
YIYPYTGGTGYNQKFQG

SEQ ID NO: 22555 - protein, 11 aa, Artificial Sequence
  Description of Artificial Sequence: Synthetic peptide
  XENP020416 vhCDR3
SDDGYSYAMDY

SEQ ID NO: 22556 - protein, 213 aa, Artificial Sequence; identical to SEQ ID NO: 22116
  Description of Artificial Sequence: Synthetic polypeptide
  XENP020416 4C8_H2L1_IgG1_PVA_/S267K Light Chain

SEQ ID NO: 22557 - protein, 106 aa, Artificial Sequence; identical to SEQ ID NO: 22117
  Description of Artificial Sequence: Synthetic polypeptide
  VL of XENP020416

SEQ ID NO: 22558 - protein, 11 aa, Artificial Sequence
  Description of Artificial Sequence: Synthetic peptide
  XENP020416 vlCDR1
QASQDISNYLN

SEQ ID NO: 22559 - protein, 7 aa, Artificial Sequence
  Description of Artificial Sequence: Synthetic peptide
  XENP020416 vlCDR2
YTSRLHS

SEQ ID NO: 22560 - protein, 8 aa, Artificial Sequence
  Description of Artificial Sequence: Synthetic peptide
  XENP020416 vlCDR3
QQGNTLWT

SEQ ID NO: 22561 - protein, 450 aa, Artificial Sequence; identical to SEQ ID NO: 22481
  Description of Artificial Sequence: Synthetic polypeptide
  XENP020417 7G8_H3L1_IgG1_PVA_/S267K Heavy Chain

SEQ ID NO: 22562 - protein, 121 aa, Artificial Sequence; identical to SEQ ID NO: 22482
  Description of Artificial Sequence: Synthetic polypeptide
  VH of XENP020417

SEQ ID NO: 22563 - protein, 5 aa, Artificial Sequence
  Description of Artificial Sequence: Synthetic peptide
  XENP020417 vhCDR1
DAWMD

SEQ ID NO: 22564 - protein, 19 aa, Artificial Sequence
  Description of Artificial Sequence: Synthetic peptide
  XENP020417 vhCDR2
EIRTKANNHATYYAESVKG

SEQ ID NO: 22565 - protein, 10 aa, Artificial Sequence
  Description of Artificial Sequence: Synthetic peptide
  XENP020417 vhCDR3
LANWDWYFDV

SEQ ID NO: 22566 - protein, 218 aa, Artificial Sequence; identical to SEQ ID NO: 22276
  Description of Artificial Sequence: Synthetic polypeptide
  XENP020417 7G8_H3L1_IgG1_PVA_/S267K Light Chain

SEQ ID NO: 22567 - protein, 111 aa, Artificial Sequence; identical to SEQ ID NO: 22277
  Description of Artificial Sequence: Synthetic polypeptide
  VL of XENP020417

SEQ ID NO: 22568 - protein, 15 aa, Artificial Sequence
  Description of Artificial Sequence: Synthetic peptide
  XENP020417 vlCDR1
RASQSVDYDGDSYMN

SEQ ID NO: 22569 - protein, 7 aa, Artificial Sequence
  Description of Artificial Sequence: Synthetic peptide
  XENP020417 vlCDR2
AASNLES

SEQ ID NO: 22570 - protein, 9 aa, Artificial Sequence
  Description of Artificial Sequence: Synthetic peptide
  XENP020417 vlCDR3
QQSNEDPFT

SEQ ID NO: 22571 - protein, 450 aa, Artificial Sequence; identical to SEQ ID NO: 22481
  Description of Artificial Sequence: Synthetic polypeptide
  XENP020418 7G8_H3L2_IgG1_PVA_/S267K Heavy Chain

SEQ ID NO: 22572 - protein, 121 aa, Artificial Sequence; identical to SEQ ID NO: 22482
  Description of Artificial Sequence: Synthetic polypeptide
  VH of XENP020418

SEQ ID NO: 22573 - protein, 5 aa, Artificial Sequence
  Description of Artificial Sequence: Synthetic peptide
  XENP020418 vhCDR1
DAWMD

SEQ ID NO: 22574 - protein, 19 aa, Artificial Sequence
  Description of Artificial Sequence: Synthetic peptide
  XENP020418 vhCDR2
EIRTKANNHATYYAESVKG

SEQ ID NO: 22575 - protein, 10 aa, Artificial Sequence
  Description of Artificial Sequence: Synthetic peptide
  XENP020418 vhCDR3
LANWDWYFDV

SEQ ID NO: 22576 - protein, 218 aa, Artificial Sequence; identical to SEQ ID NO: 22286
  Description of Artificial Sequence: Synthetic polypeptide
  XENP020418 7G8_H3L2_IgG1_PVA_/S267K Light Chain

SEQ ID NO: 22577 - protein, 111 aa, Artificial Sequence; identical to SEQ ID NO: 22287
  Description of Artificial Sequence: Synthetic polypeptide
  VL of XENP020418

SEQ ID NO: 22578 - protein, 15 aa, Artificial Sequence
  Description of Artificial Sequence: Synthetic peptide
  XENP020418 vlCDR1
RASQSVDYDGDSYMN

SEQ ID NO: 22579 - protein, 7 aa, Artificial Sequence
  Description of Artificial Sequence: Synthetic peptide
  XENP020418 vlCDR2
AASNLES

SEQ ID NO: 22580 - protein, 9 aa, Artificial Sequence
  Description of Artificial Sequence: Synthetic peptide
  XENP020418 vlCDR3
QQSNEDPFT

SEQ ID NO: 22581 - protein, 450 aa, Artificial Sequence; identical to SEQ ID NO: 22481
  Description of Artificial Sequence: Synthetic polypeptide
  XENP020419 7G8_H3L3_IgG1_PVA_/S267K Heavy Chain

SEQ ID NO: 22582 - protein, 121 aa, Artificial Sequence; identical to SEQ ID NO: 22482
  Description of Artificial Sequence: Synthetic polypeptide
  VH of XENP020419

SEQ ID NO: 22583 - protein, 5 aa, Artificial Sequence
  Description of Artificial Sequence: Synthetic peptide
  XENP020419 vhCDR1
DAWMD

SEQ ID NO: 22584 - protein, 19 aa, Artificial Sequence
  Description of Artificial Sequence: Synthetic peptide
  XENP020419 vhCDR2
EIRTKANNHATYYAESVKG

SEQ ID NO: 22585 - protein, 10 aa, Artificial Sequence
  Description of Artificial Sequence: Synthetic peptide
  XENP020419 vhCDR3
LANWDWYFDV

SEQ ID NO: 22586 - protein, 218 aa, Artificial Sequence; identical to SEQ ID NO: 22296
  Description of Artificial Sequence: Synthetic polypeptide
  XENP020419 7G8_H3L3_IgG1_PVA_/S267K Light Chain

SEQ ID NO: 22587 - protein, 111 aa, Artificial Sequence; identical to SEQ ID NO: 22297
  Description of Artificial Sequence: Synthetic polypeptide
  VL of XENP020419

SEQ ID NO: 22588 - protein, 15 aa, Artificial Sequence
  Description of Artificial Sequence: Synthetic peptide
  XENP020419 vlCDR1
KASQSVDYDGDSYMN

SEQ ID NO: 22589 - protein, 7 aa, Artificial Sequence
  Description of Artificial Sequence: Synthetic peptide
  XENP020419 vlCDR2
AASNLES

SEQ ID NO: 22590 - protein, 9 aa, Artificial Sequence
  Description of Artificial Sequence: Synthetic peptide
  XENP020419 vlCDR3
QQSNEDPFT

SEQ ID NO: 22591 - protein, 449 aa, Artificial Sequence; identical to SEQ ID NO: 22111
  Description of Artificial Sequence: Synthetic polypeptide
  XENP020420 4C8_H1L2_IgG1_PVA_/S267K Heavy Chain

SEQ ID NO: 22592 - protein, 120 aa, Artificial Sequence; identical to SEQ ID NO: 22112
  Description of Artificial Sequence: Synthetic polypeptide
  VH of XENP020420

SEQ ID NO: 22593 - protein, 5 aa, Artificial Sequence
  Description of Artificial Sequence: Synthetic peptide
  XENP020420 vhCDR1
DYNMH

SEQ ID NO: 22594 - protein, 17 aa, Artificial Sequence
  Description of Artificial Sequence: Synthetic peptide
  XENP020420 vhCDR2
YIYPYTGGTGYNQKFQG

SEQ ID NO: 22595 - protein, 11 aa, Artificial Sequence
  Description of Artificial Sequence: Synthetic peptide
  XENP020420 vhCDR3
SDDGYSYAMDY

SEQ ID NO: 22596 - protein, 213 aa, Artificial Sequence
  Description of Artificial Sequence: Synthetic polypeptide
  XENP020420 4C8_H1L2_IgG1_PVA_/S267K Light Chain
DIQMTQSPSSLSASVGDRVTITCRASQDISNYLNWYQQKPGKAPKLLIYYTSRLHSGVPSRFSGSGSGTDYTLTISSLQPEDFATYFCQQGNTLWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 22597 - protein, 106 aa, Artificial Sequence
  Description of Artificial Sequence: Synthetic polypeptide
  VL of XENP020420
DIQMTQSPSSLSASVGDRVTITCRASQDISNYLNWYQQKPGKAPKLLIYYTSRLHSGVPSRFSGSGSGTDYTLTISSLQPEDFATYFCQQGNTLWTFGGGTKVEIK

SEQ ID NO: 22598 - protein, 11 aa, Artificial Sequence
  Description of Artificial Sequence: Synthetic peptide
  XENP020420 vlCDR1
RASQDISNYLN

SEQ ID NO: 22599 - protein, 7 aa, Artificial Sequence
  Description of Artificial Sequence: Synthetic peptide
  XENP020420 vlCDR2
YTSRLHS

SEQ ID NO: 22600 - protein, 8 aa, Artificial Sequence
  Description of Artificial Sequence: Synthetic peptide
  XENP020420 vlCDR3
QQGNTLWT

SEQ ID NO: 22601 - protein, 449 aa, Artificial Sequence; identical to SEQ ID NO: 22471
  Description of Artificial Sequence: Synthetic polypeptide
  XENP020421 4C8_H2L2_IgG1_PVA_/S267K Heavy Chain

SEQ ID NO: 22602 - protein, 120 aa, Artificial Sequence; identical to SEQ ID NO: 22472
  Description of Artificial Sequence: Synthetic polypeptide
  VH of XENP020421

SEQ ID NO: 22603 - protein, 5 aa, Artificial Sequence
  Description of Artificial Sequence: Synthetic peptide
  XENP020421 vhCDR1
DYNVH

SEQ ID NO: 22604 - protein, 17 aa, Artificial Sequence
  Description of Artificial Sequence: Synthetic peptide
  XENP020421 vhCDR2
YIYPYTGGTGYNQKFQG

SEQ ID NO: 22605 - protein, 11 aa, Artificial Sequence
  Description of Artificial Sequence: Synthetic peptide
  XENP020421 vhCDR3
SDDGYSYAMDY

SEQ ID NO: 22606 - protein, 213 aa, Artificial Sequence; identical to SEQ ID NO: 22596
  Description of Artificial Sequence: Synthetic polypeptide
  XENP020421 4C8_H2L2_IgG1_PVA_/S267K Light Chain

SEQ ID NO: 22607 - protein, 106 aa, Artificial Sequence; identical to SEQ ID NO: 22597
  Description of Artificial Sequence: Synthetic polypeptide
  VL of XENP020421

SEQ ID NO: 22608 - protein, 11 aa, Artificial Sequence
  Description of Artificial Sequence: Synthetic peptide
  XENP020421 vlCDR1
RASQDISNYLN

SEQ ID NO: 22609 - protein, 7 aa, Artificial Sequence
  Description of Artificial Sequence: Synthetic peptide
  XENP020421 vlCDR2
YTSRLHS

SEQ ID NO: 22610 - protein, 8 aa, Artificial Sequence
  Description of Artificial Sequence: Synthetic peptide
  XENP020421 vlCDR3
QQGNTLWT

SEQ ID NO: 22611 - protein, 447 aa, Artificial Sequence; identical to SEQ ID NO: 21901
  Description of Artificial Sequence: Synthetic polypeptide
  XENP019361 2A11_H0L0_IgG1_PVA_/S267K Heavy Chain

SEQ ID NO: 22612 - protein, 118 aa, Artificial Sequence; identical to SEQ ID NO: 21902
  Description of Artificial Sequence: Synthetic polypeptide
  VH of XENP019361

SEQ ID NO: 22613 - protein, 5 aa, Artificial Sequence
  Description of Artificial Sequence: Synthetic peptide
  XENP019361 vhCDR1
DYYMH

SEQ ID NO: 22614 - protein, 17 aa, Artificial Sequence
  Description of Artificial Sequence: Synthetic peptide
  XENP019361 vhCDR2
WIDPENGDTEYAPKFQG

SEQ ID NO: 22615 - protein, 9 aa, Artificial Sequence
  Description of Artificial Sequence: Synthetic peptide
  XENP019361 vhCDR3
RGVRQALDY

SEQ ID NO: 22616 - protein, 214 aa, Artificial Sequence; identical to SEQ ID NO: 21906
  Description of Artificial Sequence: Synthetic polypeptide
  XENP019361 2A11_H0L0_IgG1_PVA_/S267K Light Chain

SEQ ID NO: 22617 - protein, 107 aa, Artificial Sequence; identical to SEQ ID NO: 21907
  Description of Artificial Sequence: Synthetic polypeptide
  VL of XENP019361

SEQ ID NO: 22618 - protein, 11 aa, Artificial Sequence
  Description of Artificial Sequence: Synthetic peptide
  XENP019361 vlCDR1
RASQDIGNYLN

SEQ ID NO: 22619 - protein, 7 aa, Artificial Sequence
  Description of Artificial Sequence: Synthetic peptide
  XENP019361 vlCDR2
YTSRLHS

SEQ ID NO: 22620 - protein, 9 aa, Artificial Sequence
  Description of Artificial Sequence: Synthetic peptide
  XENP019361 vlCDR3
QQGNTLPYT

SEQ ID NO: 22621 - protein, 447 aa, Artificial Sequence; identical to SEQ ID NO: 2885
  Description of Artificial Sequence: Synthetic polypeptide
  XENP019362 2A11_H1L1_IgG1_PVA_/S267K Heavy Chain

SEQ ID NO: 22622 - protein, 118 aa, Artificial Sequence; identical to SEQ ID NO: 2686
  Description of Artificial Sequence: Synthetic polypeptide
  VH of XENP019362

SEQ ID NO: 22623 - protein, 5 aa, Artificial Sequence
  Description of Artificial Sequence: Synthetic peptide
  XENP019362 vhCDR1
DYYMH

SEQ ID NO: 22624 - protein, 17 aa, Artificial Sequence
  Description of Artificial Sequence: Synthetic peptide
  XENP019362 vhCDR2
WIDPENGDTEYAPKFQG

SEQ ID NO: 22625 - protein, 9 aa, Artificial Sequence
  Description of Artificial Sequence: Synthetic peptide
  XENP019362 vhCDR3
RGVRQALDY

SEQ ID NO: 22626 - protein, 214 aa, Artificial Sequence; identical to SEQ ID NO: 21916
  Description of Artificial Sequence: Synthetic polypeptide
  XENP019362 2A11_H1L1_IgG1_PVA_/S267K Light Chain

SEQ ID NO: 22627 - protein, 107 aa, Artificial Sequence; identical to SEQ ID NO: 21917
  Description of Artificial Sequence: Synthetic polypeptide
  VL of XENP019362

SEQ ID NO: 22628 - protein, 11 aa, Artificial Sequence
  Description of Artificial Sequence: Synthetic peptide
  XENP019362 vlCDR1
RASQDIGNYLN

SEQ ID NO: 22629 - protein, 7 aa, Artificial Sequence
  Description of Artificial Sequence: Synthetic peptide
  XENP019362 vlCDR2
YTSRLHS

SEQ ID NO: 22630 - protein, 9 aa, Artificial Sequence
  Description of Artificial Sequence: Synthetic peptide
  XENP019362 vlCDR3
QQGNTLPYT

SEQ ID NO: 22631 - protein, 447 aa, Artificial Sequence; identical to SEQ ID NO: 2885
  Description of Artificial Sequence: Synthetic polypeptide
  XENP019363 2A11_H1L2_IgG1_PVA_/S267K Heavy Chain

SEQ ID NO: 22632 - protein, 118 aa, Artificial Sequence; identical to SEQ ID NO: 2686
  Description of Artificial Sequence: Synthetic polypeptide
  VH of XENP019363

SEQ ID NO: 22633 - protein, 5 aa, Artificial Sequence
  Description of Artificial Sequence: Synthetic peptide
  XENP019363 vhCDR1
DYYMH

SEQ ID NO: 22634 - protein, 17 aa, Artificial Sequence
  Description of Artificial Sequence: Synthetic peptide
  XENP019363 vhCDR2
WIDPENGDTEYAPKFQG

SEQ ID NO: 22635 - protein, 9 aa, Artificial Sequence
  Description of Artificial Sequence: Synthetic peptide
  XENP019363 vhCDR3
RGVRQALDY

SEQ ID NO: 22636 - protein, 214 aa, Artificial Sequence; identical to SEQ ID NO: 2880
  Description of Artificial Sequence: Synthetic polypeptide
  XENP019363 2A11_H1L2_IgG1_PVA_/S267K Light Chain

SEQ ID NO: 22637 - protein, 107 aa, Artificial Sequence; identical to SEQ ID NO: 2881
  Description of Artificial Sequence: Synthetic polypeptide
  VL of XENP019363

SEQ ID NO: 22638 - protein, 11 aa, Artificial Sequence
  Description of Artificial Sequence: Synthetic peptide
  XENP019363 vlCDR1
QASQDIGNYLN

SEQ ID NO: 22639 - protein, 7 aa, Artificial Sequence
  Description of Artificial Sequence: Synthetic peptide
  XENP019363 vlCDR2
YTSRLHS

SEQ ID NO: 22640 - protein, 9 aa, Artificial Sequence
  Description of Artificial Sequence: Synthetic peptide
  XENP019363 vlCDR3
QQGNTLPYT

SEQ ID NO: 22641 - protein, 446 aa, Artificial Sequence; identical to SEQ ID NO: 21931
  Description of Artificial Sequence: Synthetic polypeptide
  XENP019364 2A11_H2L1_IgG1_PVA_/S267K Heavy Chain

SEQ ID NO: 22642 - protein, 117 aa, Artificial Sequence; identical to SEQ ID NO: 21932
  Description of Artificial Sequence: Synthetic polypeptide
  VH of XENP019364

SEQ ID NO: 22643 - protein, 5 aa, Artificial Sequence
  Description of Artificial Sequence: Synthetic peptide
  XENP019364 vhCDR1
DYYMH

SEQ ID NO: 22644 - protein, 17 aa, Artificial Sequence
  Description of Artificial Sequence: Synthetic peptide
  XENP019364 vhCDR2
WIDPENGDTEYAPKFQG

SEQ ID NO: 22645 - protein, 8 aa, Artificial Sequence
  Description of Artificial Sequence: Synthetic peptide
  XENP019364 vhCDR3
GVRQALDY

SEQ ID NO: 22646 - protein, 214 aa, Artificial Sequence; identical to SEQ ID NO: 21916
  Description of Artificial Sequence: Synthetic polypeptide
  XENP019364 2A11_H2L1_IgG1_PVA_/S267K Light Chain

SEQ ID NO: 22647 - protein, 107 aa, Artificial Sequence; identical to SEQ ID NO: 21917
  Description of Artificial Sequence: Synthetic polypeptide
  VL of XENP019364

SEQ ID NO: 22648 - protein, 11 aa, Artificial Sequence
  Description of Artificial Sequence: Synthetic peptide
  XENP019364 vlCDR1
RASQDIGNYLN

SEQ ID NO: 22649 - protein, 7 aa, Artificial Sequence
  Description of Artificial Sequence: Synthetic peptide
  XENP019364 vlCDR2
YTSRLHS

SEQ ID NO: 22650 - protein, 9 aa, Artificial Sequence
  Description of Artificial Sequence: Synthetic peptide
  XENP019364 vlCDR3
QQGNTLPYT

SEQ ID NO: 22651 - protein, 446 aa, Artificial Sequence; identical to SEQ ID NO: 21931
  Description of Artificial Sequence: Synthetic polypeptide
  XENP019365 2A11_H2L2_IgG1_PVA_/S267K Heavy Chain

SEQ ID NO: 22652 - protein, 117 aa, Artificial Sequence; identical to SEQ ID NO: 21932
  Description of Artificial Sequence: Synthetic polypeptide
  VH of XENP019365

SEQ ID NO: 22653 - protein, 5 aa, Artificial Sequence
  Description of Artificial Sequence: Synthetic peptide
  XENP019365 vhCDR1
DYYMH

SEQ ID NO: 22654 - protein, 17 aa, Artificial Sequence
  Description of Artificial Sequence: Synthetic peptide
  XENP019365 vhCDR2
WIDPENGDTEYAPKFQG

SEQ ID NO: 22655 - protein, 8 aa, Artificial Sequence
  Description of Artificial Sequence: Synthetic peptide
  XENP019365 vhCDR3
GVRQALDY

SEQ ID NO: 22656 - protein, 214 aa, Artificial Sequence; identical to SEQ ID NO: 2880
  Description of Artificial Sequence: Synthetic polypeptide
  XENP019365 2A11_H2L2_IgG1_PVA_/S267K Light Chain

SEQ ID NO: 22657 - protein, 107 aa, Artificial Sequence; identical to SEQ ID NO: 2881
  Description of Artificial Sequence: Synthetic polypeptide
  VL of XENP019365

SEQ ID NO: 22658 - protein, 11 aa, Artificial Sequence
  Description of Artificial Sequence: Synthetic peptide
  XENP019365 vlCDR1
QASQDIGNYLN

SEQ ID NO: 22659 - protein, 7 aa, Artificial Sequence
  Description of Artificial Sequence: Synthetic peptide
  XENP019365 vlCDR2
YTSRLHS

SEQ ID NO: 22660 - protein, 9 aa, Artificial Sequence
  Description of Artificial Sequence: Synthetic peptide
  XENP019365 vlCDR3
QQGNTLPYT

SEQ ID NO: 22661 - protein, 447 aa, Artificial Sequence; identical to SEQ ID NO: 21951
  Description of Artificial Sequence: Synthetic polypeptide
  XENP019366 2A11_H3L1_IgG1_PVA_/S267K Heavy Chain

SEQ ID NO: 22662 - protein, 118 aa, Artificial Sequence; identical to SEQ ID NO: 21952
  Description of Artificial Sequence: Synthetic polypeptide
  VH of XENP019366

SEQ ID NO: 22663 - protein, 5 aa, Artificial Sequence
  Description of Artificial Sequence: Synthetic peptide
  XENP019366 vhCDR1
DYYMH

SEQ ID NO: 22664 - protein, 17 aa, Artificial Sequence
  Description of Artificial Sequence: Synthetic peptide
  XENP019366 vhCDR2
WIDPENGDTEYAPSVKG

SEQ ID NO: 22665 - protein, 9 aa, Artificial Sequence
  Description of Artificial Sequence: Synthetic peptide
  XENP019366 vhCDR3
RGVRQALDY

SEQ ID NO: 22666 - protein, 214 aa, Artificial Sequence; identical to SEQ ID NO: 21916
  Description of Artificial Sequence: Synthetic polypeptide
  XENP019366 2A11_H3L1_IgG1_PVA_/S267K Light Chain

SEQ ID NO: 22667 - protein, 107 aa, Artificial Sequence; identical to SEQ ID NO: 21917
  Description of Artificial Sequence: Synthetic polypeptide
  VL of XENP019366

SEQ ID NO: 22668 - protein, 11 aa, Artificial Sequence
  Description of Artificial Sequence: Synthetic peptide
  XENP019366 vlCDR1
RASQDIGNYLN

SEQ ID NO: 22669 - protein, 7 aa, Artificial Sequence
  Description of Artificial Sequence: Synthetic peptide
  XENP019366 vlCDR2
YTSRLHS

SEQ ID NO: 22670 - protein, 9 aa, Artificial Sequence
  Description of Artificial Sequence: Synthetic peptide
  XENP019366 vlCDR3
QQGNTLPYT

SEQ ID NO: 22671 - protein, 447 aa, Artificial Sequence; identical to SEQ ID NO: 21951
  Description of Artificial Sequence: Synthetic polypeptide
  XENP019367 2A11_H3L2_IgG1_PVA_/S267K Heavy Chain

SEQ ID NO: 22672 - protein, 118 aa, Artificial Sequence; identical to SEQ ID NO: 21952
  Description of Artificial Sequence: Synthetic polypeptide
  VH of XENP019367

SEQ ID NO: 22673 - protein, 5 aa, Artificial Sequence
  Description of Artificial Sequence: Synthetic peptide
  XENP019367 vhCDR1
DYYMH

SEQ ID NO: 22674 - protein, 17 aa, Artificial Sequence
  Description of Artificial Sequence: Synthetic peptide
  XENP019367 vhCDR2
WIDPENGDTEYAPSVKG

SEQ ID NO: 22675 - protein, 9 aa, Artificial Sequence
  Description of Artificial Sequence: Synthetic peptide
  XENP019367 vhCDR3
RGVRQALDY

SEQ ID NO: 22676 - protein, 214 aa, Artificial Sequence; identical to SEQ ID NO: 2880
  Description of Artificial Sequence: Synthetic polypeptide
  XENP019367 2A11_H3L2_IgG1_PVA_/S267K Light Chain

SEQ ID NO: 22677 - protein, 107 aa, Artificial Sequence; identical to SEQ ID NO: 2881
  Description of Artificial Sequence: Synthetic polypeptide
  VL of XENP019367

SEQ ID NO: 22678 - protein, 11 aa, Artificial Sequence
  Description of Artificial Sequence: Synthetic peptide
  XENP019367 vlCDR1
QASQDIGNYLN

SEQ ID NO: 22679 - protein, 7 aa, Artificial Sequence
  Description of Artificial Sequence: Synthetic peptide
  XENP019367 vlCDR2
YTSRLHS

SEQ ID NO: 22680 - protein, 9 aa, Artificial Sequence
  Description of Artificial Sequence: Synthetic peptide
  XENP019367 vlCDR3
QQGNTLPYT

SEQ ID NO: 22681 - protein, 446 aa, Artificial Sequence; identical to SEQ ID NO: 21971
  Description of Artificial Sequence: Synthetic polypeptide
  XENP019368 2A11_H4L1_IgG1_PVA_/S267K Heavy Chain

SEQ ID NO: 22682 - protein, 117 aa, Artificial Sequence; identical to SEQ ID NO: 21972
  Description of Artificial Sequence: Synthetic polypeptide
  VH of XENP019368

SEQ ID NO: 22683 - protein, 5 aa, Artificial Sequence
  Description of Artificial Sequence: Synthetic peptide
  XENP019368 vhCDR1
DYYMH

SEQ ID NO: 22684 - protein, 17 aa, Artificial Sequence
  Description of Artificial Sequence: Synthetic peptide
  XENP019368 vhCDR2
WIDPENGDTEYAPSVKG

SEQ ID NO: 22685 - protein, 8 aa, Artificial Sequence
  Description of Artificial Sequence: Synthetic peptide
  XENP019368 vhCDR3
GVRQALDY

SEQ ID NO: 22686 - protein, 214 aa, Artificial Sequence; identical to SEQ ID NO: 21916
  Description of Artificial Sequence: Synthetic polypeptide
  XENP019368 2A11_H4L1_IgG1_PVA_/S267K Light Chain

SEQ ID NO: 22687 - protein, 107 aa, Artificial Sequence; identical to SEQ ID NO: 21917
  Description of Artificial Sequence: Synthetic polypeptide
  VL of XENP019368

SEQ ID NO: 22688 - protein, 11 aa, Artificial Sequence
  Description of Artificial Sequence: Synthetic peptide
  XENP019368 vlCDR1
RASQDIGNYLN

SEQ ID NO: 22689 - protein, 7 aa, Artificial Sequence
  Description of Artificial Sequence: Synthetic peptide
  XENP019368 vlCDR2
YTSRLHS

SEQ ID NO: 22690 - protein, 9 aa, Artificial Sequence
  Description of Artificial Sequence: Synthetic peptide
  XENP019368 vlCDR3
QQGNTLPYT

SEQ ID NO: 22691 - protein, 446 aa, Artificial Sequence; identical to SEQ ID NO: 21971
  Description of Artificial Sequence: Synthetic polypeptide
  XENP019369 2A11_H4L2_IgG1_PVA_/S267K Heavy Chain

SEQ ID NO: 22692 - protein, 117 aa, Artificial Sequence; identical to SEQ ID NO: 21972
  Description of Artificial Sequence: Synthetic polypeptide
  VH of XENP019369

SEQ ID NO: 22693 - protein, 5 aa, Artificial Sequence
  Description of Artificial Sequence: Synthetic peptide
  XENP019369 vhCDR1
DYYMH

SEQ ID NO: 22694 - protein, 17 aa, Artificial Sequence
  Description of Artificial Sequence: Synthetic peptide
  XENP019369 vhCDR2
WIDPENGDTEYAPSVKG

SEQ ID NO: 22695 - protein, 8 aa, Artificial Sequence
  Description of Artificial Sequence: Synthetic peptide
  XENP019369 vhCDR3
GVRQALDY

SEQ ID NO: 22696 - protein, 214 aa, Artificial Sequence; identical to SEQ ID NO: 2880
  Description of Artificial Sequence: Synthetic polypeptide
  XENP019369 2A11_H4L2_IgG1_PVA_/S267K Light Chain

SEQ ID NO: 22697 - protein, 107 aa, Artificial Sequence; identical to SEQ ID NO: 2881
  Description of Artificial Sequence: Synthetic polypeptide
  VL of XENP019369

SEQ ID NO: 22698 - protein, 11 aa, Artificial Sequence
  Description of Artificial Sequence: Synthetic peptide
  XENP019369 vlCDR1
QASQDIGNYLN

SEQ ID NO: 22699 - protein, 7 aa, Artificial Sequence
  Description of Artificial Sequence: Synthetic peptide
  XENP019369 vlCDR2
YTSRLHS

SEQ ID NO: 22700 - protein, 9 aa, Artificial Sequence
  Description of Artificial Sequence: Synthetic peptide
  XENP019369 vlCDR3
QQGNTLPYT

SEQ ID NO: 22701 - protein, 447 aa, Artificial Sequence; identical to SEQ ID NO: 2885
  Description of Artificial Sequence: Synthetic polypeptide
  XENP020023 2A11_H1L0_IgG1_PVA_/S267K Heavy Chain

SEQ ID NO: 22702 - protein, 118 aa, Artificial Sequence; identical to SEQ ID NO: 2686
  Description of Artificial Sequence: Synthetic polypeptide
  VH of XENP020023

SEQ ID NO: 22703 - protein, 5 aa, Artificial Sequence
  Description of Artificial Sequence: Synthetic peptide
  XENP020023 vhCDR1
DYYMH

SEQ ID NO: 22704 - protein, 17 aa, Artificial Sequence
  Description of Artificial Sequence: Synthetic peptide
  XENP020023 vhCDR2
WIDPENGDTEYAPKFQG

SEQ ID NO: 22705 - protein, 9 aa, Artificial Sequence
  Description of Artificial Sequence: Synthetic peptide
  XENP020023 vhCDR3
RGVRQALDY

SEQ ID NO: 22706 - protein, 214 aa, Artificial Sequence; identical to SEQ ID NO: 21906
  Description of Artificial Sequence: Synthetic polypeptide
  XENP020023 2A11_H1L0_IgG1_PVA_/S267K Light Chain

SEQ ID NO: 22707 - protein, 107 aa, Artificial Sequence; identical to SEQ ID NO: 21907
  Description of Artificial Sequence: Synthetic polypeptide
  VL of XENP020023

SEQ ID NO: 22708 - protein, 11 aa, Artificial Sequence
  Description of Artificial Sequence: Synthetic peptide
  XENP020023 vlCDR1
RASQDIGNYLN

SEQ ID NO: 22709 - protein, 7 aa, Artificial Sequence
  Description of Artificial Sequence: Synthetic peptide
  XENP020023 vlCDR2
YTSRLHS

SEQ ID NO: 22710 - protein, 9 aa, Artificial Sequence
  Description of Artificial Sequence: Synthetic peptide
  XENP020023 vlCDR3
QQGNTLPYT

SEQ ID NO: 22711 - protein, 447 aa, Artificial Sequence; identical to SEQ ID NO: 21901
  Description of Artificial Sequence: Synthetic polypeptide
  XENP020024 2A11_H0L1_IgG1_PVA_/S267K Heavy Chain

SEQ ID NO: 22712 - protein, 118 aa, Artificial Sequence; identical to SEQ ID NO: 21902
  Description of Artificial Sequence: Synthetic polypeptide
  VH of XENP020024

SEQ ID NO: 22713 - protein, 5 aa, Artificial Sequence
  Description of Artificial Sequence: Synthetic peptide
  XENP020024 vhCDR1
DYYMH

SEQ ID NO: 22714 - protein, 17 aa, Artificial Sequence
  Description of Artificial Sequence: Synthetic peptide
  XENP020024 vhCDR2
WIDPENGDTEYAPKFQG

SEQ ID NO: 22715 - protein, 9 aa, Artificial Sequence
  Description of Artificial Sequence: Synthetic peptide
  XENP020024 vhCDR3
RGVRQALDY

SEQ ID NO: 22716 - protein, 214 aa, Artificial Sequence; identical to SEQ ID NO: 21916
  Description of Artificial Sequence: Synthetic polypeptide
  XENP020024 2A11_H0L1_IgG1_PVA_/S267K Light Chain

SEQ ID NO: 22717 - protein, 107 aa, Artificial Sequence; identical to SEQ ID NO: 21917
  Description of Artificial Sequence: Synthetic polypeptide
  VL of XENP020024

SEQ ID NO: 22718 - protein, 11 aa, Artificial Sequence
  Description of Artificial Sequence: Synthetic peptide
  XENP020024 vlCDR1
RASQDIGNYLN

SEQ ID NO: 22719 - protein, 7 aa, Artificial Sequence
  Description of Artificial Sequence: Synthetic peptide
  XENP020024 vlCDR2
YTSRLHS

SEQ ID NO: 22720 - protein, 9 aa, Artificial Sequence
  Description of Artificial Sequence: Synthetic peptide
  XENP020024 vlCDR3
QQGNTLPYT

SEQ ID NO: 22721 - protein, 450 aa, Artificial Sequence; identical to SEQ ID NO: 22261
  Description of Artificial Sequence: Synthetic polypeptide
  XENP019401 7G8_H0L0_IgG1_PVA_/S267K Heavy Chain

SEQ ID NO: 22722 - protein, 121 aa, Artificial Sequence; identical to SEQ ID NO: 22262
  Description of Artificial Sequence: Synthetic polypeptide
  VH of XENP019401

SEQ ID NO: 22723 - protein, 5 aa, Artificial Sequence
  Description of Artificial Sequence: Synthetic peptide
  XENP019401 vhCDR1
DAWMD

SEQ ID NO: 22724 - protein, 19 aa, Artificial Sequence
  Description of Artificial Sequence: Synthetic peptide
  XENP019401 vhCDR2
EIRTKANNHATYYAESVKG

SEQ ID NO: 22725 - protein, 10 aa, Artificial Sequence
  Description of Artificial Sequence: Synthetic peptide
  XENP019401 vhCDR3
LANWDWYFDV

SEQ ID NO: 22726 - protein, 218 aa, Artificial Sequence; identical to SEQ ID NO: 22266
  Description of Artificial Sequence: Synthetic polypeptide
  XENP019401 7G8_H0L0_IgG1_PVA_/S267K Light Chain

SEQ ID NO: 22727 - protein, 111 aa, Artificial Sequence; identical to SEQ ID NO: 22267
  Description of Artificial Sequence: Synthetic polypeptide
  VL of XENP019401

SEQ ID NO: 22728 - protein, 15 aa, Artificial Sequence
  Description of Artificial Sequence: Synthetic peptide
  XENP019401 vlCDR1
KASQSVDYDGDSYMN

SEQ ID NO: 22729 - protein, 7 aa, Artificial Sequence
  Description of Artificial Sequence: Synthetic peptide
  XENP019401 vlCDR2
AASNLES

SEQ ID NO: 22730 - protein, 9 aa, Artificial Sequence
  Description of Artificial Sequence: Synthetic peptide
  XENP019401 vlCDR3
QQSNEDPFT

SEQ ID NO: 22731 - protein, 450 aa, Artificial Sequence; identical to SEQ ID NO: 22271
  Description of Artificial Sequence: Synthetic polypeptide
  XENP019402 7G8_H1L1_IgG1_PVA_/S267K Heavy Chain

SEQ ID NO: 22732 - protein, 121 aa, Artificial Sequence; identical to SEQ ID NO: 22272
  Description of Artificial Sequence: Synthetic polypeptide
  VH of XENP019402

SEQ ID NO: 22733 - protein, 5 aa, Artificial Sequence
  Description of Artificial Sequence: Synthetic peptide
  XENP019402 vhCDR1
DAWMD

SEQ ID NO: 22734 - protein, 19 aa, Artificial Sequence
  Description of Artificial Sequence: Synthetic peptide
  XENP019402 vhCDR2
EIRTKANNHATYYAEKFQG

SEQ ID NO: 22735 - protein, 10 aa, Artificial Sequence
  Description of Artificial Sequence: Synthetic peptide
  XENP019402 vhCDR3
LANWDWYFDV

SEQ ID NO: 22736 - protein, 218 aa, Artificial Sequence; identical to SEQ ID NO: 22276
  Description of Artificial Sequence: Synthetic polypeptide
  XENP019402 7G8_H1L1_IgG1_PVA_/S267K Light Chain

SEQ ID NO: 22737 - protein, 111 aa, Artificial Sequence; identical to SEQ ID NO: 22277
  Description of Artificial Sequence: Synthetic polypeptide
  VL of XENP019402

SEQ ID NO: 22738 - protein, 15 aa, Artificial Sequence
  Description of Artificial Sequence: Synthetic peptide
  XENP019402 vlCDR1
RASQSVDYDGDSYMN

SEQ ID NO: 22739 - protein, 7 aa, Artificial Sequence
  Description of Artificial Sequence: Synthetic peptide
  XENP019402 vlCDR2
AASNLES

SEQ ID NO: 22740 - protein, 9 aa, Artificial Sequence
  Description of Artificial Sequence: Synthetic peptide
  XENP019402 vlCDR3
QQSNEDPFT

SEQ ID NO: 22741 - protein, 450 aa, Artificial Sequence; identical to SEQ ID NO: 22271
  Description of Artificial Sequence: Synthetic polypeptide
  XENP019403 7G8_H1L2_IgG1_PVA_/S267K Heavy Chain

SEQ ID NO: 22742 - protein, 121 aa, Artificial Sequence; identical to SEQ ID NO: 22272
  Description of Artificial Sequence: Synthetic polypeptide
  VH of XENP019403

SEQ ID NO: 22743 - protein, 5 aa, Artificial Sequence
  Description of Artificial Sequence: Synthetic peptide
  XENP019403 vhCDR1
DAWMD

SEQ ID NO: 22744 - protein, 19 aa, Artificial Sequence
  Description of Artificial Sequence: Synthetic peptide
  XENP019403 vhCDR2
EIRTKANNHATYYAEKFQG

SEQ ID NO: 22745 - protein, 10 aa, Artificial Sequence
  Description of Artificial Sequence: Synthetic peptide
  XENP019403 vhCDR3
LANWDWYFDV

SEQ ID NO: 22746 - protein, 218 aa, Artificial Sequence; identical to SEQ ID NO: 22286
  Description of Artificial Sequence: Synthetic polypeptide
  XENP019403 7G8_H1L2_IgG1_PVA_/S267K Light Chain

SEQ ID NO: 22747 - protein, 111 aa, Artificial Sequence; identical to SEQ ID NO: 22287
  Description of Artificial Sequence: Synthetic polypeptide
  VL of XENP019403

SEQ ID NO: 22748 - protein, 15 aa, Artificial Sequence
  Description of Artificial Sequence: Synthetic peptide
  XENP019403 vlCDR1
RASQSVDYDGDSYMN

SEQ ID NO: 22749 - protein, 7 aa, Artificial Sequence
  Description of Artificial Sequence: Synthetic peptide
  XENP019403 vlCDR2
AASNLES

SEQ ID NO: 22750 - protein, 9 aa, Artificial Sequence
  Description of Artificial Sequence: Synthetic peptide
  XENP019403 vlCDR3
QQSNEDPFT

SEQ ID NO: 22751 - protein, 450 aa, Artificial Sequence; identical to SEQ ID NO: 22271
  Description of Artificial Sequence: Synthetic polypeptide
  XENP019404 7G8_H1L3_IgG1_PVA_/S267K Heavy Chain

SEQ ID NO: 22752 - protein, 121 aa, Artificial Sequence; identical to SEQ ID NO: 22272
  Description of Artificial Sequence: Synthetic polypeptide
  VH of XENP019404

SEQ ID NO: 22753 - protein, 5 aa, Artificial Sequence
  Description of Artificial Sequence: Synthetic peptide
  XENP019404 vhCDR1
DAWMD

SEQ ID NO: 22754 - protein, 19 aa, Artificial Sequence
  Description of Artificial Sequence: Synthetic peptide
  XENP019404 vhCDR2
EIRTKANNHATYYAEKFQG

SEQ ID NO: 22755 - protein, 10 aa, Artificial Sequence
  Description of Artificial Sequence: Synthetic peptide
  XENP019404 vhCDR3
LANWDWYFDV

SEQ ID NO: 22756 - protein, 218 aa, Artificial Sequence; identical to SEQ ID NO: 22296
  Description of Artificial Sequence: Synthetic polypeptide
  XENP019404 7G8_H1L3_IgG1_PVA_/S267K Light Chain

SEQ ID NO: 22757 - protein, 111 aa, Artificial Sequence; identical to SEQ ID NO: 22297
  Description of Artificial Sequence: Synthetic polypeptide
  VL of XENP019404

SEQ ID NO: 22758 - protein, 15 aa, Artificial Sequence
  Description of Artificial Sequence: Synthetic peptide
  XENP019404 vlCDR1
KASQSVDYDGDSYMN

SEQ ID NO: 22759 - protein, 7 aa, Artificial Sequence
  Description of Artificial Sequence: Synthetic peptide
  XENP019404 vlCDR2
AASNLES

SEQ ID NO: 22760 - protein, 9 aa, Artificial Sequence
  Description of Artificial Sequence: Synthetic peptide
  XENP019404 vlCDR3
QQSNEDPFT

SEQ ID NO: 22761 - protein, 450 aa, Artificial Sequence; identical to SEQ ID NO: 22301
  Description of Artificial Sequence: Synthetic polypeptide
  XENP019405 7G8_H2L1_IgG1_PVA_/S267K Heavy Chain

SEQ ID NO: 22762 - protein, 121 aa, Artificial Sequence; identical to SEQ ID NO: 22302
  Description of Artificial Sequence: Synthetic polypeptide
  VH of XENP019405

SEQ ID NO: 22763 - protein, 5 aa, Artificial Sequence
  Description of Artificial Sequence: Synthetic peptide
  XENP019405 vhCDR1
DAWMD

SEQ ID NO: 22764 - protein, 19 aa, Artificial Sequence
  Description of Artificial Sequence: Synthetic peptide
  XENP019405 vhCDR2
EIRTKANNHATYYAESVKG

SEQ ID NO: 22765 - protein, 10 aa, Artificial Sequence
  Description of Artificial Sequence: Synthetic peptide
  XENP019405 vhCDR3
LANWDWYFDV

SEQ ID NO: 22766 - protein, 218 aa, Artificial Sequence; identical to SEQ ID NO: 22276
  Description of Artificial Sequence: Synthetic polypeptide
  XENP019405 7G8_H2L1_IgG1_PVA_/S267K Light Chain

SEQ ID NO: 22767 - protein, 111 aa, Artificial Sequence; identical to SEQ ID NO: 22277
  Description of Artificial Sequence: Synthetic polypeptide
  VL of XENP019405

SEQ ID NO: 22768 - protein, 15 aa, Artificial Sequence
  Description of Artificial Sequence: Synthetic peptide
  XENP019405 vlCDR1
RASQSVDYDGDSYMN

SEQ ID NO: 22769 - protein, 7 aa, Artificial Sequence
  Description of Artificial Sequence: Synthetic peptide
  XENP019405 vlCDR2
AASNLES

SEQ ID NO: 22770 - protein, 9 aa, Artificial Sequence
  Description of Artificial Sequence: Synthetic peptide
  XENP019405 vlCDR3
QQSNEDPFT

SEQ ID NO: 22771 - protein, 450 aa, Artificial Sequence; identical to SEQ ID NO: 22301
  Description of Artificial Sequence: Synthetic polypeptide
  XENP019406 7G8_H2L2_IgG1_PVA_/S267K Heavy Chain

SEQ ID NO: 22772 - protein, 121 aa, Artificial Sequence; identical to SEQ ID NO: 22302
  Description of Artificial Sequence: Synthetic polypeptide
  VH of XENP019406

SEQ ID NO: 22773 - protein, 5 aa, Artificial Sequence
  Description of Artificial Sequence: Synthetic peptide
  XENP019406 vhCDR1
DAWMD

SEQ ID NO: 22774 - protein, 19 aa, Artificial Sequence
  Description of Artificial Sequence: Synthetic peptide
  XENP019406 vhCDR2
EIRTKANNHATYYAESVKG

SEQ ID NO: 22775 - protein, 10 aa, Artificial Sequence
  Description of Artificial Sequence: Synthetic peptide
  XENP019406 vhCDR3
LANWDWYFDV

SEQ ID NO: 22776 - protein, 218 aa, Artificial Sequence; identical to SEQ ID NO: 22286
  Description of Artificial Sequence: Synthetic polypeptide
  XENP019406 7G8_H2L2_IgG1_PVA_/S267K Light Chain

SEQ ID NO: 22777 - protein, 111 aa, Artificial Sequence; identical to SEQ ID NO: 22287
  Description of Artificial Sequence: Synthetic polypeptide
  VL of XENP019406

SEQ ID NO: 22778 - protein, 15 aa, Artificial Sequence
  Description of Artificial Sequence: Synthetic peptide
  XENP019406 vlCDR1
RASQSVDYDGDSYMN

SEQ ID NO: 22779 - protein, 7 aa, Artificial Sequence
  Description of Artificial Sequence: Synthetic peptide
  XENP019406 vlCDR2
AASNLES

SEQ ID NO: 22780 - protein, 9 aa, Artificial Sequence
  Description of Artificial Sequence: Synthetic peptide
  XENP019406 vlCDR3
QQSNEDPFT

SEQ ID NO: 22781 - protein, 450 aa, Artificial Sequence; identical to SEQ ID NO: 22301
  Description of Artificial Sequence: Synthetic polypeptide
  XENP019407 7G8_H2L3_IgG1_PVA_/S267K Heavy Chain

SEQ ID NO: 22782 - protein, 121 aa, Artificial Sequence; identical to SEQ ID NO: 22302
  Description of Artificial Sequence: Synthetic polypeptide
  VH of XENP019407

SEQ ID NO: 22783 - protein, 5 aa, Artificial Sequence
  Description of Artificial Sequence: Synthetic peptide
  XENP019407 vhCDR1
DAWMD

SEQ ID NO: 22784 - protein, 19 aa, Artificial Sequence
  Description of Artificial Sequence: Synthetic peptide
  XENP019407 vhCDR2
EIRTKANNHATYYAESVKG

SEQ ID NO: 22785 - protein, 10 aa, Artificial Sequence
  Description of Artificial Sequence: Synthetic peptide
  XENP019407 vhCDR3
LANWDWYFDV

SEQ ID NO: 22786 - protein, 218 aa, Artificial Sequence; identical to SEQ ID NO: 22296
  Description of Artificial Sequence: Synthetic polypeptide
  XENP019407 7G8_H2L3_IgG1_PVA_/S267K Light Chain

SEQ ID NO: 22787 - protein, 111 aa, Artificial Sequence; identical to SEQ ID NO: 22297
  Description of Artificial Sequence: Synthetic polypeptide
  VL of XENP019407

SEQ ID NO: 22788 - protein, 15 aa, Artificial Sequence
  Description of Artificial Sequence: Synthetic peptide
  XENP019407 vlCDR1
KASQSVDYDGDSYMN

SEQ ID NO: 22789 - protein, 7 aa, Artificial Sequence
  Description of Artificial Sequence: Synthetic peptide
  XENP019407 vlCDR2
AASNLES

SEQ ID NO: 22790 - protein, 9 aa, Artificial Sequence
  Description of Artificial Sequence: Synthetic peptide
  XENP019407 vlCDR3
QQSNEDPFT

SEQ ID NO: 22791 - protein, 450 aa, Artificial Sequence; identical to SEQ ID NO: 22271
  Description of Artificial Sequence: Synthetic polypeptide
  XENP020028 7G8_H1L0_IgG1_PVA_/S267K Heavy Chain

SEQ ID NO: 22792 - protein, 121 aa, Artificial Sequence; identical to SEQ ID NO: 22272
  Description of Artificial Sequence: Synthetic polypeptide
  VH of XENP020028

SEQ ID NO: 22793 - protein, 5 aa, Artificial Sequence
  Description of Artificial Sequence: Synthetic peptide
  XENP020028 vhCDR1
DAWMD

SEQ ID NO: 22794 - protein, 19 aa, Artificial Sequence
  Description of Artificial Sequence: Synthetic peptide
  XENP020028 vhCDR2
EIRTKANNHATYYAEKFQG

SEQ ID NO: 22795 - protein, 10 aa, Artificial Sequence
  Description of Artificial Sequence: Synthetic peptide
  XENP020028 vhCDR3
LANWDWYFDV

SEQ ID NO: 22796 - protein, 218 aa, Artificial Sequence; identical to SEQ ID NO: 22266
  Description of Artificial Sequence: Synthetic polypeptide
  XENP020028 7G8_H1L0_IgG1_PVA_/S267K Light Chain

SEQ ID NO: 22797 - protein, 111 aa, Artificial Sequence; identical to SEQ ID NO: 22267
  Description of Artificial Sequence: Synthetic polypeptide
  VL of XENP020028

SEQ ID NO: 22798 - protein, 15 aa, Artificial Sequence
  Description of Artificial Sequence: Synthetic peptide
  XENP020028 vlCDR1
KASQSVDYDGDSYMN

SEQ ID NO: 22799 - protein, 7 aa, Artificial Sequence
  Description of Artificial Sequence: Synthetic peptide
  XENP020028 vlCDR2
AASNLES

SEQ ID NO: 22800 - protein, 9 aa, Artificial Sequence
  Description of Artificial Sequence: Synthetic peptide
  XENP020028 vlCDR3
QQSNEDPFT

SEQ ID NO: 22801 - protein, 450 aa, Artificial Sequence; identical to SEQ ID NO: 22261
  Description of Artificial Sequence: Synthetic polypeptide
  XENP020029 7G8_H0L1_IgG1_PVA_/S267K Heavy Chain

SEQ ID NO: 22802 - protein, 121 aa, Artificial Sequence; identical to SEQ ID NO: 22262
  Description of Artificial Sequence: Synthetic polypeptide
  VH of XENP020029

SEQ ID NO: 22803 - protein, 5 aa, Artificial Sequence
  Description of Artificial Sequence: Synthetic peptide
  XENP020029 vhCDR1
DAWMD

SEQ ID NO: 22804 - protein, 19 aa, Artificial Sequence
  Description of Artificial Sequence: Synthetic peptide
  XENP020029 vhCDR2
EIRTKANNHATYYAESVKG

SEQ ID NO: 22805 - protein, 10 aa, Artificial Sequence
  Description of Artificial Sequence: Synthetic peptide
  XENP020029 vhCDR3
LANWDWYFDV

SEQ ID NO: 22806 - protein, 218 aa, Artificial Sequence; identical to SEQ ID NO: 22276
  Description of Artificial Sequence: Synthetic polypeptide
  XENP020029 7G8_H0L1_IgG1_PVA_/S267K Light Chain

SEQ ID NO: 22807 - protein, 111 aa, Artificial Sequence; identical to SEQ ID NO: 22277
  Description of Artificial Sequence: Synthetic polypeptide
  VL of XENP020029

SEQ ID NO: 22808 - protein, 15 aa, Artificial Sequence
  Description of Artificial Sequence: Synthetic peptide
  XENP020029 vlCDR1
RASQSVDYDGDSYMN

SEQ ID NO: 22809 - protein, 7 aa, Artificial Sequence
  Description of Artificial Sequence: Synthetic peptide
  XENP020029 vlCDR2
AASNLES

SEQ ID NO: 22810 - protein, 9 aa, Artificial Sequence
  Description of Artificial Sequence: Synthetic peptide
  XENP020029 vlCDR3
QQSNEDPFT

SEQ ID NO: 22811 - protein, 450 aa, Artificial Sequence; identical to SEQ ID NO: 22301
  Description of Artificial Sequence: Synthetic polypeptide
  XENP020262 7G8_H2L0_IgG1_PVA_/S267K Heavy Chain

SEQ ID NO: 22812 - protein, 121 aa, Artificial Sequence; identical to SEQ ID NO: 22302
  Description of Artificial Sequence: Synthetic polypeptide
  VH of XENP020262

SEQ ID NO: 22813 - protein, 5 aa, Artificial Sequence
  Description of Artificial Sequence: Synthetic peptide
  XENP020262 vhCDR1
DAWMD

SEQ ID NO: 22814 - protein, 19 aa, Artificial Sequence
  Description of Artificial Sequence: Synthetic peptide
  XENP020262 vhCDR2
EIRTKANNHATYYAESVKG

SEQ ID NO: 22815 - protein, 10 aa, Artificial Sequence
  Description of Artificial Sequence: Synthetic peptide
  XENP020262 vhCDR3
LANWDWYFDV

SEQ ID NO: 22816 - protein, 218 aa, Artificial Sequence; identical to SEQ ID NO: 22266
  Description of Artificial Sequence: Synthetic polypeptide
  XENP020262 7G8_H2L0_IgG1_PVA_/S267K Light Chain

SEQ ID NO: 22817 - protein, 111 aa, Artificial Sequence; identical to SEQ ID NO: 22267
  Description of Artificial Sequence: Synthetic polypeptide
  VL of XENP020262

SEQ ID NO: 22818 - protein, 15 aa, Artificial Sequence
  Description of Artificial Sequence: Synthetic peptide
  XENP020262 vlCDR1
KASQSVDYDGDSYMN

SEQ ID NO: 22819 - protein, 7 aa, Artificial Sequence
  Description of Artificial Sequence: Synthetic peptide
  XENP020262 vlCDR2
AASNLES

SEQ ID NO: 22820 - protein, 9 aa, Artificial Sequence
  Description of Artificial Sequence: Synthetic peptide
  XENP020262 vlCDR3
QQSNEDPFT

SEQ ID NO: 22821 - protein, 450 aa, Artificial Sequence; identical to SEQ ID NO: 22261
  Description of Artificial Sequence: Synthetic polypeptide
  XENP020263 7G8_H0L2_IgG1_PVA_/S267K Heavy Chain

SEQ ID NO: 22822 - protein, 121 aa, Artificial Sequence; identical to SEQ ID NO: 22262
  Description of Artificial Sequence: Synthetic polypeptide
  VH of XENP020263

SEQ ID NO: 22823 - protein, 5 aa, Artificial Sequence
  Description of Artificial Sequence: Synthetic peptide
  XENP020263 vhCDR1
DAWMD

SEQ ID NO: 22824 - protein, 19 aa, Artificial Sequence
  Description of Artificial Sequence: Synthetic peptide
  XENP020263 vhCDR2
EIRTKANNHATYYAESVKG

SEQ ID NO: 22825 - protein, 10 aa, Artificial Sequence
  Description of Artificial Sequence: Synthetic peptide
  XENP020263 vhCDR3
LANWDWYFDV

SEQ ID NO: 22826 - protein, 218 aa, Artificial Sequence; identical to SEQ ID NO: 22286
  Description of Artificial Sequence: Synthetic polypeptide
  XENP020263 7G8_H0L2_IgG1_PVA_/S267K Light Chain

SEQ ID NO: 22827 - protein, 111 aa, Artificial Sequence; identical to SEQ ID NO: 22287
  Description of Artificial Sequence: Synthetic polypeptide
  VL of XENP020263

SEQ ID NO: 22828 - protein, 15 aa, Artificial Sequence
  Description of Artificial Sequence: Synthetic peptide
  XENP020263 vlCDR1
RASQSVDYDGDSYMN

SEQ ID NO: 22829 - protein, 7 aa, Artificial Sequence
  Description of Artificial Sequence: Synthetic peptide
  XENP020263 vlCDR2
AASNLES

SEQ ID NO: 22830 - protein, 9 aa, Artificial Sequence
  Description of Artificial Sequence: Synthetic peptide
  XENP020263 vlCDR3
QQSNEDPFT

SEQ ID NO: 22831 - protein, 450 aa, Artificial Sequence; identical to SEQ ID NO: 22481
  Description of Artificial Sequence: Synthetic polypeptide
  XENP020417 7G8_H3L1_IgG1_PVA_/S267K Heavy Chain

SEQ ID NO: 22832 - protein, 121 aa, Artificial Sequence; identical to SEQ ID NO: 22482
  Description of Artificial Sequence: Synthetic polypeptide
  VH of XENP020417

SEQ ID NO: 22833 - protein, 5 aa, Artificial Sequence
  Description of Artificial Sequence: Synthetic peptide
  XENP020417 vhCDR1
DAWMD

SEQ ID NO: 22834 - protein, 19 aa, Artificial Sequence
  Description of Artificial Sequence: Synthetic peptide
  XENP020417 vhCDR2
EIRTKANNHATYYAESVKG

SEQ ID NO: 22835 - protein, 10 aa, Artificial Sequence
  Description of Artificial Sequence: Synthetic peptide
  XENP020417 vhCDR3
LANWDWYFDV

SEQ ID NO: 22836 - protein, 218 aa, Artificial Sequence; identical to SEQ ID NO: 22276
  Description of Artificial Sequence: Synthetic polypeptide
  XENP020417 7G8_H3L1_IgG1_PVA_/S267K Light Chain

SEQ ID NO: 22837 - protein, 111 aa, Artificial Sequence; identical to SEQ ID NO: 22277
  Description of Artificial Sequence: Synthetic polypeptide
  VL of XENP020417

SEQ ID NO: 22838 - protein, 15 aa, Artificial Sequence
  Description of Artificial Sequence: Synthetic peptide
  XENP020417 vlCDR1
RASQSVDYDGDSYMN

SEQ ID NO: 22839 - protein, 7 aa, Artificial Sequence
  Description of Artificial Sequence: Synthetic peptide
  XENP020417 vlCDR2
AASNLES

SEQ ID NO: 22840 - protein, 9 aa, Artificial Sequence
  Description of Artificial Sequence: Synthetic peptide
  XENP020417 vlCDR3
QQSNEDPFT

SEQ ID NO: 22841 - protein, 450 aa, Artificial Sequence; identical to SEQ ID NO: 22481
  Description of Artificial Sequence: Synthetic polypeptide
  XENP020418 7G8_H3L2_IgG1_PVA_/S267K Heavy Chain

SEQ ID NO: 22842 - protein, 121 aa, Artificial Sequence; identical to SEQ ID NO: 22482
  Description of Artificial Sequence: Synthetic polypeptide
  VH of XENP020418

SEQ ID NO: 22843 - protein, 5 aa, Artificial Sequence
  Description of Artificial Sequence: Synthetic peptide
  XENP020418 vhCDR1
DAWMD

SEQ ID NO: 22844 - protein, 19 aa, Artificial Sequence
  Description of Artificial Sequence: Synthetic peptide
  XENP020418 vhCDR2
EIRTKANNHATYYAESVKG

SEQ ID NO: 22845 - protein, 10 aa, Artificial Sequence
  Description of Artificial Sequence: Synthetic peptide
  XENP020418 vhCDR3
LANWDWYFDV

SEQ ID NO: 22846 - protein, 218 aa, Artificial Sequence; identical to SEQ ID NO: 22286
  Description of Artificial Sequence: Synthetic polypeptide
  XENP020418 7G8_H3L2_IgG1_PVA_/S267K Light Chain

SEQ ID NO: 22847 - protein, 111 aa, Artificial Sequence; identical to SEQ ID NO: 22287
  Description of Artificial Sequence: Synthetic polypeptide
  VL of XENP020418

SEQ ID NO: 22848 - protein, 15 aa, Artificial Sequence
  Description of Artificial Sequence: Synthetic peptide
  XENP020418 vlCDR1
RASQSVDYDGDSYMN

SEQ ID NO: 22849 - protein, 7 aa, Artificial Sequence
  Description of Artificial Sequence: Synthetic peptide
  XENP020418 vlCDR2
AASNLES

SEQ ID NO: 22850 - protein, 9 aa, Artificial Sequence
  Description of Artificial Sequence: Synthetic peptide
  XENP020418 vlCDR3
QQSNEDPFT

SEQ ID NO: 22851 - protein, 450 aa, Artificial Sequence; identical to SEQ ID NO: 22481
  Description of Artificial Sequence: Synthetic polypeptide
  XENP020419 7G8_H3L3_IgG1_PVA_/S267K Heavy Chain

SEQ ID NO: 22852 - protein, 121 aa, Artificial Sequence; identical to SEQ ID NO: 22482
  Description of Artificial Sequence: Synthetic polypeptide
  VH of XENP020419

SEQ ID NO: 22853 - protein, 5 aa, Artificial Sequence
  Description of Artificial Sequence: Synthetic peptide
  XENP020419 vhCDR1
DAWMD

SEQ ID NO: 22854 - protein, 19 aa, Artificial Sequence
  Description of Artificial Sequence: Synthetic peptide
  XENP020419 vhCDR2
EIRTKANNHATYYAESVKG

SEQ ID NO: 22855 - protein, 10 aa, Artificial Sequence
  Description of Artificial Sequence: Synthetic peptide
  XENP020419 vhCDR3
LANWDWYFDV

SEQ ID NO: 22856 - protein, 218 aa, Artificial Sequence; identical to SEQ ID NO: 22296
  Description of Artificial Sequence: Synthetic polypeptide
  XENP020419 7G8_H3L3_IgG1_PVA_/S267K Light Chain

SEQ ID NO: 22857 - protein, 111 aa, Artificial Sequence; identical to SEQ ID NO: 22297
  Description of Artificial Sequence: Synthetic polypeptide
  VL of XENP020419

SEQ ID NO: 22858 - protein, 15 aa, Artificial Sequence
  Description of Artificial Sequence: Synthetic peptide
  XENP020419 vlCDR1
KASQSVDYDGDSYMN

SEQ ID NO: 22859 - protein, 7 aa, Artificial Sequence
  Description of Artificial Sequence: Synthetic peptide
  XENP020419 vlCDR2
AASNLES

SEQ ID NO: 22860 - protein, 9 aa, Artificial Sequence
  Description of Artificial Sequence: Synthetic peptide
  XENP020419 vlCDR3
QQSNEDPFT

SEQ ID NO: 22861 - protein, 450 aa, Artificial Sequence; identical to SEQ ID NO: 22481
  Description of Artificial Sequence: Synthetic polypeptide
  XENP020417 7G8_H3L1_IgG1_PVA_/S267K Heavy Chain

SEQ ID NO: 22862 - protein, 121 aa, Artificial Sequence; identical to SEQ ID NO: 22482
  Description of Artificial Sequence: Synthetic polypeptide
  VH of XENP020417

SEQ ID NO: 22863 - protein, 5 aa, Artificial Sequence
  Description of Artificial Sequence: Synthetic peptide
  XENP020417 vhCDR1
DAWMD

SEQ ID NO: 22864 - protein, 19 aa, Artificial Sequence
  Description of Artificial Sequence: Synthetic peptide
  XENP020417 vhCDR2
EIRTKANNHATYYAESVKG

SEQ ID NO: 22865 - protein, 10 aa, Artificial Sequence
  Description of Artificial Sequence: Synthetic peptide
  XENP020417 vhCDR3
LANWDWYFDV

SEQ ID NO: 22866 - protein, 218 aa, Artificial Sequence; identical to SEQ ID NO: 22276
  Description of Artificial Sequence: Synthetic polypeptide
  XENP020417 7G8_H3L1_IgG1_PVA_/S267K Light Chain

SEQ ID NO: 22867 - protein, 111 aa, Artificial Sequence; identical to SEQ ID NO: 22277
  Description of Artificial Sequence: Synthetic polypeptide
  VL of XENP020417

SEQ ID NO: 22868 - protein, 15 aa, Artificial Sequence
  Description of Artificial Sequence: Synthetic peptide
  XENP020417 vlCDR1
RASQSVDYDGDSYMN

SEQ ID NO: 22869 - protein, 7 aa, Artificial Sequence
  Description of Artificial Sequence: Synthetic peptide
  XENP020417 vlCDR2
AASNLES

SEQ ID NO: 22870 - protein, 9 aa, Artificial Sequence
  Description of Artificial Sequence: Synthetic peptide
  XENP020417 vlCDR3
QQSNEDPFT

SEQ ID NO: 22871 - protein, 450 aa, Artificial Sequence; identical to SEQ ID NO: 22481
  Description of Artificial Sequence: Synthetic polypeptide
  XENP020418 7G8_H3L2_IgG1_PVA_/S267K Heavy Chain

SEQ ID NO: 22872 - protein, 121 aa, Artificial Sequence; identical to SEQ ID NO: 22482
  Description of Artificial Sequence: Synthetic polypeptide
  VH of XENP020418

SEQ ID NO: 22873 - protein, 5 aa, Artificial Sequence
  Description of Artificial Sequence: Synthetic peptide
  XENP020418 vhCDR1
DAWMD

SEQ ID NO: 22874 - protein, 19 aa, Artificial Sequence
  Description of Artificial Sequence: Synthetic peptide
  XENP020418 vhCDR2
EIRTKANNHATYYAESVKG

SEQ ID NO: 22875 - protein, 10 aa, Artificial Sequence
  Description of Artificial Sequence: Synthetic peptide
  XENP020418 vhCDR3
LANWDWYFDV

SEQ ID NO: 22876 - protein, 218 aa, Artificial Sequence; identical to SEQ ID NO: 22286
  Description of Artificial Sequence: Synthetic polypeptide
  XENP020418 7G8_H3L2_IgG1_PVA_/S267K Light Chain

SEQ ID NO: 22877 - protein, 111 aa, Artificial Sequence; identical to SEQ ID NO: 22287
  Description of Artificial Sequence: Synthetic polypeptide
  VL of XENP020418

SEQ ID NO: 22878 - protein, 15 aa, Artificial Sequence
  Description of Artificial Sequence: Synthetic peptide
  XENP020418 vlCDR1
RASQSVDYDGDSYMN

SEQ ID NO: 22879 - protein, 7 aa, Artificial Sequence
  Description of Artificial Sequence: Synthetic peptide
  XENP020418 vlCDR2
AASNLES

SEQ ID NO: 22880 - protein, 9 aa, Artificial Sequence
  Description of Artificial Sequence: Synthetic peptide
  XENP020418 vlCDR3
QQSNEDPFT

SEQ ID NO: 22881 - protein, 450 aa, Artificial Sequence; identical to SEQ ID NO: 22481
  Description of Artificial Sequence: Synthetic polypeptide
  XENP020419 7G8_H3L3_IgG1_PVA_/S267K Heavy Chain

SEQ ID NO: 22882 - protein, 121 aa, Artificial Sequence; identical to SEQ ID NO: 22482
  Description of Artificial Sequence: Synthetic polypeptide
  VH of XENP020419

SEQ ID NO: 22883 - protein, 5 aa, Artificial Sequence
  Description of Artificial Sequence: Synthetic peptide
  XENP020419 vhCDR1
DAWMD

SEQ ID NO: 22884 - protein, 19 aa, Artificial Sequence
  Description of Artificial Sequence: Synthetic peptide
  XENP020419 vhCDR2
EIRTKANNHATYYAESVKG

SEQ ID NO: 22885 - protein, 10 aa, Artificial Sequence
  Description of Artificial Sequence: Synthetic peptide
  XENP020419 vhCDR3
LANWDWYFDV

SEQ ID NO: 22886 - protein, 218 aa, Artificial Sequence; identical to SEQ ID NO: 22296
  Description of Artificial Sequence: Synthetic polypeptide
  XENP020419 7G8_H3L3_IgG1_PVA_/S267K Light Chain

SEQ ID NO: 22887 - protein, 111 aa, Artificial Sequence; identical to SEQ ID NO: 22297
  Description of Artificial Sequence: Synthetic polypeptide
  VL of XENP020419

SEQ ID NO: 22888 - protein, 15 aa, Artificial Sequence
  Description of Artificial Sequence: Synthetic peptide
  XENP020419 vlCDR1
KASQSVDYDGDSYMN

SEQ ID NO: 22889 - protein, 7 aa, Artificial Sequence
  Description of Artificial Sequence: Synthetic peptide
  XENP020419 vlCDR2
AASNLES

SEQ ID NO: 22890 - protein, 9 aa, Artificial Sequence
  Description of Artificial Sequence: Synthetic peptide
  XENP020419 vlCDR3
QQSNEDPFT

SEQ ID NO: 22891 - protein, 450 aa, Artificial Sequence
  Description of Artificial Sequence: Synthetic polypeptide
  XENP020449 7G8_H0.1_L0_IgG1_PVA_/S267K Heavy Chain
EVKLEESGGGLVQPGGSMKLSCAASGYTFSDAWMDWVRQSPEKGLEWVAEIRTKANNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 22892 - protein, 121 aa, Artificial Sequence
  Description of Artificial Sequence: Synthetic polypeptide
  VH of XENP020449
EVKLEESGGGLVQPGGSMKLSCAASGYTFSDAWMDWVRQSPEKGLEWVAEIRTKANNHATYYAESVKGRFTISRDDSKSSVYLQMNSLRAEDTGIYYCTRLANWDWYFDVWGAGTTVTVSS

SEQ ID NO: 22893 - protein, 5 aa, Artificial Sequence
  Description of Artificial Sequence: Synthetic peptide
  XENP020449 vhCDR1
DAWMD

SEQ ID NO: 22894 - protein, 19 aa, Artificial Sequence
  Description of Artificial Sequence: Synthetic peptide
  XENP020449 vhCDR2
EIRTKANNHATYYAESVKG

SEQ ID NO: 22895 - protein, 10 aa, Artificial Sequence
  Description of Artificial Sequence: Synthetic peptide
  XENP020449 vhCDR3
LANWDWYFDV

SEQ ID NO: 22896 - protein, 218 aa, Artificial Sequence; identical to SEQ ID NO: 22266
  Description of Artificial Sequence: Synthetic polypeptide
  XENP020449 7G8_H0.1_L0_IgG1_PVA_/S267K Light Chain

SEQ ID NO: 22897 - protein, 111 aa, Artificial Sequence; identical to SEQ ID NO: 22267
  Description of Artificial Sequence: Synthetic polypeptide
  VL of XENP020449

SEQ ID NO: 22898 - protein, 15 aa, Artificial Sequence
  Description of Artificial Sequence: Synthetic peptide
  XENP020449 vlCDR1
KASQSVDYDGDSYMN

SEQ ID NO: 22899 - protein, 7 aa, Artificial Sequence
  Description of Artificial Sequence: Synthetic peptide
  XENP020449 vlCDR2
AASNLES

SEQ ID NO: 22900 - protein, 9 aa, Artificial Sequence
  Description of Artificial Sequence: Synthetic peptide
  XENP020449 vlCDR3
QQSNEDPFT

SEQ ID NO: 22901 - protein, 450 aa, Artificial Sequence
  Description of Artificial Sequence: Synthetic polypeptide
  XENP020450 7G8_H0.2_L0_IgG1_PVA_/S267K Heavy Chain
EVKLEESGGGLVQPGGSMKLSCAASGGTFSDAWMDWVRQSPEKGLEWVAEIRTKANNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 22902 - protein, 121 aa, Artificial Sequence
  Description of Artificial Sequence: Synthetic polypeptide
  VH of XENP020450
EVKLEESGGGLVQPGGSMKLSCAASGGTFSDAWMDWVRQSPEKGLEWVAEIRTKANNHATYYAESVKGRFTISRDDSKSSVYLQMNSLRAEDTGIYYCTRLANWDWYFDVWGAGTTVTVSS

SEQ ID NO: 22903 - protein, 5 aa, Artificial Sequence
  Description of Artificial Sequence: Synthetic peptide
  XENP020450 vhCDR1
DAWMD

SEQ ID NO: 22904 - protein, 19 aa, Artificial Sequence
  Description of Artificial Sequence: Synthetic peptide
  XENP020450 vhCDR2
EIRTKANNHATYYAESVKG

SEQ ID NO: 22905 - protein, 10 aa, Artificial Sequence
  Description of Artificial Sequence: Synthetic peptide
  XENP020450 vhCDR3
LANWDWYFDV

SEQ ID NO: 22906 - protein, 218 aa, Artificial Sequence; identical to SEQ ID NO: 22266
  Description of Artificial Sequence: Synthetic polypeptide
  XENP020450 7G8_H0.2_L0_IgG1_PVA_/S267K Light Chain

SEQ ID NO: 22907 - protein, 111 aa, Artificial Sequence; identical to SEQ ID NO: 22267
  Description of Artificial Sequence: Synthetic polypeptide
  VL of XENP020450

SEQ ID NO: 22908 - protein, 15 aa, Artificial Sequence
  Description of Artificial Sequence: Synthetic peptide
  XENP020450 vlCDR1
KASQSVDYDGDSYMN

SEQ ID NO: 22909 - protein, 7 aa, Artificial Sequence
  Description of Artificial Sequence: Synthetic peptide
  XENP020450 vlCDR2
AASNLES

SEQ ID NO: 22910 - protein, 9 aa, Artificial Sequence
  Description of Artificial Sequence: Synthetic peptide
  XENP020450 vlCDR3
QQSNEDPFT

SEQ ID NO: 22911 - protein, 450 aa, Artificial Sequence
  Description of Artificial Sequence: Synthetic polypeptide
  XENP020451 7G8_H0.3_L0_IgG1_PVA_/S267K Heavy Chain
EVKLEESGGGLVQPGGSMKLSCAASGDTFSDAWMDWVRQSPEKGLEWVAEIRTKANNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 22912 - protein, 121 aa, Artificial Sequence
  Description of Artificial Sequence: Synthetic polypeptide
  VH of XENP020451
EVKLEESGGGLVQPGGSMKLSCAASGDTFSDAWMDWVRQSPEKGLEWVAEIRTKANNHATYYAESVKGRFTISRDDSKSSVYLQMNSLRAEDTGIYYCTRLANWDWYFDVWGAGTTVTVSS

SEQ ID NO: 22913 - protein, 5 aa, Artificial Sequence
  Description of Artificial Sequence: Synthetic peptide
  XENP020451 vhCDR1
DAWMD

SEQ ID NO: 22914 - protein, 19 aa, Artificial Sequence
  Description of Artificial Sequence: Synthetic peptide
  XENP020451 vhCDR2
EIRTKANNHATYYAESVKG

SEQ ID NO: 22915 - protein, 10 aa, Artificial Sequence
  Description of Artificial Sequence: Synthetic peptide
  XENP020451 vhCDR3
LANWDWYFDV

SEQ ID NO: 22916 - protein, 218 aa, Artificial Sequence; identical to SEQ ID NO: 22266
  Description of Artificial Sequence: Synthetic polypeptide
  XENP020451 7G8_H0.3_L0_IgG1_PVA_/S267K Light Chain

SEQ ID NO: 22917 - protein, 111 aa, Artificial Sequence; identical to SEQ ID NO: 22267
  Description of Artificial Sequence: Synthetic polypeptide
  VL of XENP020451

SEQ ID NO: 22918 - protein, 15 aa, Artificial Sequence
  Description of Artificial Sequence: Synthetic peptide
  XENP020451 vlCDR1
KASQSVDYDGDSYMN

SEQ ID NO: 22919 - protein, 7 aa, Artificial Sequence
  Description of Artificial Sequence: Synthetic peptide
  XENP020451 vlCDR2
AASNLES

SEQ ID NO: 22920 - protein, 9 aa, Artificial Sequence
  Description of Artificial Sequence: Synthetic peptide
  XENP020451 vlCDR3
QQSNEDPFT

SEQ ID NO: 22921 - protein, 450 aa, Artificial Sequence
  Description of Artificial Sequence: Synthetic polypeptide
  XENP020452 7G8_H0.4_L0_IgG1_PVA_/S267K Heavy Chain
EVKLEESGGGLVQPGGSMKLSCAASGFSFSDAWMDWVRQSPEKGLEWVAEIRTKANNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 22922 - protein, 121 aa, Artificial Sequence
  Description of Artificial Sequence: Synthetic polypeptide
  VH of XENP020452
EVKLEESGGGLVQPGGSMKLSCAASGFSFSDAWMDWVRQSPEKGLEWVAEIRTKANNHATYYAESVKGRFTISRDDSKSSVYLQMNSLRAEDTGIYYCTRLANWDWYFDVWGAGTTVTVSS

SEQ ID NO: 22923 - protein, 5 aa, Artificial Sequence
  Description of Artificial Sequence: Synthetic peptide
  XENP020452 vhCDR1
DAWMD

SEQ ID NO: 22924 - protein, 19 aa, Artificial Sequence
  Description of Artificial Sequence: Synthetic peptide
  XENP020452 vhCDR2
EIRTKANNHATYYAESVKG

SEQ ID NO: 22925 - protein, 10 aa, Artificial Sequence
  Description of Artificial Sequence: Synthetic peptide
  XENP020452 vhCDR3
LANWDWYFDV

SEQ ID NO: 22926 - protein, 218 aa, Artificial Sequence; identical to SEQ ID NO: 22266
  Description of Artificial Sequence: Synthetic polypeptide
  XENP020452 7G8_H0.4_L0_IgG1_PVA_/S267K Light Chain

SEQ ID NO: 22927 - protein, 111 aa, Artificial Sequence; identical to SEQ ID NO: 22267
  Description of Artificial Sequence: Synthetic polypeptide
  VL of XENP020452

SEQ ID NO: 22928 - protein, 15 aa, Artificial Sequence
  Description of Artificial Sequence: Synthetic peptide
  XENP020452 vlCDR1
KASQSVDYDGDSYMN

SEQ ID NO: 22929 - protein, 7 aa, Artificial Sequence
  Description of Artificial Sequence: Synthetic peptide
  XENP020452 vlCDR2
AASNLES

SEQ ID NO: 22930 - protein, 9 aa, Artificial Sequence
  Description of Artificial Sequence: Synthetic peptide
  XENP020452 vlCDR3
QQSNEDPFT

SEQ ID NO: 22931 - protein, 450 aa, Artificial Sequence
  Description of Artificial Sequence: Synthetic polypeptide
  XENP020453 7G8_H0.5_L0_IgG1_PVA_/S267K Heavy Chain
EVKLEESGGGLVQPGGSMKLSCAASGFTFTDAWMDWVRQSPEKGLEWVAEIRTKANNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 22932 - protein, 121 aa, Artificial Sequence
  Description of Artificial Sequence: Synthetic polypeptide
  VH of XENP020453
EVKLEESGGGLVQPGGSMKLSCAASGFTFTDAWMDWVRQSPEKGLEWVAEIRTKANNHATYYAESVKGRFTISRDDSKSSVYLQMNSLRAEDTGIYYCTRLANWDWYFDVWGAGTTVTVSS

SEQ ID NO: 22933 - protein, 5 aa, Artificial Sequence
  Description of Artificial Sequence: Synthetic peptide
  XENP020453 vhCDR1
DAWMD

SEQ ID NO: 22934 - protein, 19 aa, Artificial Sequence
  Description of Artificial Sequence: Synthetic peptide
  XENP020453 vhCDR2
EIRTKANNHATYYAESVKG

SEQ ID NO: 22935 - protein, 10 aa, Artificial Sequence
  Description of Artificial Sequence: Synthetic peptide
  XENP020453 vhCDR3
LANWDWYFDV

SEQ ID NO: 22936 - protein, 218 aa, Artificial Sequence; identical to SEQ ID NO: 22266
  Description of Artificial Sequence: Synthetic polypeptide
  XENP020453 7G8_H0.5_L0_IgG1_PVA_/S267K Light Chain

SEQ ID NO: 22937 - protein, 111 aa, Artificial Sequence; identical to SEQ ID NO: 22267
  Description of Artificial Sequence: Synthetic polypeptide
  VL of XENP020453

SEQ ID NO: 22938 - protein, 15 aa, Artificial Sequence
  Description of Artificial Sequence: Synthetic peptide
  XENP020453 vlCDR1
KASQSVDYDGDSYMN

SEQ ID NO: 22939 - protein, 7 aa, Artificial Sequence
  Description of Artificial Sequence: Synthetic peptide
  XENP020453 vlCDR2
AASNLES

SEQ ID NO: 22940 - protein, 9 aa, Artificial Sequence
  Description of Artificial Sequence: Synthetic peptide
  XENP020453 vlCDR3
QQSNEDPFT

SEQ ID NO: 22941 - protein, 450 aa, Artificial Sequence
  Description of Artificial Sequence: Synthetic polypeptide
  XENP020454 7G8_H0.6_L0_IgG1_PVA_/S267K Heavy Chain
EVKLEESGGGLVQPGGSMKLSCAASGFTFDDAWMDWVRQSPEKGLEWVAEIRTKANNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 22942 - protein, 121 aa, Artificial Sequence
  Description of Artificial Sequence: Synthetic polypeptide
  VH of XENP020454
EVKLEESGGGLVQPGGSMKLSCAASGFTFDDAWMDWVRQSPEKGLEWVAEIRTKANNHATYYAESVKGRFTISRDDSKSSVYLQMNSLRAEDTGIYYCTRLANWDWYFDVWGAGTTVTVSS

SEQ ID NO: 22943 - protein, 5 aa, Artificial Sequence
  Description of Artificial Sequence: Synthetic peptide
  XENP020454 vhCDR1
DAWMD

SEQ ID NO: 22944 - protein, 19 aa, Artificial Sequence
  Description of Artificial Sequence: Synthetic peptide
  XENP020454 vhCDR2
EIRTKANNHATYYAESVKG

SEQ ID NO: 22945 - protein, 10 aa, Artificial Sequence
  Description of Artificial Sequence: Synthetic peptide
  XENP020454 vhCDR3
LANWDWYFDV

SEQ ID NO: 22946 - protein, 218 aa, Artificial Sequence; identical to SEQ ID NO: 22266
  Description of Artificial Sequence: Synthetic polypeptide
  XENP020454 7G8_H0.6_L0_IgG1_PVA_/S267K Light Chain

SEQ ID NO: 22947 - protein, 111 aa, Artificial Sequence; identical to SEQ ID NO: 22267
  Description of Artificial Sequence: Synthetic polypeptide
  VL of XENP020454

SEQ ID NO: 22948 - protein, 15 aa, Artificial Sequence
  Description of Artificial Sequence: Synthetic peptide
  XENP020454 vlCDR1
KASQSVDYDGDSYMN

SEQ ID NO: 22949 - protein, 7 aa, Artificial Sequence
  Description of Artificial Sequence: Synthetic peptide
  XENP020454 vlCDR2
AASNLES

SEQ ID NO: 22950 - protein, 9 aa, Artificial Sequence
  Description of Artificial Sequence: Synthetic peptide
  XENP020454 vlCDR3
QQSNEDPFT

SEQ ID NO: 22951 - protein, 450 aa, Artificial Sequence
  Description of Artificial Sequence: Synthetic polypeptide
  XENP020455 7G8_H0.7_L0_IgG1_PVA_/S267K Heavy Chain
EVKLEESGGGLVQPGGSMKLSCAASGFTFGDAWMDWVRQSPEKGLEWVAEIRTKANNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 22952 - protein, 121 aa, Artificial Sequence
  Description of Artificial Sequence: Synthetic polypeptide
  VH of XENP020455
EVKLEESGGGLVQPGGSMKLSCAASGFTFGDAWMDWVRQSPEKGLEWVAEIRTKANNHATYYAESVKGRFTISRDDSKSSVYLQMNSLRAEDTGIYYCTRLANWDWYFDVWGAGTTVTVSS

SEQ ID NO: 22953 - protein, 5 aa, Artificial Sequence
  Description of Artificial Sequence: Synthetic peptide
  XENP020455 vhCDR1
DAWMD

SEQ ID NO: 22954 - protein, 19 aa, Artificial Sequence
  Description of Artificial Sequence: Synthetic peptide
  XENP020455 vhCDR2
EIRTKANNHATYYAESVKG

SEQ ID NO: 22955 - protein, 10 aa, Artificial Sequence
  Description of Artificial Sequence: Synthetic peptide
  XENP020455 vhCDR3
LANWDWYFDV

SEQ ID NO: 22956 - protein, 218 aa, Artificial Sequence; identical to SEQ ID NO: 22266
  Description of Artificial Sequence: Synthetic polypeptide
  XENP020455 7G8_H0.7_L0_IgG1_PVA_/S267K Light Chain

SEQ ID NO: 22957 - protein, 111 aa, Artificial Sequence; identical to SEQ ID NO: 22267
  Description of Artificial Sequence: Synthetic polypeptide
  VL of XENP020455

SEQ ID NO: 22958 - protein, 15 aa, Artificial Sequence
  Description of Artificial Sequence: Synthetic peptide
  XENP020455 vlCDR1
KASQSVDYDGDSYMN

SEQ ID NO: 22959 - protein, 7 aa, Artificial Sequence
  Description of Artificial Sequence: Synthetic peptide
  XENP020455 vlCDR2
AASNLES

SEQ ID NO: 22960 - protein, 9 aa, Artificial Sequence
  Description of Artificial Sequence: Synthetic peptide
  XENP020455 vlCDR3
QQSNEDPFT

SEQ ID NO: 22961 - protein, 450 aa, Artificial Sequence
  Description of Artificial Sequence: Synthetic polypeptide
  XENP020456 7G8_H0.8_L0_IgG1_PVA_/S267K Heavy Chain
EVKLEESGGGLVQPGGSMKLSCAASGFTFSNAWMDWVRQSPEKGLEWVAEIRTKANNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 22962 - protein, 121 aa, Artificial Sequence
  Description of Artificial Sequence: Synthetic polypeptide
  VH of XENP020456
EVKLEESGGGLVQPGGSMKLSCAASGFTFSNAWMDWVRQSPEKGLEWVAEIRTKANNHATYYAESVKGRFTISRDDSKSSVYLQMNSLRAEDTGIYYCTRLANWDWYFDVWGAGTTVTVSS

SEQ ID NO: 22963 - protein, 5 aa, Artificial Sequence
  Description of Artificial Sequence: Synthetic peptide
  XENP020456 vhCDR1
NAWMD

SEQ ID NO: 22964 - protein, 19 aa, Artificial Sequence
  Description of Artificial Sequence: Synthetic peptide
  XENP020456 vhCDR2
EIRTKANNHATYYAESVKG

SEQ ID NO: 22965 - protein, 10 aa, Artificial Sequence
  Description of Artificial Sequence: Synthetic peptide
  XENP020456 vhCDR3
LANWDWYFDV

SEQ ID NO: 22966 - protein, 218 aa, Artificial Sequence; identical to SEQ ID NO: 22266
  Description of Artificial Sequence: Synthetic polypeptide
  XENP020456 7G8_H0.8_L0_IgG1_PVA_/S267K Light Chain

SEQ ID NO: 22967 - protein, 111 aa, Artificial Sequence; identical to SEQ ID NO: 22267
  Description of Artificial Sequence: Synthetic polypeptide
  VL of XENP020456

SEQ ID NO: 22968 - protein, 15 aa, Artificial Sequence
  Description of Artificial Sequence: Synthetic peptide
  XENP020456 vlCDR1
KASQSVDYDGDSYMN

SEQ ID NO: 22969 - protein, 7 aa, Artificial Sequence
  Description of Artificial Sequence: Synthetic peptide
  XENP020456 vlCDR2
AASNLES

SEQ ID NO: 22970 - protein, 9 aa, Artificial Sequence
  Description of Artificial Sequence: Synthetic peptide
  XENP020456 vlCDR3
QQSNEDPFT

SEQ ID NO: 22971 - protein, 450 aa, Artificial Sequence
  Description of Artificial Sequence: Synthetic polypeptide
  XENP020457 7G8_H0.9_L0_IgG1_PVA_/S267K Heavy Chain
EVKLEESGGGLVQPGGSMKLSCAASGFTFSEAWMDWVRQSPEKGLEWVAEIRTKANNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 22972 - protein, 121 aa, Artificial Sequence
  Description of Artificial Sequence: Synthetic polypeptide
  VH of XENP020457
EVKLEESGGGLVQPGGSMKLSCAASGFTFSEAWMDWVRQSPEKGLEWVAEIRTKANNHATYYAESVKGRFTISRDDSKSSVYLQMNSLRAEDTGIYYCTRLANWDWYFDVWGAGTTVTVSS

SEQ ID NO: 22973 - protein, 5 aa, Artificial Sequence
  Description of Artificial Sequence: Synthetic peptide
  XENP020457 vhCDR1
EAWMD

SEQ ID NO: 22974 - protein, 19 aa, Artificial Sequence
  Description of Artificial Sequence: Synthetic peptide
  XENP020457 vhCDR2
EIRTKANNHATYYAESVKG

SEQ ID NO: 22975 - protein, 10 aa, Artificial Sequence
  Description of Artificial Sequence: Synthetic peptide
  XENP020457 vhCDR3
LANWDWYFDV

SEQ ID NO: 22976 - protein, 218 aa, Artificial Sequence; identical to SEQ ID NO: 22266
  Description of Artificial Sequence: Synthetic polypeptide
  XENP020457 7G8_H0.9_L0_IgG1_PVA_/S267K Light Chain

SEQ ID NO: 22977 - protein, 111 aa, Artificial Sequence; identical to SEQ ID NO: 22267
  Description of Artificial Sequence: Synthetic polypeptide
  VL of XENP020457

SEQ ID NO: 22978 - protein, 15 aa, Artificial Sequence
  Description of Artificial Sequence: Synthetic peptide
  XENP020457 vlCDR1
KASQSVDYDGDSYMN

SEQ ID NO: 22979 - protein, 7 aa, Artificial Sequence
  Description of Artificial Sequence: Synthetic peptide
  XENP020457 vlCDR2
AASNLES

SEQ ID NO: 22980 - protein, 9 aa, Artificial Sequence
  Description of Artificial Sequence: Synthetic peptide
  XENP020457 vlCDR3
QQSNEDPFT

SEQ ID NO: 22981 - protein, 450 aa, Artificial Sequence
  Description of Artificial Sequence: Synthetic polypeptide
  XENP020458 7G8_H0.10_L0_IgG1_PVA_/S267K Heavy Chain
EVKLEESGGGLVQPGGSMKLSCAASGFTFSHAWMDWVRQSPEKGLEWVAEIRTKANNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 22982 - protein, 121 aa, Artificial Sequence
  Description of Artificial Sequence: Synthetic polypeptide
  VH of XENP020458
EVKLEESGGGLVQPGGSMKLSCAASGFTFSHAWMDWVRQSPEKGLEWVAEIRTKANNHATYYAESVKGRFTISRDDSKSSVYLQMNSLRAEDTGIYYCTRLANWDWYFDVWGAGTTVTVSS

SEQ ID NO: 22983 - protein, 5 aa, Artificial Sequence
  Description of Artificial Sequence: Synthetic peptide
  XENP020458 vhCDR1
HAWMD

SEQ ID NO: 22984 - protein, 19 aa, Artificial Sequence
  Description of Artificial Sequence: Synthetic peptide
  XENP020458 vhCDR2
EIRTKANNHATYYAESVKG

SEQ ID NO: 22985 - protein, 10 aa, Artificial Sequence
  Description of Artificial Sequence: Synthetic peptide
  XENP020458 vhCDR3
LANWDWYFDV

SEQ ID NO: 22986 - protein, 218 aa, Artificial Sequence; identical to SEQ ID NO: 22266
  Description of Artificial Sequence: Synthetic polypeptide
  XENP020458 7G8_H0.10_L0_IgG1_PVA_/S267K Light Chain

SEQ ID NO: 22987 - protein, 111 aa, Artificial Sequence; identical to SEQ ID NO: 22267
  Description of Artificial Sequence: Synthetic polypeptide
  VL of XENP020458

SEQ ID NO: 22988 - protein, 15 aa, Artificial Sequence
  Description of Artificial Sequence: Synthetic peptide
  XENP020458 vlCDR1
KASQSVDYDGDSYMN

SEQ ID NO: 22989 - protein, 7 aa, Artificial Sequence
  Description of Artificial Sequence: Synthetic peptide
  XENP020458 vlCDR2
AASNLES

SEQ ID NO: 22990 - protein, 9 aa, Artificial Sequence
  Description of Artificial Sequence: Synthetic peptide
  XENP020458 vlCDR3
QQSNEDPFT

SEQ ID NO: 22991 - protein, 450 aa, Artificial Sequence
  Description of Artificial Sequence: Synthetic polypeptide
  XENP020459 7G8_H0.11_L0_IgG1_PVA_/S267K Heavy Chain
EVKLEESGGGLVQPGGSMKLSCAASGFTFSSAWMDWVRQSPEKGLEWVAEIRTKANNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 22992 - protein, 121 aa, Artificial Sequence
  Description of Artificial Sequence: Synthetic polypeptide
  VH of XENP020459
EVKLEESGGGLVQPGGSMKLSCAASGFTFSSAWMDWVRQSPEKGLEWVAEIRTKANNHATYYAESVKGRFTISRDDSKSSVYLQMNSLRAEDTGIYYCTRLANWDWYFDVWGAGTTVTVSS

SEQ ID NO: 22993 - protein, 5 aa, Artificial Sequence
  Description of Artificial Sequence: Synthetic peptide
  XENP020459 vhCDR1
SAWMD

SEQ ID NO: 22994 - protein, 19 aa, Artificial Sequence
  Description of Artificial Sequence: Synthetic peptide
  XENP020459 vhCDR2
EIRTKANNHATYYAESVKG

SEQ ID NO: 22995 - protein, 10 aa, Artificial Sequence
  Description of Artificial Sequence: Synthetic peptide
  XENP020459 vhCDR3
LANWDWYFDV

SEQ ID NO: 22996 - protein, 218 aa, Artificial Sequence; identical to SEQ ID NO: 22266
  Description of Artificial Sequence: Synthetic polypeptide
  XENP020459 7G8_H0.11_L0_IgG1_PVA_/S267K Light Chain

SEQ ID NO: 22997 - protein, 111 aa, Artificial Sequence; identical to SEQ ID NO: 22267
  Description of Artificial Sequence: Synthetic polypeptide
  VL of XENP020459

SEQ ID NO: 22998 - protein, 15 aa, Artificial Sequence
  Description of Artificial Sequence: Synthetic peptide
  XENP020459 vlCDR1
KASQSVDYDGDSYMN

SEQ ID NO: 22999 - protein, 7 aa, Artificial Sequence
  Description of Artificial Sequence: Synthetic peptide
  XENP020459 vlCDR2
AASNLES

SEQ ID NO: 23000 - protein, 9 aa, Artificial Sequence
  Description of Artificial Sequence: Synthetic peptide
  XENP020459 vlCDR3
QQSNEDPFT

SEQ ID NO: 23001 - protein, 450 aa, Artificial Sequence
  Description of Artificial Sequence: Synthetic polypeptide
  XENP020460 7G8_H0.12_L0_IgG1_PVA_/S267K Heavy Chain
EVKLEESGGGLVQPGGSMKLSCAASGFTFSRAWMDWVRQSPEKGLEWVAEIRTKANNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 23002 - protein, 121 aa, Artificial Sequence
  Description of Artificial Sequence: Synthetic polypeptide
  VH of XENP020460
EVKLEESGGGLVQPGGSMKLSCAASGFTFSRAWMDWVRQSPEKGLEWVAEIRTKANNHATYYAESVKGRFTISRDDSKSSVYLQMNSLRAEDTGIYYCTRLANWDWYFDVWGAGTTVTVSS

SEQ ID NO: 23003 - protein, 5 aa, Artificial Sequence
  Description of Artificial Sequence: Synthetic peptide
  XENP020460 vhCDR1
RAWMD

SEQ ID NO: 23004 - protein, 19 aa, Artificial Sequence
  Description of Artificial Sequence: Synthetic peptide
  XENP020460 vhCDR2
EIRTKANNHATYYAESVKG

SEQ ID NO: 23005 - protein, 10 aa, Artificial Sequence
  Description of Artificial Sequence: Synthetic peptide
  XENP020460 vhCDR3
LANWDWYFDV

SEQ ID NO: 23006 - protein, 218 aa, Artificial Sequence; identical to SEQ ID NO: 22266
  Description of Artificial Sequence: Synthetic polypeptide
  XENP020460 7G8_H0.12_L0_IgG1_PVA_/S267K Light Chain

SEQ ID NO: 23007 - protein, 111 aa, Artificial Sequence; identical to SEQ ID NO: 22267
  Description of Artificial Sequence: Synthetic polypeptide
  VL of XENP020460

SEQ ID NO: 23008 - protein, 15 aa, Artificial Sequence
  Description of Artificial Sequence: Synthetic peptide
  XENP020460 vlCDR1
KASQSVDYDGDSYMN

SEQ ID NO: 23009 - protein, 7 aa, Artificial Sequence
  Description of Artificial Sequence: Synthetic peptide
  XENP020460 vlCDR2
AASNLES

SEQ ID NO: 23010 - protein, 9 aa, Artificial Sequence
  Description of Artificial Sequence: Synthetic peptide
  XENP020460 vlCDR3
QQSNEDPFT

SEQ ID NO: 23011 - protein, 450 aa, Artificial Sequence
  Description of Artificial Sequence: Synthetic polypeptide
  XENP020461 7G8_H0.13_L0_IgG1_PVA_/S267K Heavy Chain
EVKLEESGGGLVQPGGSMKLSCAASGFTFSLAWMDWVRQSPEKGLEWVAEIRTKANNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 23012 - protein, 121 aa, Artificial Sequence
  Description of Artificial Sequence: Synthetic polypeptide
  VH of XENP020461
EVKLEESGGGLVQPGGSMKLSCAASGFTFSLAWMDWVRQSPEKGLEWVAEIRTKANNHATYYAESVKGRFTISRDDSKSSVYLQMNSLRAEDTGIYYCTRLANWDWYFDVWGAGTTVTVSS

SEQ ID NO: 23013 - protein, 5 aa, Artificial Sequence
  Description of Artificial Sequence: Synthetic peptide
  XENP020461 vhCDR1
LAWMD

SEQ ID NO: 23014 - protein, 19 aa, Artificial Sequence
  Description of Artificial Sequence: Synthetic peptide
  XENP020461 vhCDR2
EIRTKANNHATYYAESVKG

SEQ ID NO: 23015 - protein, 10 aa, Artificial Sequence
  Description of Artificial Sequence: Synthetic peptide
  XENP020461 vhCDR3
LANWDWYFDV

SEQ ID NO: 23016 - protein, 218 aa, Artificial Sequence; identical to SEQ ID NO: 22266
  Description of Artificial Sequence: Synthetic polypeptide
  XENP020461 7G8_H0.13_L0_IgG1_PVA_/S267K Light Chain

SEQ ID NO: 23017 - protein, 111 aa, Artificial Sequence; identical to SEQ ID NO: 22267
  Description of Artificial Sequence: Synthetic polypeptide
  VL of XENP020461

SEQ ID NO: 23018 - protein, 15 aa, Artificial Sequence
  Description of Artificial Sequence: Synthetic peptide
  XENP020461 vlCDR1
KASQSVDYDGDSYMN

SEQ ID NO: 23019 - protein, 7 aa, Artificial Sequence
  Description of Artificial Sequence: Synthetic peptide
  XENP020461 vlCDR2
AASNLES

SEQ ID NO: 23020 - protein, 9 aa, Artificial Sequence
  Description of Artificial Sequence: Synthetic peptide
  XENP020461 vlCDR3
QQSNEDPFT

SEQ ID NO: 23021 - protein, 450 aa, Artificial Sequence
  Description of Artificial Sequence: Synthetic polypeptide
  XENP020462 7G8_H0.14_L0_IgG1_PVA_/S267K Heavy Chain
EVKLEESGGGLVQPGGSMKLSCAASGFTFSTAWMDWVRQSPEKGLEWVAEIRTKANNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 23022 - protein, 121 aa, Artificial Sequence
  Description of Artificial Sequence: Synthetic polypeptide
  VH of XENP020462
EVKLEESGGGLVQPGGSMKLSCAASGFTFSTAWMDWVRQSPEKGLEWVAEIRTKANNHATYYAESVKGRFTISRDDSKSSVYLQMNSLRAEDTGIYYCTRLANWDWYFDVWGAGTTVTVSS

SEQ ID NO: 23023 - protein, 5 aa, Artificial Sequence
  Description of Artificial Sequence: Synthetic peptide
  XENP020462 vhCDR1
TAWMD

SEQ ID NO: 23024 - protein, 19 aa, Artificial Sequence
  Description of Artificial Sequence: Synthetic peptide
  XENP020462 vhCDR2
EIRTKANNHATYYAESVKG

SEQ ID NO: 23025 - protein, 10 aa, Artificial Sequence
  Description of Artificial Sequence: Synthetic peptide
  XENP020462 vhCDR3
LANWDWYFDV

SEQ ID NO: 23026 - protein, 218 aa, Artificial Sequence; identical to SEQ ID NO: 22266
  Description of Artificial Sequence: Synthetic polypeptide
  XENP020462 7G8_H0.14_L0_IgG1_PVA_/S267K Light Chain

SEQ ID NO: 23027 - protein, 111 aa, Artificial Sequence; identical to SEQ ID NO: 22267
  Description of Artificial Sequence: Synthetic polypeptide
  VL of XENP020462

SEQ ID NO: 23028 - protein, 15 aa, Artificial Sequence
  Description of Artificial Sequence: Synthetic peptide
  XENP020462 vlCDR1
KASQSVDYDGDSYMN

SEQ ID NO: 23029 - protein, 7 aa, Artificial Sequence
  Description of Artificial Sequence: Synthetic peptide
  XENP020462 vlCDR2
AASNLES

SEQ ID NO: 23030 - protein, 9 aa, Artificial Sequence
  Description of Artificial Sequence: Synthetic peptide
  XENP020462 vlCDR3
QQSNEDPFT

SEQ ID NO: 23031 - protein, 450 aa, Artificial Sequence
  Description of Artificial Sequence: Synthetic polypeptide
  XENP020463 7G8_H0.15_L0_IgG1_PVA_/S267K Heavy Chain
EVKLEESGGGLVQPGGSMKLSCAASGFTFSGAWMDWVRQSPEKGLEWVAEIRTKANNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 23032 - protein, 121 aa, Artificial Sequence
  Description of Artificial Sequence: Synthetic polypeptide
  VH of XENP020463
EVKLEESGGGLVQPGGSMKLSCAASGFTFSGAWMDWVRQSPEKGLEWVAEIRTKANNHATYYAESVKGRFTISRDDSKSSVYLQMNSLRAEDTGIYYCTRLANWDWYFDVWGAGTTVTVSS

SEQ ID NO: 23033 - protein, 5 aa, Artificial Sequence
  Description of Artificial Sequence: Synthetic peptide
  XENP020463 vhCDR1
GAWMD

SEQ ID NO: 23034 - protein, 19 aa, Artificial Sequence
  Description of Artificial Sequence: Synthetic peptide
  XENP020463 vhCDR2
EIRTKANNHATYYAESVKG

SEQ ID NO: 23035 - protein, 10 aa, Artificial Sequence
  Description of Artificial Sequence: Synthetic peptide
  XENP020463 vhCDR3
LANWDWYFDV

SEQ ID NO: 23036 - protein, 218 aa, Artificial Sequence; identical to SEQ ID NO: 22266
  Description of Artificial Sequence: Synthetic polypeptide
  XENP020463 7G8_H0.15_L0_IgG1_PVA_/S267K Light Chain

SEQ ID NO: 23037 - protein, 111 aa, Artificial Sequence; identical to SEQ ID NO: 22267
  Description of Artificial Sequence: Synthetic polypeptide
  VL of XENP020463

SEQ ID NO: 23038 - protein, 15 aa, Artificial Sequence
  Description of Artificial Sequence: Synthetic peptide
  XENP020463 vlCDR1
KASQSVDYDGDSYMN

SEQ ID NO: 23039 - protein, 7 aa, Artificial Sequence
  Description of Artificial Sequence: Synthetic peptide
  XENP020463 vlCDR2
AASNLES

SEQ ID NO: 23040 - protein, 9 aa, Artificial Sequence
  Description of Artificial Sequence: Synthetic peptide
  XENP020463 vlCDR3
QQSNEDPFT

SEQ ID NO: 23041 - protein, 450 aa, Artificial Sequence
  Description of Artificial Sequence: Synthetic polypeptide
  XENP020464 7G8_H0.16_L0_IgG1_PVA_/S267K Heavy Chain
EVKLEESGGGLVQPGGSMKLSCAASGFTFSYAWMDWVRQSPEKGLEWVAEIRTKANNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 23042 - protein, 121 aa, Artificial Sequence
  Description of Artificial Sequence: Synthetic polypeptide
  VH of XENP020464
EVKLEESGGGLVQPGGSMKLSCAASGFTFSYAWMDWVRQSPEKGLEWVAEIRTKANNHATYYAESVKGRFTISRDDSKSSVYLQMNSLRAEDTGIYYCTRLANWDWYFDVWGAGTTVTVSS

SEQ ID NO: 23043 - protein, 5 aa, Artificial Sequence
  Description of Artificial Sequence: Synthetic peptide
  XENP020464 vhCDR1
YAWMD

SEQ ID NO: 23044 - protein, 19 aa, Artificial Sequence
  Description of Artificial Sequence: Synthetic peptide
  XENP020464 vhCDR2
EIRTKANNHATYYAESVKG

SEQ ID NO: 23045 - protein, 10 aa, Artificial Sequence
  Description of Artificial Sequence: Synthetic peptide
  XENP020464 vhCDR3
LANWDWYFDV

SEQ ID NO: 23046 - protein, 218 aa, Artificial Sequence; identical to SEQ ID NO: 22266
  Description of Artificial Sequence: Synthetic polypeptide
  XENP020464 7G8_H0.16_L0_IgG1_PVA_/S267K Light Chain

SEQ ID NO: 23047 - protein, 111 aa, Artificial Sequence; identical to SEQ ID NO: 22267
  Description of Artificial Sequence: Synthetic polypeptide
  VL of XENP020464

SEQ ID NO: 23048 - protein, 15 aa, Artificial Sequence
  Description of Artificial Sequence: Synthetic peptide
  XENP020464 vlCDR1
KASQSVDYDGDSYMN

SEQ ID NO: 23049 - protein, 7 aa, Artificial Sequence
  Description of Artificial Sequence: Synthetic peptide
  XENP020464 vlCDR2
AASNLES

SEQ ID NO: 23050 - protein, 9 aa, Artificial Sequence
  Description of Artificial Sequence: Synthetic peptide
  XENP020464 vlCDR3
QQSNEDPFT

SEQ ID NO: 23051 - protein, 450 aa, Artificial Sequence
  Description of Artificial Sequence: Synthetic polypeptide
  XENP020465 7G8_H0.17_L0_IgG1_PVA_/S267K Heavy Chain
EVKLEESGGGLVQPGGSMKLSCAASGFTFSDSWMDWVRQSPEKGLEWVAEIRTKANNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 23052 - protein, 121 aa, Artificial Sequence
  Description of Artificial Sequence: Synthetic polypeptide
  VH of XENP020465
EVKLEESGGGLVQPGGSMKLSCAASGFTFSDSWMDWVRQSPEKGLEWVAEIRTKANNHATYYAESVKGRFTISRDDSKSSVYLQMNSLRAEDTGIYYCTRLANWDWYFDVWGAGTTVTVSS

SEQ ID NO: 23053 - protein, 5 aa, Artificial Sequence
  Description of Artificial Sequence: Synthetic peptide
  XENP020465 vhCDR1
DSWMD

SEQ ID NO: 23054 - protein, 19 aa, Artificial Sequence
  Description of Artificial Sequence: Synthetic peptide
  XENP020465 vhCDR2
EIRTKANNHATYYAESVKG

SEQ ID NO: 23055 - protein, 10 aa, Artificial Sequence
  Description of Artificial Sequence: Synthetic peptide
  XENP020465 vhCDR3
LANWDWYFDV

SEQ ID NO: 23056 - protein, 218 aa, Artificial Sequence; identical to SEQ ID NO: 22266
  Description of Artificial Sequence: Synthetic polypeptide
  XENP020465 7G8_H0.17_L0_IgG1_PVA_/S267K Light Chain

SEQ ID NO: 23057 - protein, 111 aa, Artificial Sequence; identical to SEQ ID NO: 22267
  Description of Artificial Sequence: Synthetic polypeptide
  VL of XENP020465

SEQ ID NO: 23058 - protein, 15 aa, Artificial Sequence
  Description of Artificial Sequence: Synthetic peptide
  XENP020465 vlCDR1
KASQSVDYDGDSYMN

SEQ ID NO: 23059 - protein, 7 aa, Artificial Sequence
  Description of Artificial Sequence: Synthetic peptide
  XENP020465 vlCDR2
AASNLES

SEQ ID NO: 23060 - protein, 9 aa, Artificial Sequence
  Description of Artificial Sequence: Synthetic peptide
  XENP020465 vlCDR3
QQSNEDPFT

SEQ ID NO: 23061 - protein, 450 aa, Artificial Sequence
  Description of Artificial Sequence: Synthetic polypeptide
  XENP020466 7G8_H0.18_L0_IgG1_PVA_/S267K Heavy Chain
EVKLEESGGGLVQPGGSMKLSCAASGFTFSDTWMDWVRQSPEKGLEWVAEIRTKANNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 23062 - protein, 121 aa, Artificial Sequence
  Description of Artificial Sequence: Synthetic polypeptide
  VH of XENP020466
EVKLEESGGGLVQPGGSMKLSCAASGFTFSDTWMDWVRQSPEKGLEWVAEIRTKANNHATYYAESVKGRFTISRDDSKSSVYLQMNSLRAEDTGIYYCTRLANWDWYFDVWGAGTTVTVSS

SEQ ID NO: 23063 - protein, 5 aa, Artificial Sequence
  Description of Artificial Sequence: Synthetic peptide
  XENP020466 vhCDR1
DTWMD

SEQ ID NO: 23064 - protein, 19 aa, Artificial Sequence
  Description of Artificial Sequence: Synthetic peptide
  XENP020466 vhCDR2
EIRTKANNHATYYAESVKG

SEQ ID NO: 23065 - protein, 10 aa, Artificial Sequence
  Description of Artificial Sequence: Synthetic peptide
  XENP020466 vhCDR3
LANWDWYFDV

SEQ ID NO: 23066 - protein, 218 aa, Artificial Sequence; identical to SEQ ID NO: 22266
  Description of Artificial Sequence: Synthetic polypeptide
  XENP020466 7G8_H0.18_L0_IgG1_PVA_/S267K Light Chain

SEQ ID NO: 23067 - protein, 111 aa, Artificial Sequence; identical to SEQ ID NO: 22267
  Description of Artificial Sequence: Synthetic polypeptide
  VL of XENP020466

SEQ ID NO: 23068 - protein, 15 aa, Artificial Sequence
  Description of Artificial Sequence: Synthetic peptide
  XENP020466 vlCDR1
KASQSVDYDGDSYMN

SEQ ID NO: 23069 - protein, 7 aa, Artificial Sequence
  Description of Artificial Sequence: Synthetic peptide
  XENP020466 vlCDR2
AASNLES

SEQ ID NO: 23070 - protein, 9 aa, Artificial Sequence
  Description of Artificial Sequence: Synthetic peptide
  XENP020466 vlCDR3
QQSNEDPFT

SEQ ID NO: 23071 - protein, 450 aa, Artificial Sequence
  Description of Artificial Sequence: Synthetic polypeptide
  XENP020467 7G8_H0.19_L0_IgG1_PVA_/S267K Heavy Chain
EVKLEESGGGLVQPGGSMKLSCAASGFTFSDGWMDWVRQSPEKGLEWVAEIRTKANNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 23072 - protein, 121 aa, Artificial Sequence
  Description of Artificial Sequence: Synthetic polypeptide
  VH of XENP020467
EVKLEESGGGLVQPGGSMKLSCAASGFTFSDGWMDWVRQSPEKGLEWVAEIRTKANNHATYYAESVKGRFTISRDDSKSSVYLQMNSLRAEDTGIYYCTRLANWDWYFDVWGAGTTVTVSS

SEQ ID NO: 23073 - protein, 5 aa, Artificial Sequence
  Description of Artificial Sequence: Synthetic peptide
  XENP020467 vhCDR1
DGWMD

SEQ ID NO: 23074 - protein, 19 aa, Artificial Sequence
  Description of Artificial Sequence: Synthetic peptide
  XENP020467 vhCDR2
EIRTKANNHATYYAESVKG

SEQ ID NO: 23075 - protein, 10 aa, Artificial Sequence
  Description of Artificial Sequence: Synthetic peptide
  XENP020467 vhCDR3
LANWDWYFDV

SEQ ID NO: 23076 - protein, 218 aa, Artificial Sequence; identical to SEQ ID NO: 22266
  Description of Artificial Sequence: Synthetic polypeptide
  XENP020467 7G8_H0.19_L0_IgG1_PVA_/S267K Light Chain

SEQ ID NO: 23077 - protein, 111 aa, Artificial Sequence; identical to SEQ ID NO: 22267
  Description of Artificial Sequence: Synthetic polypeptide
  VL of XENP020467

SEQ ID NO: 23078 - protein, 15 aa, Artificial Sequence
  Description of Artificial Sequence: Synthetic peptide
  XENP020467 vlCDR1
KASQSVDYDGDSYMN

SEQ ID NO: 23079 - protein, 7 aa, Artificial Sequence
  Description of Artificial Sequence: Synthetic peptide
  XENP020467 vlCDR2
AASNLES

SEQ ID NO: 23080 - protein, 9 aa, Artificial Sequence
  Description of Artificial Sequence: Synthetic peptide
  XENP020467 vlCDR3
QQSNEDPFT

SEQ ID NO: 23081 - protein, 450 aa, Artificial Sequence
  Description of Artificial Sequence: Synthetic polypeptide
  XENP020468 7G8_H0.20_L0_IgG1_PVA_/S267K Heavy Chain
EVKLEESGGGLVQPGGSMKLSCAASGFTFSDHWMDWVRQSPEKGLEWVAEIRTKANNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 23082 - protein, 121 aa, Artificial Sequence
  Description of Artificial Sequence: Synthetic polypeptide
  VH of XENP020468
EVKLEESGGGLVQPGGSMKLSCAASGFTFSDHWMDWVRQSPEKGLEWVAEIRTKANNHATYYAESVKGRFTISRDDSKSSVYLQMNSLRAEDTGIYYCTRLANWDWYFDVWGAGTTVTVSS

SEQ ID NO: 23083 - protein, 5 aa, Artificial Sequence
  Description of Artificial Sequence: Synthetic peptide
  XENP020468 vhCDR1
DHWMD

SEQ ID NO: 23084 - protein, 19 aa, Artificial Sequence
  Description of Artificial Sequence: Synthetic peptide
  XENP020468 vhCDR2
EIRTKANNHATYYAESVKG

SEQ ID NO: 23085 - protein, 10 aa, Artificial Sequence
  Description of Artificial Sequence: Synthetic peptide
  XENP020468 vhCDR3
LANWDWYFDV

SEQ ID NO: 23086 - protein, 218 aa, Artificial Sequence; identical to SEQ ID NO: 22266
  Description of Artificial Sequence: Synthetic polypeptide
  XENP020468 7G8_H0.20_L0_IgG1_PVA_/S267K Light Chain

SEQ ID NO: 23087 - protein, 111 aa, Artificial Sequence; identical to SEQ ID NO: 22267
  Description of Artificial Sequence: Synthetic polypeptide
  VL of XENP020468

SEQ ID NO: 23088 - protein, 15 aa, Artificial Sequence
  Description of Artificial Sequence: Synthetic peptide
  XENP020468 vlCDR1
KASQSVDYDGDSYMN

SEQ ID NO: 23089 - protein, 7 aa, Artificial Sequence
  Description of Artificial Sequence: Synthetic peptide
  XENP020468 vlCDR2
AASNLES

SEQ ID NO: 23090 - protein, 9 aa, Artificial Sequence
  Description of Artificial Sequence: Synthetic peptide
  XENP020468 vlCDR3
QQSNEDPFT

SEQ ID NO: 23091 - protein, 450 aa, Artificial Sequence
  Description of Artificial Sequence: Synthetic polypeptide
  XENP020469 7G8_H0.21_L0_IgG1_PVA_/S267K Heavy Chain
EVKLEESGGGLVQPGGSMKLSCAASGFTFSDDWMDWVRQSPEKGLEWVAEIRTKANNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 23092 - protein, 121 aa, Artificial Sequence
  Description of Artificial Sequence: Synthetic polypeptide
  VH of XENP020469
EVKLEESGGGLVQPGGSMKLSCAASGFTFSDDWMDWVRQSPEKGLEWVAEIRTKANNHATYYAESVKGRFTISRDDSKSSVYLQMNSLRAEDTGIYYCTRLANWDWYFDVWGAGTTVTVSS

SEQ ID NO: 23093 - protein, 5 aa, Artificial Sequence
  Description of Artificial Sequence: Synthetic peptide
  XENP020469 vhCDR1
DDWMD

SEQ ID NO: 23094 - protein, 19 aa, Artificial Sequence
  Description of Artificial Sequence: Synthetic peptide
  XENP020469 vhCDR2
EIRTKANNHATYYAESVKG

SEQ ID NO: 23095 - protein, 10 aa, Artificial Sequence
  Description of Artificial Sequence: Synthetic peptide
  XENP020469 vhCDR3
LANWDWYFDV

SEQ ID NO: 23096 - protein, 218 aa, Artificial Sequence; identical to SEQ ID NO: 22266
  Description of Artificial Sequence: Synthetic polypeptide
  XENP020469 7G8_H0.21_L0_IgG1_PVA_/S267K Light Chain

SEQ ID NO: 23097 - protein, 111 aa, Artificial Sequence; identical to SEQ ID NO: 22267
  Description of Artificial Sequence: Synthetic polypeptide
  VL of XENP020469

SEQ ID NO: 23098 - protein, 15 aa, Artificial Sequence
  Description of Artificial Sequence: Synthetic peptide
  XENP020469 vlCDR1
KASQSVDYDGDSYMN

SEQ ID NO: 23099 - protein, 7 aa, Artificial Sequence
  Description of Artificial Sequence: Synthetic peptide
  XENP020469 vlCDR2
AASNLES

SEQ ID NO: 23100 - protein, 9 aa, Artificial Sequence
  Description of Artificial Sequence: Synthetic peptide
  XENP020469 vlCDR3
QQSNEDPFT

SEQ ID NO: 23101 - protein, 450 aa, Artificial Sequence
  Description of Artificial Sequence: Synthetic polypeptide
  XENP020470 7G8_H0.22_L0_IgG1_PVA_/S267K Heavy Chain
EVKLEESGGGLVQPGGSMKLSCAASGFTFSDLWMDWVRQSPEKGLEWVAEIRTKANNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 23102 - protein, 121 aa, Artificial Sequence
  Description of Artificial Sequence: Synthetic polypeptide
  VH of XENP020470
EVKLEESGGGLVQPGGSMKLSCAASGFTFSDLWMDWVRQSPEKGLEWVAEIRTKANNHATYYAESVKGRFTISRDDSKSSVYLQMNSLRAEDTGIYYCTRLANWDWYFDVWGAGTTVTVSS

SEQ ID NO: 23103 - protein, 5 aa, Artificial Sequence
  Description of Artificial Sequence: Synthetic peptide
  XENP020470 vhCDR1
DLWMD

SEQ ID NO: 23104 - protein, 19 aa, Artificial Sequence
  Description of Artificial Sequence: Synthetic peptide
  XENP020470 vhCDR2
EIRTKANNHATYYAESVKG

SEQ ID NO: 23105 - protein, 10 aa, Artificial Sequence
  Description of Artificial Sequence: Synthetic peptide
  XENP020470 vhCDR3
LANWDWYFDV

SEQ ID NO: 23106 - protein, 218 aa, Artificial Sequence; identical to SEQ ID NO: 22266
  Description of Artificial Sequence: Synthetic polypeptide
  XENP020470 7G8_H0.22_L0_IgG1_PVA_/S267K Light Chain

SEQ ID NO: 23107 - protein, 111 aa, Artificial Sequence; identical to SEQ ID NO: 22267
  Description of Artificial Sequence: Synthetic polypeptide
  VL of XENP020470

SEQ ID NO: 23108 - protein, 15 aa, Artificial Sequence
  Description of Artificial Sequence: Synthetic peptide
  XENP020470 vlCDR1
KASQSVDYDGDSYMN

SEQ ID NO: 23109 - protein, 7 aa, Artificial Sequence
  Description of Artificial Sequence: Synthetic peptide
  XENP020470 vlCDR2
AASNLES

SEQ ID NO: 23110 - protein, 9 aa, Artificial Sequence
  Description of Artificial Sequence: Synthetic peptide
  XENP020470 vlCDR3
QQSNEDPFT

SEQ ID NO: 23111 - protein, 450 aa, Artificial Sequence
  Description of Artificial Sequence: Synthetic polypeptide
  XENP020471 7G8_H0.23_L0_IgG1_PVA_/S267K Heavy Chain
EVKLEESGGGLVQPGGSMKLSCAASGFTFSDKWMDWVRQSPEKGLEWVAEIRTKANNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 23112 - protein, 121 aa, Artificial Sequence
  Description of Artificial Sequence: Synthetic polypeptide
  VH of XENP020471
EVKLEESGGGLVQPGGSMKLSCAASGFTFSDKWMDWVRQSPEKGLEWVAEIRTKANNHATYYAESVKGRFTISRDDSKSSVYLQMNSLRAEDTGIYYCTRLANWDWYFDVWGAGTTVTVSS

SEQ ID NO: 23113 - protein, 5 aa, Artificial Sequence
  Description of Artificial Sequence: Synthetic peptide
  XENP020471 vhCDR1
DKWMD

SEQ ID NO: 23114 - protein, 19 aa, Artificial Sequence
  Description of Artificial Sequence: Synthetic peptide
  XENP020471 vhCDR2
EIRTKANNHATYYAESVKG

SEQ ID NO: 23115 - protein, 10 aa, Artificial Sequence
  Description of Artificial Sequence: Synthetic peptide
  XENP020471 vhCDR3
LANWDWYFDV

SEQ ID NO: 23116 - protein, 218 aa, Artificial Sequence; identical to SEQ ID NO: 22266
  Description of Artificial Sequence: Synthetic polypeptide
  XENP020471 7G8_H0.23_L0_IgG1_PVA_/S267K Light Chain

SEQ ID NO: 23117 - protein, 111 aa, Artificial Sequence; identical to SEQ ID NO: 22267
  Description of Artificial Sequence: Synthetic polypeptide
  VL of XENP020471

SEQ ID NO: 23118 - protein, 15 aa, Artificial Sequence
  Description of Artificial Sequence: Synthetic peptide
  XENP020471 vlCDR1
KASQSVDYDGDSYMN

SEQ ID NO: 23119 - protein, 7 aa, Artificial Sequence
  Description of Artificial Sequence: Synthetic peptide
  XENP020471 vlCDR2
AASNLES

SEQ ID NO: 23120 - protein, 9 aa, Artificial Sequence
  Description of Artificial Sequence: Synthetic peptide
  XENP020471 vlCDR3
QQSNEDPFT

SEQ ID NO: 23121 - protein, 450 aa, Artificial Sequence
  Description of Artificial Sequence: Synthetic polypeptide
  XENP020472 7G8_H0.24_L0_IgG1_PVA_/S267K Heavy Chain
EVKLEESGGGLVQPGGSMKLSCAASGFTFSDYWMDWVRQSPEKGLEWVAEIRTKANNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 23122 - protein, 121 aa, Artificial Sequence
  Description of Artificial Sequence: Synthetic polypeptide
  VH of XENP020472
EVKLEESGGGLVQPGGSMKLSCAASGFTFSDYWMDWVRQSPEKGLEWVAEIRTKANNHATYYAESVKGRFTISRDDSKSSVYLQMNSLRAEDTGIYYCTRLANWDWYFDVWGAGTTVTVSS

SEQ ID NO: 23123 - protein, 5 aa, Artificial Sequence
  Description of Artificial Sequence: Synthetic peptide
  XENP020472 vhCDR1
DYWMD

SEQ ID NO: 23124 - protein, 19 aa, Artificial Sequence
  Description of Artificial Sequence: Synthetic peptide
  XENP020472 vhCDR2
EIRTKANNHATYYAESVKG

SEQ ID NO: 23125 - protein, 10 aa, Artificial Sequence
  Description of Artificial Sequence: Synthetic peptide
  XENP020472 vhCDR3
LANWDWYFDV

SEQ ID NO: 23126 - protein, 218 aa, Artificial Sequence; identical to SEQ ID NO: 22266
  Description of Artificial Sequence: Synthetic polypeptide
  XENP020472 7G8_H0.24_L0_IgG1_PVA_/S267K Light Chain

SEQ ID NO: 23127 - protein, 111 aa, Artificial Sequence; identical to SEQ ID NO: 22267
  Description of Artificial Sequence: Synthetic polypeptide
  VL of XENP020472

SEQ ID NO: 23128 - protein, 15 aa, Artificial Sequence
  Description of Artificial Sequence: Synthetic peptide
  XENP020472 vlCDR1
KASQSVDYDGDSYMN

SEQ ID NO: 23129 - protein, 7 aa, Artificial Sequence
  Description of Artificial Sequence: Synthetic peptide
  XENP020472 vlCDR2
AASNLES

SEQ ID NO: 23130 - protein, 9 aa, Artificial Sequence
  Description of Artificial Sequence: Synthetic peptide
  XENP020472 vlCDR3
QQSNEDPFT

SEQ ID NO: 23131 - protein, 450 aa, Artificial Sequence
  Description of Artificial Sequence: Synthetic polypeptide
  XENP020473 7G8_H0.25_L0_IgG1_PVA_/S267K Heavy Chain
EVKLEESGGGLVQPGGSMKLSCAASGFTFSDAYMDWVRQSPEKGLEWVAEIRTKANNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 23132 - protein, 121 aa, Artificial Sequence
  Description of Artificial Sequence: Synthetic polypeptide
  VH of XENP020473
EVKLEESGGGLVQPGGSMKLSCAASGFTFSDAYMDWVRQSPEKGLEWVAEIRTKANNHATYYAESVKGRFTISRDDSKSSVYLQMNSLRAEDTGIYYCTRLANWDWYFDVWGAGTTVTVSS

SEQ ID NO: 23133 - protein, 5 aa, Artificial Sequence
  Description of Artificial Sequence: Synthetic peptide
  XENP020473 vhCDR1
DAYMD

SEQ ID NO: 23134 - protein, 19 aa, Artificial Sequence
  Description of Artificial Sequence: Synthetic peptide
  XENP020473 vhCDR2
EIRTKANNHATYYAESVKG

SEQ ID NO: 23135 - protein, 10 aa, Artificial Sequence
  Description of Artificial Sequence: Synthetic peptide
  XENP020473 vhCDR3
LANWDWYFDV

SEQ ID NO: 23136 - protein, 218 aa, Artificial Sequence; identical to SEQ ID NO: 22266
  Description of Artificial Sequence: Synthetic polypeptide
  XENP020473 7G8_H0.25_L0_IgG1_PVA_/S267K Light Chain

SEQ ID NO: 23137 - protein, 111 aa, Artificial Sequence; identical to SEQ ID NO: 22267
  Description of Artificial Sequence: Synthetic polypeptide
  VL of XENP020473

SEQ ID NO: 23138 - protein, 15 aa, Artificial Sequence
  Description of Artificial Sequence: Synthetic peptide
  XENP020473 vlCDR1
KASQSVDYDGDSYMN

SEQ ID NO: 23139 - protein, 7 aa, Artificial Sequence
  Description of Artificial Sequence: Synthetic peptide
  XENP020473 vlCDR2
AASNLES

SEQ ID NO: 23140 - protein, 9 aa, Artificial Sequence
  Description of Artificial Sequence: Synthetic peptide
  XENP020473 vlCDR3
QQSNEDPFT

SEQ ID NO: 23141 - protein, 450 aa, Artificial Sequence
  Description of Artificial Sequence: Synthetic polypeptide
  XENP020474 7G8_H0.26_L0_IgG1_PVA_/S267K Heavy Chain
EVKLEESGGGLVQPGGSMKLSCAASGFTFSDAFMDWVRQSPEKGLEWVAEIRTKANNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 23142 - protein, 121 aa, Artificial Sequence
  Description of Artificial Sequence: Synthetic polypeptide
  VH of XENP020474
EVKLEESGGGLVQPGGSMKLSCAASGFTFSDAFMDWVRQSPEKGLEWVAEIRTKANNHATYYAESVKGRFTISRDDSKSSVYLQMNSLRAEDTGIYYCTRLANWDWYFDVWGAGTTVTVSS

SEQ ID NO: 23143 - protein, 5 aa, Artificial Sequence
  Description of Artificial Sequence: Synthetic peptide
  XENP020474 vhCDR1
DAFMD

SEQ ID NO: 23144 - protein, 19 aa, Artificial Sequence
  Description of Artificial Sequence: Synthetic peptide
  XENP020474 vhCDR2
EIRTKANNHATYYAESVKG

SEQ ID NO: 23145 - protein, 10 aa, Artificial Sequence
  Description of Artificial Sequence: Synthetic peptide
  XENP020474 vhCDR3
LANWDWYFDV

SEQ ID NO: 23146 - protein, 218 aa, Artificial Sequence; identical to SEQ ID NO: 22266
  Description of Artificial Sequence: Synthetic polypeptide
  XENP020474 7G8_H0.26_L0_IgG1_PVA_/S267K Light Chain

SEQ ID NO: 23147 - protein, 111 aa, Artificial Sequence; identical to SEQ ID NO: 22267
  Description of Artificial Sequence: Synthetic polypeptide
  VL of XENP020474

SEQ ID NO: 23148 - protein, 15 aa, Artificial Sequence
  Description of Artificial Sequence: Synthetic peptide
  XENP020474 vlCDR1
KASQSVDYDGDSYMN

SEQ ID NO: 23149 - protein, 7 aa, Artificial Sequence
  Description of Artificial Sequence: Synthetic peptide
  XENP020474 vlCDR2
AASNLES

SEQ ID NO: 23150 - protein, 9 aa, Artificial Sequence
  Description of Artificial Sequence: Synthetic peptide
  XENP020474 vlCDR3
QQSNEDPFT

SEQ ID NO: 23151 - protein, 450 aa, Artificial Sequence
  Description of Artificial Sequence: Synthetic polypeptide
  XENP020475 7G8_H0.27_L0_IgG1_PVA_/S267K Heavy Chain
EVKLEESGGGLVQPGGSMKLSCAASGFTFSDAWMDWVRQSPEKGLEWVAEIKTKANNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 23152 - protein, 121 aa, Artificial Sequence
  Description of Artificial Sequence: Synthetic polypeptide
  VH of XENP020475
EVKLEESGGGLVQPGGSMKLSCAASGFTFSDAWMDWVRQSPEKGLEWVAEIKTKANNHATYYAESVKGRFTISRDDSKSSVYLQMNSLRAEDTGIYYCTRLANWDWYFDVWGAGTTVTVSS

SEQ ID NO: 23153 - protein, 5 aa, Artificial Sequence
  Description of Artificial Sequence: Synthetic peptide
  XENP020475 vhCDR1
DAWMD

SEQ ID NO: 23154 - protein, 19 aa, Artificial Sequence
  Description of Artificial Sequence: Synthetic peptide
  XENP020475 vhCDR2
EIKTKANNHATYYAESVKG

SEQ ID NO: 23155 - protein, 10 aa, Artificial Sequence
  Description of Artificial Sequence: Synthetic peptide
  XENP020475 vhCDR3
LANWDWYFDV

SEQ ID NO: 23156 - protein, 218 aa, Artificial Sequence; identical to SEQ ID NO: 22266
  Description of Artificial Sequence: Synthetic polypeptide
  XENP020475 7G8_H0.27_L0_IgG1_PVA_/S267K Light Chain

SEQ ID NO: 23157 - protein, 111 aa, Artificial Sequence; identical to SEQ ID NO: 22267
  Description of Artificial Sequence: Synthetic polypeptide
  VL of XENP020475

SEQ ID NO: 23158 - protein, 15 aa, Artificial Sequence
  Description of Artificial Sequence: Synthetic peptide
  XENP020475 vlCDR1
KASQSVDYDGDSYMN

SEQ ID NO: 23159 - protein, 7 aa, Artificial Sequence
  Description of Artificial Sequence: Synthetic peptide
  XENP020475 vlCDR2
AASNLES

SEQ ID NO: 23160 - protein, 9 aa, Artificial Sequence
  Description of Artificial Sequence: Synthetic peptide
  XENP020475 vlCDR3
QQSNEDPFT

SEQ ID NO: 23161 - protein, 450 aa, Artificial Sequence
  Description of Artificial Sequence: Synthetic polypeptide
  XENP020476 7G8_H0.28_L0_IgG1_PVA_/S267K Heavy Chain
EVKLEESGGGLVQPGGSMKLSCAASGFTFSDAWMDWVRQSPEKGLEWVAEIETKANNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 23162 - protein, 121 aa, Artificial Sequence
  Description of Artificial Sequence: Synthetic polypeptide
  VH of XENP020476
EVKLEESGGGLVQPGGSMKLSCAASGFTFSDAWMDWVRQSPEKGLEWVAEIETKANNHATYYAESVKGRFTISRDDSKSSVYLQMNSLRAEDTGIYYCTRLANWDWYFDVWGAGTTVTVSS

SEQ ID NO: 23163 - protein, 5 aa, Artificial Sequence
  Description of Artificial Sequence: Synthetic peptide
  XENP020476 vhCDR1
DAWMD

SEQ ID NO: 23164 - protein, 19 aa, Artificial Sequence
  Description of Artificial Sequence: Synthetic peptide
  XENP020476 vhCDR2
EIETKANNHATYYAESVKG

SEQ ID NO: 23165 - protein, 10 aa, Artificial Sequence
  Description of Artificial Sequence: Synthetic peptide
  XENP020476 vhCDR3
LANWDWYFDV

SEQ ID NO: 23166 - protein, 218 aa, Artificial Sequence; identical to SEQ ID NO: 22266
  Description of Artificial Sequence: Synthetic polypeptide
  XENP020476 7G8_H0.28_L0_IgG1_PVA_/S267K Light Chain

SEQ ID NO: 23167 - protein, 111 aa, Artificial Sequence; identical to SEQ ID NO: 22267
  Description of Artificial Sequence: Synthetic polypeptide
  VL of XENP020476

SEQ ID NO: 23168 - protein, 15 aa, Artificial Sequence
  Description of Artificial Sequence: Synthetic peptide
  XENP020476 vlCDR1
KASQSVDYDGDSYMN

SEQ ID NO: 23169 - protein, 7 aa, Artificial Sequence
  Description of Artificial Sequence: Synthetic peptide
  XENP020476 vlCDR2
AASNLES

SEQ ID NO: 23170 - protein, 9 aa, Artificial Sequence
  Description of Artificial Sequence: Synthetic peptide
  XENP020476 vlCDR3
QQSNEDPFT

SEQ ID NO: 23171 - protein, 450 aa, Artificial Sequence
  Description of Artificial Sequence: Synthetic polypeptide
  XENP020477 7G8_H0.29_L0_IgG1_PVA_/S267K Heavy Chain
EVKLEESGGGLVQPGGSMKLSCAASGFTFSDAWMDWVRQSPEKGLEWVAEIDTKANNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 23172 - protein, 121 aa, Artificial Sequence
  Description of Artificial Sequence: Synthetic polypeptide
  VH of XENP020477
EVKLEESGGGLVQPGGSMKLSCAASGFTFSDAWMDWVRQSPEKGLEWVAEIDTKANNHATYYAESVKGRFTISRDDSKSSVYLQMNSLRAEDTGIYYCTRLANWDWYFDVWGAGTTVTVSS

SEQ ID NO: 23173 - protein, 5 aa, Artificial Sequence
  Description of Artificial Sequence: Synthetic peptide
  XENP020477 vhCDR1
DAWMD

SEQ ID NO: 23174 - protein, 19 aa, Artificial Sequence
  Description of Artificial Sequence: Synthetic peptide
  XENP020477 vhCDR2
EIDTKANNHATYYAESVKG

SEQ ID NO: 23175 - protein, 10 aa, Artificial Sequence
  Description of Artificial Sequence: Synthetic peptide
  XENP020477 vhCDR3
LANWDWYFDV

SEQ ID NO: 23176 - protein, 218 aa, Artificial Sequence; identical to SEQ ID NO: 22266
  Description of Artificial Sequence: Synthetic polypeptide
  XENP020477 7G8_H0.29_L0_IgG1_PVA_/S267K Light Chain

SEQ ID NO: 23177 - protein, 111 aa, Artificial Sequence; identical to SEQ ID NO: 22267
  Description of Artificial Sequence: Synthetic polypeptide
  VL of XENP020477

SEQ ID NO: 23178 - protein, 15 aa, Artificial Sequence
  Description of Artificial Sequence: Synthetic peptide
  XENP020477 vlCDR1
KASQSVDYDGDSYMN

SEQ ID NO: 23179 - protein, 7 aa, Artificial Sequence
  Description of Artificial Sequence: Synthetic peptide
  XENP020477 vlCDR2
AASNLES

SEQ ID NO: 23180 - protein, 9 aa, Artificial Sequence
  Description of Artificial Sequence: Synthetic peptide
  XENP020477 vlCDR3
QQSNEDPFT

SEQ ID NO: 23181 - protein, 450 aa, Artificial Sequence
  Description of Artificial Sequence: Synthetic polypeptide
  XENP020478 7G8_H0.30_L0_IgG1_PVA_/S267K Heavy Chain
EVKLEESGGGLVQPGGSMKLSCAASGFTFSDAWMDWVRQSPEKGLEWVAEIHTKANNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 23182 - protein, 121 aa, Artificial Sequence
  Description of Artificial Sequence: Synthetic polypeptide
  VH of XENP020478
EVKLEESGGGLVQPGGSMKLSCAASGFTFSDAWMDWVRQSPEKGLEWVAEIHTKANNHATYYAESVKGRFTISRDDSKSSVYLQMNSLRAEDTGIYYCTRLANWDWYFDVWGAGTTVTVSS

SEQ ID NO: 23183 - protein, 5 aa, Artificial Sequence
  Description of Artificial Sequence: Synthetic peptide
  XENP020478 vhCDR1
DAWMD

SEQ ID NO: 23184 - protein, 19 aa, Artificial Sequence
  Description of Artificial Sequence: Synthetic peptide
  XENP020478 vhCDR2
EIHTKANNHATYYAESVKG

SEQ ID NO: 23185 - protein, 10 aa, Artificial Sequence
  Description of Artificial Sequence: Synthetic peptide
  XENP020478 vhCDR3
LANWDWYFDV

SEQ ID NO: 23186 - protein, 218 aa, Artificial Sequence; identical to SEQ ID NO: 22266
  Description of Artificial Sequence: Synthetic polypeptide
  XENP020478 7G8_H0.30_L0_IgG1_PVA_/S267K Light Chain

SEQ ID NO: 23187 - protein, 111 aa, Artificial Sequence; identical to SEQ ID NO: 22267
  Description of Artificial Sequence: Synthetic polypeptide
  VL of XENP020478

SEQ ID NO: 23188 - protein, 15 aa, Artificial Sequence
  Description of Artificial Sequence: Synthetic peptide
  XENP020478 vlCDR1
KASQSVDYDGDSYMN

SEQ ID NO: 23189 - protein, 7 aa, Artificial Sequence
  Description of Artificial Sequence: Synthetic peptide
  XENP020478 vlCDR2
AASNLES

SEQ ID NO: 23190 - protein, 9 aa, Artificial Sequence
  Description of Artificial Sequence: Synthetic peptide
  XENP020478 vlCDR3
QQSNEDPFT

SEQ ID NO: 23191 - protein, 450 aa, Artificial Sequence
  Description of Artificial Sequence: Synthetic polypeptide
  XENP020479 7G8_H0.31_L0_IgG1_PVA_/S267K Heavy Chain
EVKLEESGGGLVQPGGSMKLSCAASGFTFSDAWMDWVRQSPEKGLEWVAEISTKANNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 23192 - protein, 121 aa, Artificial Sequence
  Description of Artificial Sequence: Synthetic polypeptide
  VH of XENP020479
EVKLEESGGGLVQPGGSMKLSCAASGFTFSDAWMDWVRQSPEKGLEWVAEISTKANNHATYYAESVKGRFTISRDDSKSSVYLQMNSLRAEDTGIYYCTRLANWDWYFDVWGAGTTVTVSS

SEQ ID NO: 23193 - protein, 5 aa, Artificial Sequence
  Description of Artificial Sequence: Synthetic peptide
  XENP020479 vhCDR1
DAWMD

SEQ ID NO: 23194 - protein, 19 aa, Artificial Sequence
  Description of Artificial Sequence: Synthetic peptide
  XENP020479 vhCDR2
EISTKANNHATYYAESVKG

SEQ ID NO: 23195 - protein, 10 aa, Artificial Sequence
  Description of Artificial Sequence: Synthetic peptide
  XENP020479 vhCDR3
LANWDWYFDV

SEQ ID NO: 23196 - protein, 218 aa, Artificial Sequence; identical to SEQ ID NO: 22266
  Description of Artificial Sequence: Synthetic polypeptide
  XENP020479 7G8_H0.31_L0_IgG1_PVA_/S267K Light Chain

SEQ ID NO: 23197 - protein, 111 aa, Artificial Sequence; identical to SEQ ID NO: 22267
  Description of Artificial Sequence: Synthetic polypeptide
  VL of XENP020479

SEQ ID NO: 23198 - protein, 15 aa, Artificial Sequence
  Description of Artificial Sequence: Synthetic peptide
  XENP020479 vlCDR1
KASQSVDYDGDSYMN

SEQ ID NO: 23199 - protein, 7 aa, Artificial Sequence
  Description of Artificial Sequence: Synthetic peptide
  XENP020479 vlCDR2
AASNLES

SEQ ID NO: 23200 - protein, 9 aa, Artificial Sequence
  Description of Artificial Sequence: Synthetic peptide
  XENP020479 vlCDR3
QQSNEDPFT

SEQ ID NO: 23201 - protein, 450 aa, Artificial Sequence
  Description of Artificial Sequence: Synthetic polypeptide
  XENP020480 7G8_H0.32_L0_IgG1_PVA_/S267K Heavy Chain
EVKLEESGGGLVQPGGSMKLSCAASGFTFSDAWMDWVRQSPEKGLEWVAEIGTKANNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 23202 - protein, 121 aa, Artificial Sequence
  Description of Artificial Sequence: Synthetic polypeptide
  VH of XENP020480
EVKLEESGGGLVQPGGSMKLSCAASGFTFSDAWMDWVRQSPEKGLEWVAEIGTKANNHATYYAESVKGRFTISRDDSKSSVYLQMNSLRAEDTGIYYCTRLANWDWYFDVWGAGTTVTVSS

SEQ ID NO: 23203 - protein, 5 aa, Artificial Sequence
  Description of Artificial Sequence: Synthetic peptide
  XENP020480 vhCDR1
DAWMD

SEQ ID NO: 23204 - protein, 19 aa, Artificial Sequence
  Description of Artificial Sequence: Synthetic peptide
  XENP020480 vhCDR2
EIGTKANNHATYYAESVKG

SEQ ID NO: 23205 - protein, 10 aa, Artificial Sequence
  Description of Artificial Sequence: Synthetic peptide
  XENP020480 vhCDR3
LANWDWYFDV

SEQ ID NO: 23206 - protein, 218 aa, Artificial Sequence; identical to SEQ ID NO: 22266
  Description of Artificial Sequence: Synthetic polypeptide
  XENP020480 7G8_H0.32_L0_IgG1_PVA_/S267K Light Chain

SEQ ID NO: 23207 - protein, 111 aa, Artificial Sequence; identical to SEQ ID NO: 22267
  Description of Artificial Sequence: Synthetic polypeptide
  VL of XENP020480

SEQ ID NO: 23208 - protein, 15 aa, Artificial Sequence
  Description of Artificial Sequence: Synthetic peptide
  XENP020480 vlCDR1
KASQSVDYDGDSYMN

SEQ ID NO: 23209 - protein, 7 aa, Artificial Sequence
  Description of Artificial Sequence: Synthetic peptide
  XENP020480 vlCDR2
AASNLES

SEQ ID NO: 23210 - protein, 9 aa, Artificial Sequence
  Description of Artificial Sequence: Synthetic peptide
  XENP020480 vlCDR3
QQSNEDPFT

SEQ ID NO: 23211 - protein, 450 aa, Artificial Sequence
  Description of Artificial Sequence: Synthetic polypeptide
  XENP020481 7G8_H0.33_L0_IgG1_PVA_/S267K Heavy Chain
EVKLEESGGGLVQPGGSMKLSCAASGFTFSDAWMDWVRQSPEKGLEWVAEIYTKANNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 23212 - protein, 121 aa, Artificial Sequence
  Description of Artificial Sequence: Synthetic polypeptide
  VH of XENP020481
EVKLEESGGGLVQPGGSMKLSCAASGFTFSDAWMDWVRQSPEKGLEWVAEIYTKANNHATYYAESVKGRFTISRDDSKSSVYLQMNSLRAEDTGIYYCTRLANWDWYFDVWGAGTTVTVSS

SEQ ID NO: 23213 - protein, 5 aa, Artificial Sequence
  Description of Artificial Sequence: Synthetic peptide
  XENP020481 vhCDR1
DAWMD

SEQ ID NO: 23214 - protein, 19 aa, Artificial Sequence
  Description of Artificial Sequence: Synthetic peptide
  XENP020481 vhCDR2
EIYTKANNHATYYAESVKG

SEQ ID NO: 23215 - protein, 10 aa, Artificial Sequence
  Description of Artificial Sequence: Synthetic peptide
  XENP020481 vhCDR3
LANWDWYFDV

SEQ ID NO: 23216 - protein, 218 aa, Artificial Sequence; identical to SEQ ID NO: 22266
  Description of Artificial Sequence: Synthetic polypeptide
  XENP020481 7G8_H0.33_L0_IgG1_PVA_/S267K Light Chain

SEQ ID NO: 23217 - protein, 111 aa, Artificial Sequence; identical to SEQ ID NO: 22267
  Description of Artificial Sequence: Synthetic polypeptide
  VL of XENP020481

SEQ ID NO: 23218 - protein, 15 aa, Artificial Sequence
  Description of Artificial Sequence: Synthetic peptide
  XENP020481 vlCDR1
KASQSVDYDGDSYMN

SEQ ID NO: 23219 - protein, 7 aa, Artificial Sequence
  Description of Artificial Sequence: Synthetic peptide
  XENP020481 vlCDR2
AASNLES

SEQ ID NO: 23220 - protein, 9 aa, Artificial Sequence
  Description of Artificial Sequence: Synthetic peptide
  XENP020481 vlCDR3
QQSNEDPFT

SEQ ID NO: 23221 - protein, 450 aa, Artificial Sequence
  Description of Artificial Sequence: Synthetic polypeptide
  XENP020482 7G8_H0.34_L0_IgG1_PVA_/S267K Heavy Chain
EVKLEESGGGLVQPGGSMKLSCAASGFTFSDAWMDWVRQSPEKGLEWVAEIITKANNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 23222 - protein, 121 aa, Artificial Sequence
  Description of Artificial Sequence: Synthetic polypeptide
  VH of XENP020482
EVKLEESGGGLVQPGGSMKLSCAASGFTFSDAWMDWVRQSPEKGLEWVAEIITKANNHATYYAESVKGRFTISRDDSKSSVYLQMNSLRAEDTGIYYCTRLANWDWYFDVWGAGTTVTVSS

SEQ ID NO: 23223 - protein, 5 aa, Artificial Sequence
  Description of Artificial Sequence: Synthetic peptide
  XENP020482 vhCDR1
DAWMD

SEQ ID NO: 23224 - protein, 19 aa, Artificial Sequence
  Description of Artificial Sequence: Synthetic peptide
  XENP020482 vhCDR2
EIITKANNHATYYAESVKG

SEQ ID NO: 23225 - protein, 10 aa, Artificial Sequence
  Description of Artificial Sequence: Synthetic peptide
  XENP020482 vhCDR3
LANWDWYFDV

SEQ ID NO: 23226 - protein, 218 aa, Artificial Sequence; identical to SEQ ID NO: 22266
  Description of Artificial Sequence: Synthetic polypeptide
  XENP020482 7G8_H0.34_L0_IgG1_PVA_/S267K Light Chain

SEQ ID NO: 23227 - protein, 111 aa, Artificial Sequence; identical to SEQ ID NO: 22267
  Description of Artificial Sequence: Synthetic polypeptide
  VL of XENP020482

SEQ ID NO: 23228 - protein, 15 aa, Artificial Sequence
  Description of Artificial Sequence: Synthetic peptide
  XENP020482 vlCDR1
KASQSVDYDGDSYMN

SEQ ID NO: 23229 - protein, 7 aa, Artificial Sequence
  Description of Artificial Sequence: Synthetic peptide
  XENP020482 vlCDR2
AASNLES

SEQ ID NO: 23230 - protein, 9 aa, Artificial Sequence
  Description of Artificial Sequence: Synthetic peptide
  XENP020482 vlCDR3
QQSNEDPFT

SEQ ID NO: 23231 - protein, 450 aa, Artificial Sequence
  Description of Artificial Sequence: Synthetic polypeptide
  XENP020483 7G8_H0.35_L0_IgG1_PVA_/S267K Heavy Chain
EVKLEESGGGLVQPGGSMKLSCAASGFTFSDAWMDWVRQSPEKGLEWVAEIWTKANNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 23232 - protein, 121 aa, Artificial Sequence
  Description of Artificial Sequence: Synthetic polypeptide
  VH of XENP020483
EVKLEESGGGLVQPGGSMKLSCAASGFTFSDAWMDWVRQSPEKGLEWVAEIWTKANNHATYYAESVKGRFTISRDDSKSSVYLQMNSLRAEDTGIYYCTRLANWDWYFDVWGAGTTVTVSS

SEQ ID NO: 23233 - protein, 5 aa, Artificial Sequence
  Description of Artificial Sequence: Synthetic peptide
  XENP020483 vhCDR1
DAWMD

SEQ ID NO: 23234 - protein, 19 aa, Artificial Sequence
  Description of Artificial Sequence: Synthetic peptide
  XENP020483 vhCDR2
EIWTKANNHATYYAESVKG

SEQ ID NO: 23235 - protein, 10 aa, Artificial Sequence
  Description of Artificial Sequence: Synthetic peptide
  XENP020483 vhCDR3
LANWDWYFDV

SEQ ID NO: 23236 - protein, 218 aa, Artificial Sequence; identical to SEQ ID NO: 22266
  Description of Artificial Sequence: Synthetic polypeptide
  XENP020483 7G8_H0.35_L0_IgG1_PVA_/S267K Light Chain

SEQ ID NO: 23237 - protein, 111 aa, Artificial Sequence; identical to SEQ ID NO: 22267
  Description of Artificial Sequence: Synthetic polypeptide
  VL of XENP020483

SEQ ID NO: 23238 - protein, 15 aa, Artificial Sequence
  Description of Artificial Sequence: Synthetic peptide
  XENP020483 vlCDR1
KASQSVDYDGDSYMN

SEQ ID NO: 23239 - protein, 7 aa, Artificial Sequence
  Description of Artificial Sequence: Synthetic peptide
  XENP020483 vlCDR2
AASNLES

SEQ ID NO: 23240 - protein, 9 aa, Artificial Sequence
  Description of Artificial Sequence: Synthetic peptide
  XENP020483 vlCDR3
QQSNEDPFT

SEQ ID NO: 23241 - protein, 450 aa, Artificial Sequence
  Description of Artificial Sequence: Synthetic polypeptide
  XENP020484 7G8_H0.36_L0_IgG1_PVA_/S267K Heavy Chain
EVKLEESGGGLVQPGGSMKLSCAASGFTFSDAWMDWVRQSPEKGLEWVAEIRVKANNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 23242 - protein, 121 aa, Artificial Sequence
  Description of Artificial Sequence: Synthetic polypeptide
  VH of XENP020484
EVKLEESGGGLVQPGGSMKLSCAASGFTFSDAWMDWVRQSPEKGLEWVAEIRVKANNHATYYAESVKGRFTISRDDSKSSVYLQMNSLRAEDTGIYYCTRLANWDWYFDVWGAGTTVTVSS

SEQ ID NO: 23243 - protein, 5 aa, Artificial Sequence
  Description of Artificial Sequence: Synthetic peptide
  XENP020484 vhCDR1
DAWMD

SEQ ID NO: 23244 - protein, 19 aa, Artificial Sequence
  Description of Artificial Sequence: Synthetic peptide
  XENP020484 vhCDR2
EIRVKANNHATYYAESVKG

SEQ ID NO: 23245 - protein, 10 aa, Artificial Sequence
  Description of Artificial Sequence: Synthetic peptide
  XENP020484 vhCDR3
LANWDWYFDV

SEQ ID NO: 23246 - protein, 218 aa, Artificial Sequence; identical to SEQ ID NO: 22266
  Description of Artificial Sequence: Synthetic polypeptide
  XENP020484 7G8_H0.36_L0_IgG1_PVA_/S267K Light Chain

SEQ ID NO: 23247 - protein, 111 aa, Artificial Sequence; identical to SEQ ID NO: 22267
  Description of Artificial Sequence: Synthetic polypeptide
  VL of XENP020484

SEQ ID NO: 23248 - protein, 15 aa, Artificial Sequence
  Description of Artificial Sequence: Synthetic peptide
  XENP020484 vlCDR1
KASQSVDYDGDSYMN

SEQ ID NO: 23249 - protein, 7 aa, Artificial Sequence
  Description of Artificial Sequence: Synthetic peptide
  XENP020484 vlCDR2
AASNLES

SEQ ID NO: 23250 - protein, 9 aa, Artificial Sequence
  Description of Artificial Sequence: Synthetic peptide
  XENP020484 vlCDR3
QQSNEDPFT

SEQ ID NO: 23251 - protein, 450 aa, Artificial Sequence
  Description of Artificial Sequence: Synthetic polypeptide
  XENP020485 7G8_H0.37_L0_IgG1_PVA_/S267K Heavy Chain
EVKLEESGGGLVQPGGSMKLSCAASGFTFSDAWMDWVRQSPEKGLEWVAEIRSKANNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 23252 - protein, 121 aa, Artificial Sequence
  Description of Artificial Sequence: Synthetic polypeptide
  VH of XENP020485
EVKLEESGGGLVQPGGSMKLSCAASGFTFSDAWMDWVRQSPEKGLEWVAEIRSKANNHATYYAESVKGRFTISRDDSKSSVYLQMNSLRAEDTGIYYCTRLANWDWYFDVWGAGTTVTVSS

SEQ ID NO: 23253 - protein, 5 aa, Artificial Sequence
  Description of Artificial Sequence: Synthetic peptide
  XENP020485 vhCDR1
DAWMD

SEQ ID NO: 23254 - protein, 19 aa, Artificial Sequence
  Description of Artificial Sequence: Synthetic peptide
  XENP020485 vhCDR2
EIRSKANNHATYYAESVKG

SEQ ID NO: 23255 - protein, 10 aa, Artificial Sequence
  Description of Artificial Sequence: Synthetic peptide
  XENP020485 vhCDR3
LANWDWYFDV

SEQ ID NO: 23256 - protein, 218 aa, Artificial Sequence; identical to SEQ ID NO: 22266
  Description of Artificial Sequence: Synthetic polypeptide
  XENP020485 7G8_H0.37_L0_IgG1_PVA_/S267K Light Chain

SEQ ID NO: 23257 - protein, 111 aa, Artificial Sequence; identical to SEQ ID NO: 22267
  Description of Artificial Sequence: Synthetic polypeptide
  VL of XENP020485

SEQ ID NO: 23258 - protein, 15 aa, Artificial Sequence
  Description of Artificial Sequence: Synthetic peptide
  XENP020485 vlCDR1
KASQSVDYDGDSYMN

SEQ ID NO: 23259 - protein, 7 aa, Artificial Sequence
  Description of Artificial Sequence: Synthetic peptide
  XENP020485 vlCDR2
AASNLES

SEQ ID NO: 23260 - protein, 9 aa, Artificial Sequence
  Description of Artificial Sequence: Synthetic peptide
  XENP020485 vlCDR3
QQSNEDPFT

SEQ ID NO: 23261 - protein, 450 aa, Artificial Sequence
  Description of Artificial Sequence: Synthetic polypeptide
  XENP020486 7G8_H0.38_L0_IgG1_PVA_/S267K Heavy Chain
EVKLEESGGGLVQPGGSMKLSCAASGFTFSDAWMDWVRQSPEKGLEWVAEIRAKANNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 23262 - protein, 121 aa, Artificial Sequence
  Description of Artificial Sequence: Synthetic polypeptide
  VH of XENP020486
EVKLEESGGGLVQPGGSMKLSCAASGFTFSDAWMDWVRQSPEKGLEWVAEIRAKANNHATYYAESVKGRFTISRDDSKSSVYLQMNSLRAEDTGIYYCTRLANWDWYFDVWGAGTTVTVSS

SEQ ID NO: 23263 - protein, 5 aa, Artificial Sequence
  Description of Artificial Sequence: Synthetic peptide
  XENP020486 vhCDR1
DAWMD

SEQ ID NO: 23264 - protein, 19 aa, Artificial Sequence
  Description of Artificial Sequence: Synthetic peptide
  XENP020486 vhCDR2
EIRAKANNHATYYAESVKG

SEQ ID NO: 23265 - protein, 10 aa, Artificial Sequence
  Description of Artificial Sequence: Synthetic peptide
  XENP020486 vhCDR3
LANWDWYFDV

SEQ ID NO: 23266 - protein, 218 aa, Artificial Sequence; identical to SEQ ID NO: 22266
  Description of Artificial Sequence: Synthetic polypeptide
  XENP020486 7G8_H0.38_L0_IgG1_PVA_/S267K Light Chain

SEQ ID NO: 23267 - protein, 111 aa, Artificial Sequence; identical to SEQ ID NO: 22267
  Description of Artificial Sequence: Synthetic polypeptide
  VL of XENP020486

SEQ ID NO: 23268 - protein, 15 aa, Artificial Sequence
  Description of Artificial Sequence: Synthetic peptide
  XENP020486 vlCDR1
KASQSVDYDGDSYMN

SEQ ID NO: 23269 - protein, 7 aa, Artificial Sequence
  Description of Artificial Sequence: Synthetic peptide
  XENP020486 vlCDR2
AASNLES

SEQ ID NO: 23270 - protein, 9 aa, Artificial Sequence
  Description of Artificial Sequence: Synthetic peptide
  XENP020486 vlCDR3
QQSNEDPFT

SEQ ID NO: 23271 - protein, 450 aa, Artificial Sequence
  Description of Artificial Sequence: Synthetic polypeptide
  XENP020487 7G8_H0.39_L0_IgG1_PVA_/S267K Heavy Chain
EVKLEESGGGLVQPGGSMKLSCAASGFTFSDAWMDWVRQSPEKGLEWVAEIRIKANNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 23272 - protein, 121 aa, Artificial Sequence
  Description of Artificial Sequence: Synthetic polypeptide
  VH of XENP020487
EVKLEESGGGLVQPGGSMKLSCAASGFTFSDAWMDWVRQSPEKGLEWVAEIRIKANNHATYYAESVKGRFTISRDDSKSSVYLQMNSLRAEDTGIYYCTRLANWDWYFDVWGAGTTVTVSS

SEQ ID NO: 23273 - protein, 5 aa, Artificial Sequence
  Description of Artificial Sequence: Synthetic peptide
  XENP020487 vhCDR1
DAWMD

SEQ ID NO: 23274 - protein, 19 aa, Artificial Sequence
  Description of Artificial Sequence: Synthetic peptide
  XENP020487 vhCDR2
EIRIKANNHATYYAESVKG

SEQ ID NO: 23275 - protein, 10 aa, Artificial Sequence
  Description of Artificial Sequence: Synthetic peptide
  XENP020487 vhCDR3
LANWDWYFDV

SEQ ID NO: 23276 - protein, 218 aa, Artificial Sequence; identical to SEQ ID NO: 22266
  Description of Artificial Sequence: Synthetic polypeptide
  XENP020487 7G8_H0.39_L0_IgG1_PVA_/S267K Light Chain

SEQ ID NO: 23277 - protein, 111 aa, Artificial Sequence; identical to SEQ ID NO: 22267
  Description of Artificial Sequence: Synthetic polypeptide
  VL of XENP020487

SEQ ID NO: 23278 - protein, 15 aa, Artificial Sequence
  Description of Artificial Sequence: Synthetic peptide
  XENP020487 vlCDR1
KASQSVDYDGDSYMN

SEQ ID NO: 23279 - protein, 7 aa, Artificial Sequence
  Description of Artificial Sequence: Synthetic peptide
  XENP020487 vlCDR2
AASNLES

SEQ ID NO: 23280 - protein, 9 aa, Artificial Sequence
  Description of Artificial Sequence: Synthetic peptide
  XENP020487 vlCDR3
QQSNEDPFT

SEQ ID NO: 23281 - protein, 450 aa, Artificial Sequence
  Description of Artificial Sequence: Synthetic polypeptide
  XENP020488 7G8_H0.40_L0_IgG1_PVA_/S267K Heavy Chain
EVKLEESGGGLVQPGGSMKLSCAASGFTFSDAWMDWVRQSPEKGLEWVAEIRQKANNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 23282 - protein, 121 aa, Artificial Sequence
  Description of Artificial Sequence: Synthetic polypeptide
  VH of XENP020488
EVKLEESGGGLVQPGGSMKLSCAASGFTFSDAWMDWVRQSPEKGLEWVAEIRQKANNHATYYAESVKGRFTISRDDSKSSVYLQMNSLRAEDTGIYYCTRLANWDWYFDVWGAGTTVTVSS

SEQ ID NO: 23283 - protein, 5 aa, Artificial Sequence
  Description of Artificial Sequence: Synthetic peptide
  XENP020488 vhCDR1
DAWMD

SEQ ID NO: 23284 - protein, 19 aa, Artificial Sequence
  Description of Artificial Sequence: Synthetic peptide
  XENP020488 vhCDR2
EIRQKANNHATYYAESVKG

SEQ ID NO: 23285 - protein, 10 aa, Artificial Sequence
  Description of Artificial Sequence: Synthetic peptide
  XENP020488 vhCDR3
LANWDWYFDV

SEQ ID NO: 23286 - protein, 218 aa, Artificial Sequence; identical to SEQ ID NO: 22266
  Description of Artificial Sequence: Synthetic polypeptide
  XENP020488 7G8_H0.40_L0_IgG1_PVA_/S267K Light Chain

SEQ ID NO: 23287 - protein, 111 aa, Artificial Sequence; identical to SEQ ID NO: 22267
  Description of Artificial Sequence: Synthetic polypeptide
  VL of XENP020488

SEQ ID NO: 23288 - protein, 15 aa, Artificial Sequence
  Description of Artificial Sequence: Synthetic peptide
  XENP020488 vlCDR1
KASQSVDYDGDSYMN

SEQ ID NO: 23289 - protein, 7 aa, Artificial Sequence
  Description of Artificial Sequence: Synthetic peptide
  XENP020488 vlCDR2
AASNLES

SEQ ID NO: 23290 - protein, 9 aa, Artificial Sequence
  Description of Artificial Sequence: Synthetic peptide
  XENP020488 vlCDR3
QQSNEDPFT

SEQ ID NO: 23291 - protein, 450 aa, Artificial Sequence
  Description of Artificial Sequence: Synthetic polypeptide
  XENP020489 7G8_H0.41_L0_IgG1_PVA_/S267K Heavy Chain
EVKLEESGGGLVQPGGSMKLSCAASGFTFSDAWMDWVRQSPEKGLEWVAEIRHKANNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 23292 - protein, 121 aa, Artificial Sequence
  Description of Artificial Sequence: Synthetic polypeptide
  VH of XENP020489
EVKLEESGGGLVQPGGSMKLSCAASGFTFSDAWMDWVRQSPEKGLEWVAEIRHKANNHATYYAESVKGRFTISRDDSKSSVYLQMNSLRAEDTGIYYCTRLANWDWYFDVWGAGTTVTVSS

SEQ ID NO: 23293 - protein, 5 aa, Artificial Sequence
  Description of Artificial Sequence: Synthetic peptide
  XENP020489 vhCDR1
DAWMD

SEQ ID NO: 23294 - protein, 19 aa, Artificial Sequence
  Description of Artificial Sequence: Synthetic peptide
  XENP020489 vhCDR2
EIRHKANNHATYYAESVKG

SEQ ID NO: 23295 - protein, 10 aa, Artificial Sequence
  Description of Artificial Sequence: Synthetic peptide
  XENP020489 vhCDR3
LANWDWYFDV

SEQ ID NO: 23296 - protein, 218 aa, Artificial Sequence; identical to SEQ ID NO: 22266
  Description of Artificial Sequence: Synthetic polypeptide
  XENP020489 7G8_H0.41_L0_IgG1_PVA_/S267K Light Chain

SEQ ID NO: 23297 - protein, 111 aa, Artificial Sequence; identical to SEQ ID NO: 22267
  Description of Artificial Sequence: Synthetic polypeptide
  VL of XENP020489

SEQ ID NO: 23298 - protein, 15 aa, Artificial Sequence
  Description of Artificial Sequence: Synthetic peptide
  XENP020489 vlCDR1
KASQSVDYDGDSYMN

SEQ ID NO: 23299 - protein, 7 aa, Artificial Sequence
  Description of Artificial Sequence: Synthetic peptide
  XENP020489 vlCDR2
AASNLES

SEQ ID NO: 23300 - protein, 9 aa, Artificial Sequence
  Description of Artificial Sequence: Synthetic peptide
  XENP020489 vlCDR3
QQSNEDPFT

SEQ ID NO: 23301 - protein, 450 aa, Artificial Sequence
  Description of Artificial Sequence: Synthetic polypeptide
  XENP020490 7G8_H0.42_L0_IgG1_PVA_/S267K Heavy Chain
EVKLEESGGGLVQPGGSMKLSCAASGFTFSDAWMDWVRQSPEKGLEWVAEIRDKANNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 23302 - protein, 121 aa, Artificial Sequence
  Description of Artificial Sequence: Synthetic polypeptide
  VH of XENP020490
EVKLEESGGGLVQPGGSMKLSCAASGFTFSDAWMDWVRQSPEKGLEWVAEIRDKANNHATYYAESVKGRFTISRDDSKSSVYLQMNSLRAEDTGIYYCTRLANWDWYFDVWGAGTTVTVSS

SEQ ID NO: 23303 - protein, 5 aa, Artificial Sequence
  Description of Artificial Sequence: Synthetic peptide
  XENP020490 vhCDR1
DAWMD

SEQ ID NO: 23304 - protein, 19 aa, Artificial Sequence
  Description of Artificial Sequence: Synthetic peptide
  XENP020490 vhCDR2
EIRDKANNHATYYAESVKG

SEQ ID NO: 23305 - protein, 10 aa, Artificial Sequence
  Description of Artificial Sequence: Synthetic peptide
  XENP020490 vhCDR3
LANWDWYFDV

SEQ ID NO: 23306 - protein, 218 aa, Artificial Sequence; identical to SEQ ID NO: 22266
  Description of Artificial Sequence: Synthetic polypeptide
  XENP020490 7G8_H0.42_L0_IgG1_PVA_/S267K Light Chain

SEQ ID NO: 23307 - protein, 111 aa, Artificial Sequence; identical to SEQ ID NO: 22267
  Description of Artificial Sequence: Synthetic polypeptide
  VL of XENP020490

SEQ ID NO: 23308 - protein, 15 aa, Artificial Sequence
  Description of Artificial Sequence: Synthetic peptide
  XENP020490 vlCDR1
KASQSVDYDGDSYMN

SEQ ID NO: 23309 - protein, 7 aa, Artificial Sequence
  Description of Artificial Sequence: Synthetic peptide
  XENP020490 vlCDR2
AASNLES

SEQ ID NO: 23310 - protein, 9 aa, Artificial Sequence
  Description of Artificial Sequence: Synthetic peptide
  XENP020490 vlCDR3
QQSNEDPFT

SEQ ID NO: 23311 - protein, 450 aa, Artificial Sequence
  Description of Artificial Sequence: Synthetic polypeptide
  XENP020491 7G8_H0.43_L0_IgG1_PVA_/S267K Heavy Chain
EVKLEESGGGLVQPGGSMKLSCAASGFTFSDAWMDWVRQSPEKGLEWVAEIRKKANNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 23312 - protein, 121 aa, Artificial Sequence
  Description of Artificial Sequence: Synthetic polypeptide
  VH of XENP020491
EVKLEESGGGLVQPGGSMKLSCAASGFTFSDAWMDWVRQSPEKGLEWVAEIRKKANNHATYYAESVKGRFTISRDDSKSSVYLQMNSLRAEDTGIYYCTRLANWDWYFDVWGAGTTVTVSS

SEQ ID NO: 23313 - protein, 5 aa, Artificial Sequence
  Description of Artificial Sequence: Synthetic peptide
  XENP020491 vhCDR1
DAWMD

SEQ ID NO: 23314 - protein, 19 aa, Artificial Sequence
  Description of Artificial Sequence: Synthetic peptide
  XENP020491 vhCDR2
EIRKKANNHATYYAESVKG

SEQ ID NO: 23315 - protein, 10 aa, Artificial Sequence
  Description of Artificial Sequence: Synthetic peptide
  XENP020491 vhCDR3
LANWDWYFDV

SEQ ID NO: 23316 - protein, 218 aa, Artificial Sequence; identical to SEQ ID NO: 22266
  Description of Artificial Sequence: Synthetic polypeptide
  XENP020491 7G8_H0.43_L0_IgG1_PVA_/S267K Light Chain

SEQ ID NO: 23317 - protein, 111 aa, Artificial Sequence; identical to SEQ ID NO: 22267
  Description of Artificial Sequence: Synthetic polypeptide
  VL of XENP020491

SEQ ID NO: 23318 - protein, 15 aa, Artificial Sequence
  Description of Artificial Sequence: Synthetic peptide
  XENP020491 vlCDR1
KASQSVDYDGDSYMN

SEQ ID NO: 23319 - protein, 7 aa, Artificial Sequence
  Description of Artificial Sequence: Synthetic peptide
  XENP020491 vlCDR2
AASNLES

SEQ ID NO: 23320 - protein, 9 aa, Artificial Sequence
  Description of Artificial Sequence: Synthetic peptide
  XENP020491 vlCDR3
QQSNEDPFT

SEQ ID NO: 23321 - protein, 450 aa, Artificial Sequence
  Description of Artificial Sequence: Synthetic polypeptide
  XENP020492 7G8_H0.44_L0_IgG1_PVA_/S267K Heavy Chain
EVKLEESGGGLVQPGGSMKLSCAASGFTFSDAWMDWVRQSPEKGLEWVAEIRYKANNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 23322 - protein, 121 aa, Artificial Sequence
  Description of Artificial Sequence: Synthetic polypeptide
  VH of XENP020492
EVKLEESGGGLVQPGGSMKLSCAASGFTFSDAWMDWVRQSPEKGLEWVAEIRYKANNHATYYAESVKGRFTISRDDSKSSVYLQMNSLRAEDTGIYYCTRLANWDWYFDVWGAGTTVTVSS

SEQ ID NO: 23323 - protein, 5 aa, Artificial Sequence
  Description of Artificial Sequence: Synthetic peptide
  XENP020492 vhCDR1
DAWMD

SEQ ID NO: 23324 - protein, 19 aa, Artificial Sequence
  Description of Artificial Sequence: Synthetic peptide
  XENP020492 vhCDR2
EIRYKANNHATYYAESVKG

SEQ ID NO: 23325 - protein, 10 aa, Artificial Sequence
  Description of Artificial Sequence: Synthetic peptide
  XENP020492 vhCDR3
LANWDWYFDV

SEQ ID NO: 23326 - protein, 218 aa, Artificial Sequence; identical to SEQ ID NO: 22266
  Description of Artificial Sequence: Synthetic polypeptide
  XENP020492 7G8_H0.44_L0_IgG1_PVA_/S267K Light Chain

SEQ ID NO: 23327 - protein, 111 aa, Artificial Sequence; identical to SEQ ID NO: 22267
  Description of Artificial Sequence: Synthetic polypeptide
  VL of XENP020492

SEQ ID NO: 23328 - protein, 15 aa, Artificial Sequence
  Description of Artificial Sequence: Synthetic peptide
  XENP020492 vlCDR1
KASQSVDYDGDSYMN

SEQ ID NO: 23329 - protein, 7 aa, Artificial Sequence
  Description of Artificial Sequence: Synthetic peptide
  XENP020492 vlCDR2
AASNLES

SEQ ID NO: 23330 - protein, 9 aa, Artificial Sequence
  Description of Artificial Sequence: Synthetic peptide
  XENP020492 vlCDR3
QQSNEDPFT

SEQ ID NO: 23331 - protein, 450 aa, Artificial Sequence
  Description of Artificial Sequence: Synthetic polypeptide
  XENP020493 7G8_H0.45_L0_IgG1_PVA_/S267K Heavy Chain
EVKLEESGGGLVQPGGSMKLSCAASGFTFSDAWMDWVRQSPEKGLEWVAEIRTRANNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 23332 - protein, 121 aa, Artificial Sequence
  Description of Artificial Sequence: Synthetic polypeptide
  VH of XENP020493
EVKLEESGGGLVQPGGSMKLSCAASGFTFSDAWMDWVRQSPEKGLEWVAEIRTRANNHATYYAESVKGRFTISRDDSKSSVYLQMNSLRAEDTGIYYCTRLANWDWYFDVWGAGTTVTVSS

SEQ ID NO: 23333 - protein, 5 aa, Artificial Sequence
  Description of Artificial Sequence: Synthetic peptide
  XENP020493 vhCDR1
DAWMD

SEQ ID NO: 23334 - protein, 19 aa, Artificial Sequence
  Description of Artificial Sequence: Synthetic peptide
  XENP020493 vhCDR2
EIRTRANNHATYYAESVKG

SEQ ID NO: 23335 - protein, 10 aa, Artificial Sequence
  Description of Artificial Sequence: Synthetic peptide
  XENP020493 vhCDR3
LANWDWYFDV

SEQ ID NO: 23336 - protein, 218 aa, Artificial Sequence; identical to SEQ ID NO: 22266
  Description of Artificial Sequence: Synthetic polypeptide
  XENP020493 7G8_H0.45_L0_IgG1_PVA_/S267K Light Chain

SEQ ID NO: 23337 - protein, 111 aa, Artificial Sequence; identical to SEQ ID NO: 22267
  Description of Artificial Sequence: Synthetic polypeptide
  VL of XENP020493

SEQ ID NO: 23338 - protein, 15 aa, Artificial Sequence
  Description of Artificial Sequence: Synthetic peptide
  XENP020493 vlCDR1
KASQSVDYDGDSYMN

SEQ ID NO: 23339 - protein, 7 aa, Artificial Sequence
  Description of Artificial Sequence: Synthetic peptide
  XENP020493 vlCDR2
AASNLES

SEQ ID NO: 23340 - protein, 9 aa, Artificial Sequence
  Description of Artificial Sequence: Synthetic peptide
  XENP020493 vlCDR3
QQSNEDPFT

SEQ ID NO: 23341 - protein, 450 aa, Artificial Sequence
  Description of Artificial Sequence: Synthetic polypeptide
  XENP020494 7G8_H0.46_L0_IgG1_PVA_/S267K Heavy Chain
EVKLEESGGGLVQPGGSMKLSCAASGFTFSDAWMDWVRQSPEKGLEWVAEIRTEANNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 23342 - protein, 121 aa, Artificial Sequence
  Description of Artificial Sequence: Synthetic polypeptide
  VH of XENP020494
EVKLEESGGGLVQPGGSMKLSCAASGFTFSDAWMDWVRQSPEKGLEWVAEIRTEANNHATYYAESVKGRFTISRDDSKSSVYLQMNSLRAEDTGIYYCTRLANWDWYFDVWGAGTTVTVSS

SEQ ID NO: 23343 - protein, 5 aa, Artificial Sequence
  Description of Artificial Sequence: Synthetic peptide
  XENP020494 vhCDR1
DAWMD

SEQ ID NO: 23344 - protein, 19 aa, Artificial Sequence
  Description of Artificial Sequence: Synthetic peptide
  XENP020494 vhCDR2
EIRTEANNHATYYAESVKG

SEQ ID NO: 23345 - protein, 10 aa, Artificial Sequence
  Description of Artificial Sequence: Synthetic peptide
  XENP020494 vhCDR3
LANWDWYFDV

SEQ ID NO: 23346 - protein, 218 aa, Artificial Sequence; identical to SEQ ID NO: 22266
  Description of Artificial Sequence: Synthetic polypeptide
  XENP020494 7G8_H0.46_L0_IgG1_PVA_/S267K Light Chain

SEQ ID NO: 23347 - protein, 111 aa, Artificial Sequence; identical to SEQ ID NO: 22267
  Description of Artificial Sequence: Synthetic polypeptide
  VL of XENP020494

SEQ ID NO: 23348 - protein, 15 aa, Artificial Sequence
  Description of Artificial Sequence: Synthetic peptide
  XENP020494 vlCDR1
KASQSVDYDGDSYMN

SEQ ID NO: 23349 - protein, 7 aa, Artificial Sequence
  Description of Artificial Sequence: Synthetic peptide
  XENP020494 vlCDR2
AASNLES

SEQ ID NO: 23350 - protein, 9 aa, Artificial Sequence
  Description of Artificial Sequence: Synthetic peptide
  XENP020494 vlCDR3
QQSNEDPFT

SEQ ID NO: 23351 - protein, 450 aa, Artificial Sequence
  Description of Artificial Sequence: Synthetic polypeptide
  XENP020495 7G8_H0.47_L0_IgG1_PVA_/S267K Heavy Chain
EVKLEESGGGLVQPGGSMKLSCAASGFTFSDAWMDWVRQSPEKGLEWVAEIRTHANNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 23352 - protein, 121 aa, Artificial Sequence
  Description of Artificial Sequence: Synthetic polypeptide
  VH of XENP020495
EVKLEESGGGLVQPGGSMKLSCAASGFTFSDAWMDWVRQSPEKGLEWVAEIRTHANNHATYYAESVKGRFTISRDDSKSSVYLQMNSLRAEDTGIYYCTRLANWDWYFDVWGAGTTVTVSS

SEQ ID NO: 23353 - protein, 5 aa, Artificial Sequence
  Description of Artificial Sequence: Synthetic peptide
  XENP020495 vhCDR1
DAWMD

SEQ ID NO: 23354 - protein, 19 aa, Artificial Sequence
  Description of Artificial Sequence: Synthetic peptide
  XENP020495 vhCDR2
EIRTHANNHATYYAESVKG

SEQ ID NO: 23355 - protein, 10 aa, Artificial Sequence
  Description of Artificial Sequence: Synthetic peptide
  XENP020495 vhCDR3
LANWDWYFDV

SEQ ID NO: 23356 - protein, 218 aa, Artificial Sequence; identical to SEQ ID NO: 22266
  Description of Artificial Sequence: Synthetic polypeptide
  XENP020495 7G8_H0.47_L0_IgG1_PVA_/S267K Light Chain

SEQ ID NO: 23357 - protein, 111 aa, Artificial Sequence; identical to SEQ ID NO: 22267
  Description of Artificial Sequence: Synthetic polypeptide
  VL of XENP020495

SEQ ID NO: 23358 - protein, 15 aa, Artificial Sequence
  Description of Artificial Sequence: Synthetic peptide
  XENP020495 vlCDR1
KASQSVDYDGDSYMN

SEQ ID NO: 23359 - protein, 7 aa, Artificial Sequence
  Description of Artificial Sequence: Synthetic peptide
  XENP020495 vlCDR2
AASNLES

SEQ ID NO: 23360 - protein, 9 aa, Artificial Sequence
  Description of Artificial Sequence: Synthetic peptide
  XENP020495 vlCDR3
QQSNEDPFT

SEQ ID NO: 23361 - protein, 450 aa, Artificial Sequence
  Description of Artificial Sequence: Synthetic polypeptide
  XENP020496 7G8_H0.48_L0_IgG1_PVA_/S267K Heavy Chain
EVKLEESGGGLVQPGGSMKLSCAASGFTFSDAWMDWVRQSPEKGLEWVAEIRTSANNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 23362 - protein, 121 aa, Artificial Sequence
  Description of Artificial Sequence: Synthetic polypeptide
  VH of XENP020496
EVKLEESGGGLVQPGGSMKLSCAASGFTFSDAWMDWVRQSPEKGLEWVAEIRTSANNHATYYAESVKGRFTISRDDSKSSVYLQMNSLRAEDTGIYYCTRLANWDWYFDVWGAGTTVTVSS

SEQ ID NO: 23363 - protein, 5 aa, Artificial Sequence
  Description of Artificial Sequence: Synthetic peptide
  XENP020496 vhCDR1
DAWMD

SEQ ID NO: 23364 - protein, 19 aa, Artificial Sequence
  Description of Artificial Sequence: Synthetic peptide
  XENP020496 vhCDR2
EIRTSANNHATYYAESVKG

SEQ ID NO: 23365 - protein, 10 aa, Artificial Sequence
  Description of Artificial Sequence: Synthetic peptide
  XENP020496 vhCDR3
LANWDWYFDV

SEQ ID NO: 23366 - protein, 218 aa, Artificial Sequence; identical to SEQ ID NO: 22266
  Description of Artificial Sequence: Synthetic polypeptide
  XENP020496 7G8_H0.48_L0_IgG1_PVA_/S267K Light Chain

SEQ ID NO: 23367 - protein, 111 aa, Artificial Sequence; identical to SEQ ID NO: 22267
  Description of Artificial Sequence: Synthetic polypeptide
  VL of XENP020496

SEQ ID NO: 23368 - protein, 15 aa, Artificial Sequence
  Description of Artificial Sequence: Synthetic peptide
  XENP020496 vlCDR1
KASQSVDYDGDSYMN

SEQ ID NO: 23369 - protein, 7 aa, Artificial Sequence
  Description of Artificial Sequence: Synthetic peptide
  XENP020496 vlCDR2
AASNLES

SEQ ID NO: 23370 - protein, 9 aa, Artificial Sequence
  Description of Artificial Sequence: Synthetic peptide
  XENP020496 vlCDR3
QQSNEDPFT

SEQ ID NO: 23371 - protein, 450 aa, Artificial Sequence
  Description of Artificial Sequence: Synthetic polypeptide
  XENP020501 7G8_H0.49_L0_IgG1_PVA_/S267K Heavy Chain
EVKLEESGGGLVQPGGSMKLSCAASGFTFSDAWMDWVRQSPEKGLEWVAEIRTDANNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 23372 - protein, 121 aa, Artificial Sequence
  Description of Artificial Sequence: Synthetic polypeptide
  VH of XENP020501
EVKLEESGGGLVQPGGSMKLSCAASGFTFSDAWMDWVRQSPEKGLEWVAEIRTDANNHATYYAESVKGRFTISRDDSKSSVYLQMNSLRAEDTGIYYCTRLANWDWYFDVWGAGTTVTVSS

SEQ ID NO: 23373 - protein, 5 aa, Artificial Sequence
  Description of Artificial Sequence: Synthetic peptide
  XENP020501 vhCDR1
DAWMD

SEQ ID NO: 23374 - protein, 19 aa, Artificial Sequence
  Description of Artificial Sequence: Synthetic peptide
  XENP020501 vhCDR2
EIRTDANNHATYYAESVKG

SEQ ID NO: 23375 - protein, 10 aa, Artificial Sequence
  Description of Artificial Sequence: Synthetic peptide
  XENP020501 vhCDR3
LANWDWYFDV

SEQ ID NO: 23376 - protein, 218 aa, Artificial Sequence; identical to SEQ ID NO: 22266
  Description of Artificial Sequence: Synthetic polypeptide
  XENP020501 7G8_H0.49_L0_IgG1_PVA_/S267K Light Chain

SEQ ID NO: 23377 - protein, 111 aa, Artificial Sequence; identical to SEQ ID NO: 22267
  Description of Artificial Sequence: Synthetic polypeptide
  VL of XENP020501

SEQ ID NO: 23378 - protein, 15 aa, Artificial Sequence
  Description of Artificial Sequence: Synthetic peptide
  XENP020501 vlCDR1
KASQSVDYDGDSYMN

SEQ ID NO: 23379 - protein, 7 aa, Artificial Sequence
  Description of Artificial Sequence: Synthetic peptide
  XENP020501 vlCDR2
AASNLES

SEQ ID NO: 23380 - protein, 9 aa, Artificial Sequence
  Description of Artificial Sequence: Synthetic peptide
  XENP020501 vlCDR3
QQSNEDPFT

SEQ ID NO: 23381 - protein, 450 aa, Artificial Sequence
  Description of Artificial Sequence: Synthetic polypeptide
  XENP020502 7G8_H0.50_L0_IgG1_PVA_/S267K Heavy Chain
EVKLEESGGGLVQPGGSMKLSCAASGFTFSDAWMDWVRQSPEKGLEWVAEIRTAANNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 23382 - protein, 121 aa, Artificial Sequence
  Description of Artificial Sequence: Synthetic polypeptide
  VH of XENP020502
EVKLEESGGGLVQPGGSMKLSCAASGFTFSDAWMDWVRQSPEKGLEWVAEIRTAANNHATYYAESVKGRFTISRDDSKSSVYLQMNSLRAEDTGIYYCTRLANWDWYFDVWGAGTTVTVSS

SEQ ID NO: 23383 - protein, 5 aa, Artificial Sequence
  Description of Artificial Sequence: Synthetic peptide
  XENP020502 vhCDR1
DAWMD

SEQ ID NO: 23384 - protein, 19 aa, Artificial Sequence
  Description of Artificial Sequence: Synthetic peptide
  XENP020502 vhCDR2
EIRTAANNHATYYAESVKG

SEQ ID NO: 23385 - protein, 10 aa, Artificial Sequence
  Description of Artificial Sequence: Synthetic peptide
  XENP020502 vhCDR3
LANWDWYFDV

SEQ ID NO: 23386 - protein, 218 aa, Artificial Sequence; identical to SEQ ID NO: 22266
  Description of Artificial Sequence: Synthetic polypeptide
  XENP020502 7G8_H0.50_L0_IgG1_PVA_/S267K Light Chain

SEQ ID NO: 23387 - protein, 111 aa, Artificial Sequence; identical to SEQ ID NO: 22267
  Description of Artificial Sequence: Synthetic polypeptide
  VL of XENP020502

SEQ ID NO: 23388 - protein, 15 aa, Artificial Sequence
  Description of Artificial Sequence: Synthetic peptide
  XENP020502 vlCDR1
KASQSVDYDGDSYMN

SEQ ID NO: 23389 - protein, 7 aa, Artificial Sequence
  Description of Artificial Sequence: Synthetic peptide
  XENP020502 vlCDR2
AASNLES

SEQ ID NO: 23390 - protein, 9 aa, Artificial Sequence
  Description of Artificial Sequence: Synthetic peptide
  XENP020502 vlCDR3
QQSNEDPFT

SEQ ID NO: 23391 - protein, 450 aa, Artificial Sequence
  Description of Artificial Sequence: Synthetic polypeptide
  XENP020503 7G8_H0.51_L0_IgG1_PVA_/S267K Heavy Chain
EVKLEESGGGLVQPGGSMKLSCAASGFTFSDAWMDWVRQSPEKGLEWVAEIRTGANNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 23392 - protein, 121 aa, Artificial Sequence
  Description of Artificial Sequence: Synthetic polypeptide
  VH of XENP020503
EVKLEESGGGLVQPGGSMKLSCAASGFTFSDAWMDWVRQSPEKGLEWVAEIRTGANNHATYYAESVKGRFTISRDDSKSSVYLQMNSLRAEDTGIYYCTRLANWDWYFDVWGAGTTVTVSS

SEQ ID NO: 23393 - protein, 5 aa, Artificial Sequence
  Description of Artificial Sequence: Synthetic peptide
  XENP020503 vhCDR1
DAWMD

SEQ ID NO: 23394 - protein, 19 aa, Artificial Sequence
  Description of Artificial Sequence: Synthetic peptide
  XENP020503 vhCDR2
EIRTGANNHATYYAESVKG

SEQ ID NO: 23395 - protein, 10 aa, Artificial Sequence
  Description of Artificial Sequence: Synthetic peptide
  XENP020503 vhCDR3
LANWDWYFDV

SEQ ID NO: 23396 - protein, 218 aa, Artificial Sequence; identical to SEQ ID NO: 22266
  Description of Artificial Sequence: Synthetic polypeptide
  XENP020503 7G8_H0.51_L0_IgG1_PVA_/S267K Light Chain

SEQ ID NO: 23397 - protein, 111 aa, Artificial Sequence; identical to SEQ ID NO: 22267
  Description of Artificial Sequence: Synthetic polypeptide
  VL of XENP020503

SEQ ID NO: 23398 - protein, 15 aa, Artificial Sequence
  Description of Artificial Sequence: Synthetic peptide
  XENP020503 vlCDR1
KASQSVDYDGDSYMN

SEQ ID NO: 23399 - protein, 7 aa, Artificial Sequence
  Description of Artificial Sequence: Synthetic peptide
  XENP020503 vlCDR2
AASNLES

SEQ ID NO: 23400 - protein, 9 aa, Artificial Sequence
  Description of Artificial Sequence: Synthetic peptide
  XENP020503 vlCDR3
QQSNEDPFT

SEQ ID NO: 23401 - protein, 450 aa, Artificial Sequence
  Description of Artificial Sequence: Synthetic polypeptide
  XENP020504 7G8_H0.52_L0_IgG1_PVA_/S267K Heavy Chain
EVKLEESGGGLVQPGGSMKLSCAASGFTFSDAWMDWVRQSPEKGLEWVAEIRTYANNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 23402 - protein, 121 aa, Artificial Sequence
  Description of Artificial Sequence: Synthetic polypeptide
  VH of XENP020504
EVKLEESGGGLVQPGGSMKLSCAASGFTFSDAWMDWVRQSPEKGLEWVAEIRTYANNHATYYAESVKGRFTISRDDSKSSVYLQMNSLRAEDTGIYYCTRLANWDWYFDVWGAGTTVTVSS

SEQ ID NO: 23403 - protein, 5 aa, Artificial Sequence
  Description of Artificial Sequence: Synthetic peptide
  XENP020504 vhCDR1
DAWMD

SEQ ID NO: 23404 - protein, 19 aa, Artificial Sequence
  Description of Artificial Sequence: Synthetic peptide
  XENP020504 vhCDR2
EIRTYANNHATYYAESVKG

SEQ ID NO: 23405 - protein, 10 aa, Artificial Sequence
  Description of Artificial Sequence: Synthetic peptide
  XENP020504 vhCDR3
LANWDWYFDV

SEQ ID NO: 23406 - protein, 218 aa, Artificial Sequence; identical to SEQ ID NO: 22266
  Description of Artificial Sequence: Synthetic polypeptide
  XENP020504 7G8_H0.52_L0_IgG1_PVA_/S267K Light Chain

SEQ ID NO: 23407 - protein, 111 aa, Artificial Sequence; identical to SEQ ID NO: 22267
  Description of Artificial Sequence: Synthetic polypeptide
  VL of XENP020504

SEQ ID NO: 23408 - protein, 15 aa, Artificial Sequence
  Description of Artificial Sequence: Synthetic peptide
  XENP020504 vlCDR1
KASQSVDYDGDSYMN

SEQ ID NO: 23409 - protein, 7 aa, Artificial Sequence
  Description of Artificial Sequence: Synthetic peptide
  XENP020504 vlCDR2
AASNLES

SEQ ID NO: 23410 - protein, 9 aa, Artificial Sequence
  Description of Artificial Sequence: Synthetic peptide
  XENP020504 vlCDR3
QQSNEDPFT

SEQ ID NO: 23411 - protein, 450 aa, Artificial Sequence
  Description of Artificial Sequence: Synthetic polypeptide
  XENP020505 7G8_H0.53_L0_IgG1_PVA_/S267K Heavy Chain
EVKLEESGGGLVQPGGSMKLSCAASGFTFSDAWMDWVRQSPEKGLEWVAEIRTIANNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 23412 - protein, 121 aa, Artificial Sequence
  Description of Artificial Sequence: Synthetic polypeptide
  VH of XENP020505
EVKLEESGGGLVQPGGSMKLSCAASGFTFSDAWMDWVRQSPEKGLEWVAEIRTIANNHATYYAESVKGRFTISRDDSKSSVYLQMNSLRAEDTGIYYCTRLANWDWYFDVWGAGTTVTVSS

SEQ ID NO: 23413 - protein, 5 aa, Artificial Sequence
  Description of Artificial Sequence: Synthetic peptide
  XENP020505 vhCDR1
DAWMD

SEQ ID NO: 23414 - protein, 19 aa, Artificial Sequence
  Description of Artificial Sequence: Synthetic peptide
  XENP020505 vhCDR2
EIRTIANNHATYYAESVKG

SEQ ID NO: 23415 - protein, 10 aa, Artificial Sequence
  Description of Artificial Sequence: Synthetic peptide
  XENP020505 vhCDR3
LANWDWYFDV

SEQ ID NO: 23416 - protein, 218 aa, Artificial Sequence; identical to SEQ ID NO: 22266
  Description of Artificial Sequence: Synthetic polypeptide
  XENP020505 7G8_H0.53_L0_IgG1_PVA_/S267K Light Chain

SEQ ID NO: 23417 - protein, 111 aa, Artificial Sequence; identical to SEQ ID NO: 22267
  Description of Artificial Sequence: Synthetic polypeptide
  VL of XENP020505

SEQ ID NO: 23418 - protein, 15 aa, Artificial Sequence
  Description of Artificial Sequence: Synthetic peptide
  XENP020505 vlCDR1
KASQSVDYDGDSYMN

SEQ ID NO: 23419 - protein, 7 aa, Artificial Sequence
  Description of Artificial Sequence: Synthetic peptide
  XENP020505 vlCDR2
AASNLES

SEQ ID NO: 23420 - protein, 9 aa, Artificial Sequence
  Description of Artificial Sequence: Synthetic peptide
  XENP020505 vlCDR3
QQSNEDPFT

SEQ ID NO: 23421 - protein, 450 aa, Artificial Sequence
  Description of Artificial Sequence: Synthetic polypeptide
  XENP020506 7G8_H0.54_L0_IgG1_PVA_/S267K Heavy Chain
EVKLEESGGGLVQPGGSMKLSCAASGFTFSDAWMDWVRQSPEKGLEWVAEIRTKSNNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 23422 - protein, 121 aa, Artificial Sequence
  Description of Artificial Sequence: Synthetic polypeptide
  VH of XENP020506
EVKLEESGGGLVQPGGSMKLSCAASGFTFSDAWMDWVRQSPEKGLEWVAEIRTKSNNHATYYAESVKGRFTISRDDSKSSVYLQMNSLRAEDTGIYYCTRLANWDWYFDVWGAGTTVTVSS

SEQ ID NO: 23423 - protein, 5 aa, Artificial Sequence
  Description of Artificial Sequence: Synthetic peptide
  XENP020506 vhCDR1
DAWMD

SEQ ID NO: 23424 - protein, 19 aa, Artificial Sequence
  Description of Artificial Sequence: Synthetic peptide
  XENP020506 vhCDR2
EIRTKSNNHATYYAESVKG

SEQ ID NO: 23425 - protein, 10 aa, Artificial Sequence
  Description of Artificial Sequence: Synthetic peptide
  XENP020506 vhCDR3
LANWDWYFDV

SEQ ID NO: 23426 - protein, 218 aa, Artificial Sequence; identical to SEQ ID NO: 22266
  Description of Artificial Sequence: Synthetic polypeptide
  XENP020506 7G8_H0.54_L0_IgG1_PVA_/S267K Light Chain

SEQ ID NO: 23427 - protein, 111 aa, Artificial Sequence; identical to SEQ ID NO: 22267
  Description of Artificial Sequence: Synthetic polypeptide
  VL of XENP020506

SEQ ID NO: 23428 - protein, 15 aa, Artificial Sequence
  Description of Artificial Sequence: Synthetic peptide
  XENP020506 vlCDR1
KASQSVDYDGDSYMN

SEQ ID NO: 23429 - protein, 7 aa, Artificial Sequence
  Description of Artificial Sequence: Synthetic peptide
  XENP020506 vlCDR2
AASNLES

SEQ ID NO: 23430 - protein, 9 aa, Artificial Sequence
  Description of Artificial Sequence: Synthetic peptide
  XENP020506 vlCDR3
QQSNEDPFT

SEQ ID NO: 23431 - protein, 450 aa, Artificial Sequence
  Description of Artificial Sequence: Synthetic polypeptide
  XENP020507 7G8_H0.55_L0_IgG1_PVA_/S267K Heavy Chain
EVKLEESGGGLVQPGGSMKLSCAASGFTFSDAWMDWVRQSPEKGLEWVAEIRTKTNNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 23432 - protein, 121 aa, Artificial Sequence
  Description of Artificial Sequence: Synthetic polypeptide
  VH of XENP020507
EVKLEESGGGLVQPGGSMKLSCAASGFTFSDAWMDWVRQSPEKGLEWVAEIRTKTNNHATYYAESVKGRFTISRDDSKSSVYLQMNSLRAEDTGIYYCTRLANWDWYFDVWGAGTTVTVSS

SEQ ID NO: 23433 - protein, 5 aa, Artificial Sequence
  Description of Artificial Sequence: Synthetic peptide
  XENP020507 vhCDR1
DAWMD

SEQ ID NO: 23434 - protein, 19 aa, Artificial Sequence
  Description of Artificial Sequence: Synthetic peptide
  XENP020507 vhCDR2
EIRTKTNNHATYYAESVKG

SEQ ID NO: 23435 - protein, 10 aa, Artificial Sequence
  Description of Artificial Sequence: Synthetic peptide
  XENP020507 vhCDR3
LANWDWYFDV

SEQ ID NO: 23436 - protein, 218 aa, Artificial Sequence; identical to SEQ ID NO: 22266
  Description of Artificial Sequence: Synthetic polypeptide
  XENP020507 7G8_H0.55_L0_IgG1_PVA_/S267K Light Chain

SEQ ID NO: 23437 - protein, 111 aa, Artificial Sequence; identical to SEQ ID NO: 22267
  Description of Artificial Sequence: Synthetic polypeptide
  VL of XENP020507

SEQ ID NO: 23438 - protein, 15 aa, Artificial Sequence
  Description of Artificial Sequence: Synthetic peptide
  XENP020507 vlCDR1
KASQSVDYDGDSYMN

SEQ ID NO: 23439 - protein, 7 aa, Artificial Sequence
  Description of Artificial Sequence: Synthetic peptide
  XENP020507 vlCDR2
AASNLES

SEQ ID NO: 23440 - protein, 9 aa, Artificial Sequence
  Description of Artificial Sequence: Synthetic peptide
  XENP020507 vlCDR3
QQSNEDPFT

SEQ ID NO: 23441 - protein, 450 aa, Artificial Sequence
  Description of Artificial Sequence: Synthetic polypeptide
  XENP020508 7G8_H0.56_L0_IgG1_PVA_/S267K Heavy Chain
EVKLEESGGGLVQPGGSMKLSCAASGFTFSDAWMDWVRQSPEKGLEWVAEIRTKGNNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 23442 - protein, 121 aa, Artificial Sequence
  Description of Artificial Sequence: Synthetic polypeptide
  VH of XENP020508
EVKLEESGGGLVQPGGSMKLSCAASGFTFSDAWMDWVRQSPEKGLEWVAEIRTKGNNHATYYAESVKGRFTISRDDSKSSVYLQMNSLRAEDTGIYYCTRLANWDWYFDVWGAGTTVTVSS

SEQ ID NO: 23443 - protein, 5 aa, Artificial Sequence
  Description of Artificial Sequence: Synthetic peptide
  XENP020508 vhCDR1
DAWMD

SEQ ID NO: 23444 - protein, 19 aa, Artificial Sequence
  Description of Artificial Sequence: Synthetic peptide
  XENP020508 vhCDR2
EIRTKGNNHATYYAESVKG

SEQ ID NO: 23445 - protein, 10 aa, Artificial Sequence
  Description of Artificial Sequence: Synthetic peptide
  XENP020508 vhCDR3
LANWDWYFDV

SEQ ID NO: 23446 - protein, 218 aa, Artificial Sequence; identical to SEQ ID NO: 22266
  Description of Artificial Sequence: Synthetic polypeptide
  XENP020508 7G8_H0.56_L0_IgG1_PVA_/S267K Light Chain

SEQ ID NO: 23447 - protein, 111 aa, Artificial Sequence; identical to SEQ ID NO: 22267
  Description of Artificial Sequence: Synthetic polypeptide
  VL of XENP020508

SEQ ID NO: 23448 - protein, 15 aa, Artificial Sequence
  Description of Artificial Sequence: Synthetic peptide
  XENP020508 vlCDR1
KASQSVDYDGDSYMN

SEQ ID NO: 23449 - protein, 7 aa, Artificial Sequence
  Description of Artificial Sequence: Synthetic peptide
  XENP020508 vlCDR2
AASNLES

SEQ ID NO: 23450 - protein, 9 aa, Artificial Sequence
  Description of Artificial Sequence: Synthetic peptide
  XENP020508 vlCDR3
QQSNEDPFT

SEQ ID NO: 23451 - protein, 450 aa, Artificial Sequence
  Description of Artificial Sequence: Synthetic polypeptide
  XENP020509 7G8_H0.57_L0_IgG1_PVA_/S267K Heavy Chain
EVKLEESGGGLVQPGGSMKLSCAASGFTFSDAWMDWVRQSPEKGLEWVAEIRTKHNNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 23452 - protein, 121 aa, Artificial Sequence
  Description of Artificial Sequence: Synthetic polypeptide
  VH of XENP020509
EVKLEESGGGLVQPGGSMKLSCAASGFTFSDAWMDWVRQSPEKGLEWVAEIRTKHNNHATYYAESVKGRFTISRDDSKSSVYLQMNSLRAEDTGIYYCTRLANWDWYFDVWGAGTTVTVSS

SEQ ID NO: 23453 - protein, 5 aa, Artificial Sequence
  Description of Artificial Sequence: Synthetic peptide
  XENP020509 vhCDR1
DAWMD

SEQ ID NO: 23454 - protein, 19 aa, Artificial Sequence
  Description of Artificial Sequence: Synthetic peptide
  XENP020509 vhCDR2
EIRTKHNNHATYYAESVKG

SEQ ID NO: 23455 - protein, 10 aa, Artificial Sequence
  Description of Artificial Sequence: Synthetic peptide
  XENP020509 vhCDR3
LANWDWYFDV

SEQ ID NO: 23456 - protein, 218 aa, Artificial Sequence; identical to SEQ ID NO: 22266
  Description of Artificial Sequence: Synthetic polypeptide
  XENP020509 7G8_H0.57_L0_IgG1_PVA_/S267K Light Chain

SEQ ID NO: 23457 - protein, 111 aa, Artificial Sequence; identical to SEQ ID NO: 22267
  Description of Artificial Sequence: Synthetic polypeptide
  VL of XENP020509

SEQ ID NO: 23458 - protein, 15 aa, Artificial Sequence
  Description of Artificial Sequence: Synthetic peptide
  XENP020509 vlCDR1
KASQSVDYDGDSYMN

SEQ ID NO: 23459 - protein, 7 aa, Artificial Sequence
  Description of Artificial Sequence: Synthetic peptide
  XENP020509 vlCDR2
AASNLES

SEQ ID NO: 23460 - protein, 9 aa, Artificial Sequence
  Description of Artificial Sequence: Synthetic peptide
  XENP020509 vlCDR3
QQSNEDPFT

SEQ ID NO: 23461 - protein, 450 aa, Artificial Sequence
  Description of Artificial Sequence: Synthetic polypeptide
  XENP020510 7G8_H0.58_L0_IgG1_PVA_/S267K Heavy Chain
EVKLEESGGGLVQPGGSMKLSCAASGFTFSDAWMDWVRQSPEKGLEWVAEIRTKQNNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 23462 - protein, 121 aa, Artificial Sequence
  Description of Artificial Sequence: Synthetic polypeptide
  VH of XENP020510
EVKLEESGGGLVQPGGSMKLSCAASGFTFSDAWMDWVRQSPEKGLEWVAEIRTKQNNHATYYAESVKGRFTISRDDSKSSVYLQMNSLRAEDTGIYYCTRLANWDWYFDVWGAGTTVTVSS

SEQ ID NO: 23463 - protein, 5 aa, Artificial Sequence
  Description of Artificial Sequence: Synthetic peptide
  XENP020510 vhCDR1
DAWMD

SEQ ID NO: 23464 - protein, 19 aa, Artificial Sequence
  Description of Artificial Sequence: Synthetic peptide
  XENP020510 vhCDR2
EIRTKQNNHATYYAESVKG

SEQ ID NO: 23465 - protein, 10 aa, Artificial Sequence
  Description of Artificial Sequence: Synthetic peptide
  XENP020510 vhCDR3
LANWDWYFDV

SEQ ID NO: 23466 - protein, 218 aa, Artificial Sequence; identical to SEQ ID NO: 22266
  Description of Artificial Sequence: Synthetic polypeptide
  XENP020510 7G8_H0.58_L0_IgG1_PVA_/S267K Light Chain

SEQ ID NO: 23467 - protein, 111 aa, Artificial Sequence; identical to SEQ ID NO: 22267
  Description of Artificial Sequence: Synthetic polypeptide
  VL of XENP020510

SEQ ID NO: 23468 - protein, 15 aa, Artificial Sequence
  Description of Artificial Sequence: Synthetic peptide
  XENP020510 vlCDR1
KASQSVDYDGDSYMN

SEQ ID NO: 23469 - protein, 7 aa, Artificial Sequence
  Description of Artificial Sequence: Synthetic peptide
  XENP020510 vlCDR2
AASNLES

SEQ ID NO: 23470 - protein, 9 aa, Artificial Sequence
  Description of Artificial Sequence: Synthetic peptide
  XENP020510 vlCDR3
QQSNEDPFT

SEQ ID NO: 23471 - protein, 450 aa, Artificial Sequence
  Description of Artificial Sequence: Synthetic polypeptide
  XENP020511 7G8_H0.59_L0_IgG1_PVA_/S267K Heavy Chain
EVKLEESGGGLVQPGGSMKLSCAASGFTFSDAWMDWVRQSPEKGLEWVAEIRTKDNNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 23472 - protein, 121 aa, Artificial Sequence
  Description of Artificial Sequence: Synthetic polypeptide
  VH of XENP020511
EVKLEESGGGLVQPGGSMKLSCAASGFTFSDAWMDWVRQSPEKGLEWVAEIRTKDNNHATYYAESVKGRFTISRDDSKSSVYLQMNSLRAEDTGIYYCTRLANWDWYFDVWGAGTTVTVSS

SEQ ID NO: 23473 - protein, 5 aa, Artificial Sequence
  Description of Artificial Sequence: Synthetic peptide
  XENP020511 vhCDR1
DAWMD

SEQ ID NO: 23474 - protein, 19 aa, Artificial Sequence
  Description of Artificial Sequence: Synthetic peptide
  XENP020511 vhCDR2
EIRTKDNNHATYYAESVKG

SEQ ID NO: 23475 - protein, 10 aa, Artificial Sequence
  Description of Artificial Sequence: Synthetic peptide
  XENP020511 vhCDR3
LANWDWYFDV

SEQ ID NO: 23476 - protein, 218 aa, Artificial Sequence; identical to SEQ ID NO: 22266
  Description of Artificial Sequence: Synthetic polypeptide
  XENP020511 7G8_H0.59_L0_IgG1_PVA_/S267K Light Chain

SEQ ID NO: 23477 - protein, 111 aa, Artificial Sequence; identical to SEQ ID NO: 22267
  Description of Artificial Sequence: Synthetic polypeptide
  VL of XENP020511

SEQ ID NO: 23478 - protein, 15 aa, Artificial Sequence
  Description of Artificial Sequence: Synthetic peptide
  XENP020511 vlCDR1
KASQSVDYDGDSYMN

SEQ ID NO: 23479 - protein, 7 aa, Artificial Sequence
  Description of Artificial Sequence: Synthetic peptide
  XENP020511 vlCDR2
AASNLES

SEQ ID NO: 23480 - protein, 9 aa, Artificial Sequence
  Description of Artificial Sequence: Synthetic peptide
  XENP020511 vlCDR3
QQSNEDPFT

SEQ ID NO: 23481 - protein, 450 aa, Artificial Sequence
  Description of Artificial Sequence: Synthetic polypeptide
  XENP020512 7G8_H0.60_L0_IgG1_PVA_/S267K Heavy Chain
EVKLEESGGGLVQPGGSMKLSCAASGFTFSDAWMDWVRQSPEKGLEWVAEIRTKLNNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 23482 - protein, 121 aa, Artificial Sequence
  Description of Artificial Sequence: Synthetic polypeptide
  VH of XENP020512
EVKLEESGGGLVQPGGSMKLSCAASGFTFSDAWMDWVRQSPEKGLEWVAEIRTKLNNHATYYAESVKGRFTISRDDSKSSVYLQMNSLRAEDTGIYYCTRLANWDWYFDVWGAGTTVTVSS

SEQ ID NO: 23483 - protein, 5 aa, Artificial Sequence
  Description of Artificial Sequence: Synthetic peptide
  XENP020512 vhCDR1
DAWMD

SEQ ID NO: 23484 - protein, 19 aa, Artificial Sequence
  Description of Artificial Sequence: Synthetic peptide
  XENP020512 vhCDR2
EIRTKLNNHATYYAESVKG

SEQ ID NO: 23485 - protein, 10 aa, Artificial Sequence
  Description of Artificial Sequence: Synthetic peptide
  XENP020512 vhCDR3
LANWDWYFDV

SEQ ID NO: 23486 - protein, 218 aa, Artificial Sequence; identical to SEQ ID NO: 22266
  Description of Artificial Sequence: Synthetic polypeptide
  XENP020512 7G8_H0.60_L0_IgG1_PVA_/S267K Light Chain

SEQ ID NO: 23487 - protein, 111 aa, Artificial Sequence; identical to SEQ ID NO: 22267
  Description of Artificial Sequence: Synthetic polypeptide
  VL of XENP020512

SEQ ID NO: 23488 - protein, 15 aa, Artificial Sequence
  Description of Artificial Sequence: Synthetic peptide
  XENP020512 vlCDR1
KASQSVDYDGDSYMN

SEQ ID NO: 23489 - protein, 7 aa, Artificial Sequence
  Description of Artificial Sequence: Synthetic peptide
  XENP020512 vlCDR2
AASNLES

SEQ ID NO: 23490 - protein, 9 aa, Artificial Sequence
  Description of Artificial Sequence: Synthetic peptide
  XENP020512 vlCDR3
QQSNEDPFT

SEQ ID NO: 23491 - protein, 450 aa, Artificial Sequence
  Description of Artificial Sequence: Synthetic polypeptide
  XENP020513 7G8_H0.61_L0_IgG1_PVA_/S267K Heavy Chain
EVKLEESGGGLVQPGGSMKLSCAASGFTFSDAWMDWVRQSPEKGLEWVAEIRTKKNNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 23492 - protein, 121 aa, Artificial Sequence
  Description of Artificial Sequence: Synthetic polypeptide
  VH of XENP020513
EVKLEESGGGLVQPGGSMKLSCAASGFTFSDAWMDWVRQSPEKGLEWVAEIRTKKNNHATYYAESVKGRFTISRDDSKSSVYLQMNSLRAEDTGIYYCTRLANWDWYFDVWGAGTTVTVSS

SEQ ID NO: 23493 - protein, 5 aa, Artificial Sequence
  Description of Artificial Sequence: Synthetic peptide
  XENP020513 vhCDR1
DAWMD

SEQ ID NO: 23494 - protein, 19 aa, Artificial Sequence
  Description of Artificial Sequence: Synthetic peptide
  XENP020513 vhCDR2
EIRTKKNNHATYYAESVKG

SEQ ID NO: 23495 - protein, 10 aa, Artificial Sequence
  Description of Artificial Sequence: Synthetic peptide
  XENP020513 vhCDR3
LANWDWYFDV

SEQ ID NO: 23496 - protein, 218 aa, Artificial Sequence; identical to SEQ ID NO: 22266
  Description of Artificial Sequence: Synthetic polypeptide
  XENP020513 7G8_H0.61_L0_IgG1_PVA_/S267K Light Chain

SEQ ID NO: 23497 - protein, 111 aa, Artificial Sequence; identical to SEQ ID NO: 22267
  Description of Artificial Sequence: Synthetic polypeptide
  VL of XENP020513

SEQ ID NO: 23498 - protein, 15 aa, Artificial Sequence
  Description of Artificial Sequence: Synthetic peptide
  XENP020513 vlCDR1
KASQSVDYDGDSYMN

SEQ ID NO: 23499 - protein, 7 aa, Artificial Sequence
  Description of Artificial Sequence: Synthetic peptide
  XENP020513 vlCDR2
AASNLES

SEQ ID NO: 23500 - protein, 9 aa, Artificial Sequence
  Description of Artificial Sequence: Synthetic peptide
  XENP020513 vlCDR3
QQSNEDPFT

SEQ ID NO: 23501 - protein, 450 aa, Artificial Sequence
  Description of Artificial Sequence: Synthetic polypeptide
  XENP020514 7G8_H0.62_L0_IgG1_PVA_/S267K Heavy Chain
EVKLEESGGGLVQPGGSMKLSCAASGFTFSDAWMDWVRQSPEKGLEWVAEIRTKYNNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 23502 - protein, 121 aa, Artificial Sequence
  Description of Artificial Sequence: Synthetic polypeptide
  VH of XENP020514
EVKLEESGGGLVQPGGSMKLSCAASGFTFSDAWMDWVRQSPEKGLEWVAEIRTKYNNHATYYAESVKGRFTISRDDSKSSVYLQMNSLRAEDTGIYYCTRLANWDWYFDVWGAGTTVTVSS

SEQ ID NO: 23503 - protein, 5 aa, Artificial Sequence
  Description of Artificial Sequence: Synthetic peptide
  XENP020514 vhCDR1
DAWMD

SEQ ID NO: 23504 - protein, 19 aa, Artificial Sequence
  Description of Artificial Sequence: Synthetic peptide
  XENP020514 vhCDR2
EIRTKYNNHATYYAESVKG

SEQ ID NO: 23505 - protein, 10 aa, Artificial Sequence
  Description of Artificial Sequence: Synthetic peptide
  XENP020514 vhCDR3
LANWDWYFDV

SEQ ID NO: 23506 - protein, 218 aa, Artificial Sequence; identical to SEQ ID NO: 22266
  Description of Artificial Sequence: Synthetic polypeptide
  XENP020514 7G8_H0.62_L0_IgG1_PVA_/S267K Light Chain

SEQ ID NO: 23507 - protein, 111 aa, Artificial Sequence; identical to SEQ ID NO: 22267
  Description of Artificial Sequence: Synthetic polypeptide
  VL of XENP020514

SEQ ID NO: 23508 - protein, 15 aa, Artificial Sequence
  Description of Artificial Sequence: Synthetic peptide
  XENP020514 vlCDR1
KASQSVDYDGDSYMN

SEQ ID NO: 23509 - protein, 7 aa, Artificial Sequence
  Description of Artificial Sequence: Synthetic peptide
  XENP020514 vlCDR2
AASNLES

SEQ ID NO: 23510 - protein, 9 aa, Artificial Sequence
  Description of Artificial Sequence: Synthetic peptide
  XENP020514 vlCDR3
QQSNEDPFT

SEQ ID NO: 23511 - protein, 450 aa, Artificial Sequence
  Description of Artificial Sequence: Synthetic polypeptide
  XENP020515 7G8_H0.63_L0_IgG1_PVA_/S267K Heavy Chain
EVKLEESGGGLVQPGGSMKLSCAASGFTFSDAWMDWVRQSPEKGLEWVAEIRTKADNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 23512 - protein, 121 aa, Artificial Sequence
  Description of Artificial Sequence: Synthetic polypeptide
  VH of XENP020515
EVKLEESGGGLVQPGGSMKLSCAASGFTFSDAWMDWVRQSPEKGLEWVAEIRTKADNHATYYAESVKGRFTISRDDSKSSVYLQMNSLRAEDTGIYYCTRLANWDWYFDVWGAGTTVTVSS

SEQ ID NO: 23513 - protein, 5 aa, Artificial Sequence
  Description of Artificial Sequence: Synthetic peptide
  XENP020515 vhCDR1
DAWMD

SEQ ID NO: 23514 - protein, 19 aa, Artificial Sequence
  Description of Artificial Sequence: Synthetic peptide
  XENP020515 vhCDR2
EIRTKADNHATYYAESVKG

SEQ ID NO: 23515 - protein, 10 aa, Artificial Sequence
  Description of Artificial Sequence: Synthetic peptide
  XENP020515 vhCDR3
LANWDWYFDV

SEQ ID NO: 23516 - protein, 218 aa, Artificial Sequence; identical to SEQ ID NO: 22266
  Description of Artificial Sequence: Synthetic polypeptide
  XENP020515 7G8_H0.63_L0_IgG1_PVA_/S267K Light Chain

SEQ ID NO: 23517 - protein, 111 aa, Artificial Sequence; identical to SEQ ID NO: 22267
  Description of Artificial Sequence: Synthetic polypeptide
  VL of XENP020515

SEQ ID NO: 23518 - protein, 15 aa, Artificial Sequence
  Description of Artificial Sequence: Synthetic peptide
  XENP020515 vlCDR1
KASQSVDYDGDSYMN

SEQ ID NO: 23519 - protein, 7 aa, Artificial Sequence
  Description of Artificial Sequence: Synthetic peptide
  XENP020515 vlCDR2
AASNLES

SEQ ID NO: 23520 - protein, 9 aa, Artificial Sequence
  Description of Artificial Sequence: Synthetic peptide
  XENP020515 vlCDR3
QQSNEDPFT

SEQ ID NO: 23521 - protein, 450 aa, Artificial Sequence
  Description of Artificial Sequence: Synthetic polypeptide
  XENP020516 7G8_H0.64_L0_IgG1_PVA_/S267K Heavy Chain
EVKLEESGGGLVQPGGSMKLSCAASGFTFSDAWMDWVRQSPEKGLEWVAEIRTKAHNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 23522 - protein, 121 aa, Artificial Sequence
  Description of Artificial Sequence: Synthetic polypeptide
  VH of XENP020516
EVKLEESGGGLVQPGGSMKLSCAASGFTFSDAWMDWVRQSPEKGLEWVAEIRTKAHNHATYYAESVKGRFTISRDDSKSSVYLQMNSLRAEDTGIYYCTRLANWDWYFDVWGAGTTVTVSS

SEQ ID NO: 23523 - protein, 5 aa, Artificial Sequence
  Description of Artificial Sequence: Synthetic peptide
  XENP020516 vhCDR1
DAWMD

SEQ ID NO: 23524 - protein, 19 aa, Artificial Sequence
  Description of Artificial Sequence: Synthetic peptide
  XENP020516 vhCDR2
EIRTKAHNHATYYAESVKG

SEQ ID NO: 23525 - protein, 10 aa, Artificial Sequence
  Description of Artificial Sequence: Synthetic peptide
  XENP020516 vhCDR3
LANWDWYFDV

SEQ ID NO: 23526 - protein, 218 aa, Artificial Sequence; identical to SEQ ID NO: 22266
  Description of Artificial Sequence: Synthetic polypeptide
  XENP020516 7G8_H0.64_L0_IgG1_PVA_/S267K Light Chain

SEQ ID NO: 23527 - protein, 111 aa, Artificial Sequence; identical to SEQ ID NO: 22267
  Description of Artificial Sequence: Synthetic polypeptide
  VL of XENP020516

SEQ ID NO: 23528 - protein, 15 aa, Artificial Sequence
  Description of Artificial Sequence: Synthetic peptide
  XENP020516 vlCDR1
KASQSVDYDGDSYMN

SEQ ID NO: 23529 - protein, 7 aa, Artificial Sequence
  Description of Artificial Sequence: Synthetic peptide
  XENP020516 vlCDR2
AASNLES

SEQ ID NO: 23530 - protein, 9 aa, Artificial Sequence
  Description of Artificial Sequence: Synthetic peptide
  XENP020516 vlCDR3
QQSNEDPFT

SEQ ID NO: 23531 - protein, 450 aa, Artificial Sequence
  Description of Artificial Sequence: Synthetic polypeptide
  XENP020517 7G8_H0.65_L0_IgG1_PVA_/S267K Heavy Chain
EVKLEESGGGLVQPGGSMKLSCAASGFTFSDAWMDWVRQSPEKGLEWVAEIRTKAENHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 23532 - protein, 121 aa, Artificial Sequence
  Description of Artificial Sequence: Synthetic polypeptide
  VH of XENP020517
EVKLEESGGGLVQPGGSMKLSCAASGFTFSDAWMDWVRQSPEKGLEWVAEIRTKAENHATYYAESVKGRFTISRDDSKSSVYLQMNSLRAEDTGIYYCTRLANWDWYFDVWGAGTTVTVSS

SEQ ID NO: 23533 - protein, 5 aa, Artificial Sequence
  Description of Artificial Sequence: Synthetic peptide
  XENP020517 vhCDR1
DAWMD

SEQ ID NO: 23534 - protein, 19 aa, Artificial Sequence
  Description of Artificial Sequence: Synthetic peptide
  XENP020517 vhCDR2
EIRTKAENHATYYAESVKG

SEQ ID NO: 23535 - protein, 10 aa, Artificial Sequence
  Description of Artificial Sequence: Synthetic peptide
  XENP020517 vhCDR3
LANWDWYFDV

SEQ ID NO: 23536 - protein, 218 aa, Artificial Sequence; identical to SEQ ID NO: 22266
  Description of Artificial Sequence: Synthetic polypeptide
  XENP020517 7G8_H0.65_L0_IgG1_PVA_/S267K Light Chain

SEQ ID NO: 23537 - protein, 111 aa, Artificial Sequence; identical to SEQ ID NO: 22267
  Description of Artificial Sequence: Synthetic polypeptide
  VL of XENP020517

SEQ ID NO: 23538 - protein, 15 aa, Artificial Sequence
  Description of Artificial Sequence: Synthetic peptide
  XENP020517 vlCDR1
KASQSVDYDGDSYMN

SEQ ID NO: 23539 - protein, 7 aa, Artificial Sequence
  Description of Artificial Sequence: Synthetic peptide
  XENP020517 vlCDR2
AASNLES

SEQ ID NO: 23540 - protein, 9 aa, Artificial Sequence
  Description of Artificial Sequence: Synthetic peptide
  XENP020517 vlCDR3
QQSNEDPFT

SEQ ID NO: 23541 - protein, 450 aa, Artificial Sequence
  Description of Artificial Sequence: Synthetic polypeptide
  XENP020518 7G8_H0.66_L0_IgG1_PVA_/S267K Heavy Chain
EVKLEESGGGLVQPGGSMKLSCAASGFTFSDAWMDWVRQSPEKGLEWVAEIRTKASNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 23542 - protein, 121 aa, Artificial Sequence
  Description of Artificial Sequence: Synthetic polypeptide
  VH of XENP020518
EVKLEESGGGLVQPGGSMKLSCAASGFTFSDAWMDWVRQSPEKGLEWVAEIRTKASNHATYYAESVKGRFTISRDDSKSSVYLQMNSLRAEDTGIYYCTRLANWDWYFDVWGAGTTVTVSS

SEQ ID NO: 23543 - protein, 5 aa, Artificial Sequence
  Description of Artificial Sequence: Synthetic peptide
  XENP020518 vhCDR1
DAWMD

SEQ ID NO: 23544 - protein, 19 aa, Artificial Sequence
  Description of Artificial Sequence: Synthetic peptide
  XENP020518 vhCDR2
EIRTKASNHATYYAESVKG

SEQ ID NO: 23545 - protein, 10 aa, Artificial Sequence
  Description of Artificial Sequence: Synthetic peptide
  XENP020518 vhCDR3
LANWDWYFDV

SEQ ID NO: 23546 - protein, 218 aa, Artificial Sequence; identical to SEQ ID NO: 22266
  Description of Artificial Sequence: Synthetic polypeptide
  XENP020518 7G8_H0.66_L0_IgG1_PVA_/S267K Light Chain

SEQ ID NO: 23547 - protein, 111 aa, Artificial Sequence; identical to SEQ ID NO: 22267
  Description of Artificial Sequence: Synthetic polypeptide
  VL of XENP020518

SEQ ID NO: 23548 - protein, 15 aa, Artificial Sequence
  Description of Artificial Sequence: Synthetic peptide
  XENP020518 vlCDR1
KASQSVDYDGDSYMN

SEQ ID NO: 23549 - protein, 7 aa, Artificial Sequence
  Description of Artificial Sequence: Synthetic peptide
  XENP020518 vlCDR2
AASNLES

SEQ ID NO: 23550 - protein, 9 aa, Artificial Sequence
  Description of Artificial Sequence: Synthetic peptide
  XENP020518 vlCDR3
QQSNEDPFT

SEQ ID NO: 23551 - protein, 450 aa, Artificial Sequence
  Description of Artificial Sequence: Synthetic polypeptide
  XENP020519 7G8_H0.67_L0_IgG1_PVA_/S267K Heavy Chain
EVKLEESGGGLVQPGGSMKLSCAASGFTFSDAWMDWVRQSPEKGLEWVAEIRTKARNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 23552 - protein, 121 aa, Artificial Sequence
  Description of Artificial Sequence: Synthetic polypeptide
  VH of XENP020519
EVKLEESGGGLVQPGGSMKLSCAASGFTFSDAWMDWVRQSPEKGLEWVAEIRTKARNHATYYAESVKGRFTISRDDSKSSVYLQMNSLRAEDTGIYYCTRLANWDWYFDVWGAGTTVTVSS

SEQ ID NO: 23553 - protein, 5 aa, Artificial Sequence
  Description of Artificial Sequence: Synthetic peptide
  XENP020519 vhCDR1
DAWMD

SEQ ID NO: 23554 - protein, 19 aa, Artificial Sequence
  Description of Artificial Sequence: Synthetic peptide
  XENP020519 vhCDR2
EIRTKARNHATYYAESVKG

SEQ ID NO: 23555 - protein, 10 aa, Artificial Sequence
  Description of Artificial Sequence: Synthetic peptide
  XENP020519 vhCDR3
LANWDWYFDV

SEQ ID NO: 23556 - protein, 218 aa, Artificial Sequence; identical to SEQ ID NO: 22266
  Description of Artificial Sequence: Synthetic polypeptide
  XENP020519 7G8_H0.67_L0_IgG1_PVA_/S267K Light Chain

SEQ ID NO: 23557 - protein, 111 aa, Artificial Sequence; identical to SEQ ID NO: 22267
  Description of Artificial Sequence: Synthetic polypeptide
  VL of XENP020519

SEQ ID NO: 23558 - protein, 15 aa, Artificial Sequence
  Description of Artificial Sequence: Synthetic peptide
  XENP020519 vlCDR1
KASQSVDYDGDSYMN

SEQ ID NO: 23559 - protein, 7 aa, Artificial Sequence
  Description of Artificial Sequence: Synthetic peptide
  XENP020519 vlCDR2
AASNLES

SEQ ID NO: 23560 - protein, 9 aa, Artificial Sequence
  Description of Artificial Sequence: Synthetic peptide
  XENP020519 vlCDR3
QQSNEDPFT

SEQ ID NO: 23561 - protein, 450 aa, Artificial Sequence
  Description of Artificial Sequence: Synthetic polypeptide
  XENP020520 7G8_H0.68_L0_IgG1_PVA_/S267K Heavy Chain
EVKLEESGGGLVQPGGSMKLSCAASGFTFSDAWMDWVRQSPEKGLEWVAEIRTKALNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 23562 - protein, 121 aa, Artificial Sequence
  Description of Artificial Sequence: Synthetic polypeptide
  VH of XENP020520
EVKLEESGGGLVQPGGSMKLSCAASGFTFSDAWMDWVRQSPEKGLEWVAEIRTKALNHATYYAESVKGRFTISRDDSKSSVYLQMNSLRAEDTGIYYCTRLANWDWYFDVWGAGTTVTVSS

SEQ ID NO: 23563 - protein, 5 aa, Artificial Sequence
  Description of Artificial Sequence: Synthetic peptide
  XENP020520 vhCDR1
DAWMD

SEQ ID NO: 23564 - protein, 19 aa, Artificial Sequence
  Description of Artificial Sequence: Synthetic peptide
  XENP020520 vhCDR2
EIRTKALNHATYYAESVKG

SEQ ID NO: 23565 - protein, 10 aa, Artificial Sequence
  Description of Artificial Sequence: Synthetic peptide
  XENP020520 vhCDR3
LANWDWYFDV

SEQ ID NO: 23566 - protein, 218 aa, Artificial Sequence; identical to SEQ ID NO: 22266
  Description of Artificial Sequence: Synthetic polypeptide
  XENP020520 7G8_H0.68_L0_IgG1_PVA_/S267K Light Chain

SEQ ID NO: 23567 - protein, 111 aa, Artificial Sequence; identical to SEQ ID NO: 22267
  Description of Artificial Sequence: Synthetic polypeptide
  VL of XENP020520

SEQ ID NO: 23568 - protein, 15 aa, Artificial Sequence
  Description of Artificial Sequence: Synthetic peptide
  XENP020520 vlCDR1
KASQSVDYDGDSYMN

SEQ ID NO: 23569 - protein, 7 aa, Artificial Sequence
  Description of Artificial Sequence: Synthetic peptide
  XENP020520 vlCDR2
AASNLES

SEQ ID NO: 23570 - protein, 9 aa, Artificial Sequence
  Description of Artificial Sequence: Synthetic peptide
  XENP020520 vlCDR3
QQSNEDPFT

SEQ ID NO: 23571 - protein, 450 aa, Artificial Sequence
  Description of Artificial Sequence: Synthetic polypeptide
  XENP020521 7G8_H0.69_L0_IgG1_PVA_/S267K Heavy Chain
EVKLEESGGGLVQPGGSMKLSCAASGFTFSDAWMDWVRQSPEKGLEWVAEIRTKATNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 23572 - protein, 121 aa, Artificial Sequence
  Description of Artificial Sequence: Synthetic polypeptide
  VH of XENP020521
EVKLEESGGGLVQPGGSMKLSCAASGFTFSDAWMDWVRQSPEKGLEWVAEIRTKATNHATYYAESVKGRFTISRDDSKSSVYLQMNSLRAEDTGIYYCTRLANWDWYFDVWGAGTTVTVSS

SEQ ID NO: 23573 - protein, 5 aa, Artificial Sequence
  Description of Artificial Sequence: Synthetic peptide
  XENP020521 vhCDR1
DAWMD

SEQ ID NO: 23574 - protein, 19 aa, Artificial Sequence
  Description of Artificial Sequence: Synthetic peptide
  XENP020521 vhCDR2
EIRTKATNHATYYAESVKG

SEQ ID NO: 23575 - protein, 10 aa, Artificial Sequence
  Description of Artificial Sequence: Synthetic peptide
  XENP020521 vhCDR3
LANWDWYFDV

SEQ ID NO: 23576 - protein, 218 aa, Artificial Sequence; identical to SEQ ID NO: 22266
  Description of Artificial Sequence: Synthetic polypeptide
  XENP020521 7G8_H0.69_L0_IgG1_PVA_/S267K Light Chain

SEQ ID NO: 23577 - protein, 111 aa, Artificial Sequence; identical to SEQ ID NO: 22267
  Description of Artificial Sequence: Synthetic polypeptide
  VL of XENP020521

SEQ ID NO: 23578 - protein, 15 aa, Artificial Sequence
  Description of Artificial Sequence: Synthetic peptide
  XENP020521 vlCDR1
KASQSVDYDGDSYMN

SEQ ID NO: 23579 - protein, 7 aa, Artificial Sequence
  Description of Artificial Sequence: Synthetic peptide
  XENP020521 vlCDR2
AASNLES

SEQ ID NO: 23580 - protein, 9 aa, Artificial Sequence
  Description of Artificial Sequence: Synthetic peptide
  XENP020521 vlCDR3
QQSNEDPFT

SEQ ID NO: 23581 - protein, 450 aa, Artificial Sequence
  Description of Artificial Sequence: Synthetic polypeptide
  XENP020522 7G8_H0.70_L0_IgG1_PVA_/S267K Heavy Chain
EVKLEESGGGLVQPGGSMKLSCAASGFTFSDAWMDWVRQSPEKGLEWVAEIRTKAGNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 23582 - protein, 121 aa, Artificial Sequence
  Description of Artificial Sequence: Synthetic polypeptide
  VH of XENP020522
EVKLEESGGGLVQPGGSMKLSCAASGFTFSDAWMDWVRQSPEKGLEWVAEIRTKAGNHATYYAESVKGRFTISRDDSKSSVYLQMNSLRAEDTGIYYCTRLANWDWYFDVWGAGTTVTVSS

SEQ ID NO: 23583 - protein, 5 aa, Artificial Sequence
  Description of Artificial Sequence: Synthetic peptide
  XENP020522 vhCDR1
DAWMD

SEQ ID NO: 23584 - protein, 19 aa, Artificial Sequence
  Description of Artificial Sequence: Synthetic peptide
  XENP020522 vhCDR2
EIRTKAGNHATYYAESVKG

SEQ ID NO: 23585 - protein, 10 aa, Artificial Sequence
  Description of Artificial Sequence: Synthetic peptide
  XENP020522 vhCDR3
LANWDWYFDV

SEQ ID NO: 23586 - protein, 218 aa, Artificial Sequence; identical to SEQ ID NO: 22266
  Description of Artificial Sequence: Synthetic polypeptide
  XENP020522 7G8_H0.70_L0_IgG1_PVA_/S267K Light Chain

SEQ ID NO: 23587 - protein, 111 aa, Artificial Sequence; identical to SEQ ID NO: 22267
  Description of Artificial Sequence: Synthetic polypeptide
  VL of XENP020522

SEQ ID NO: 23588 - protein, 15 aa, Artificial Sequence
  Description of Artificial Sequence: Synthetic peptide
  XENP020522 vlCDR1
KASQSVDYDGDSYMN

SEQ ID NO: 23589 - protein, 7 aa, Artificial Sequence
  Description of Artificial Sequence: Synthetic peptide
  XENP020522 vlCDR2
AASNLES

SEQ ID NO: 23590 - protein, 9 aa, Artificial Sequence
  Description of Artificial Sequence: Synthetic peptide
  XENP020522 vlCDR3
QQSNEDPFT

SEQ ID NO: 23591 - protein, 450 aa, Artificial Sequence
  Description of Artificial Sequence: Synthetic polypeptide
  XENP020523 7G8_H0.71_L0_IgG1_PVA_/S267K Heavy Chain
EVKLEESGGGLVQPGGSMKLSCAASGFTFSDAWMDWVRQSPEKGLEWVAEIRTKAYNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 23592 - protein, 121 aa, Artificial Sequence
  Description of Artificial Sequence: Synthetic polypeptide
  VH of XENP020523
EVKLEESGGGLVQPGGSMKLSCAASGFTFSDAWMDWVRQSPEKGLEWVAEIRTKAYNHATYYAESVKGRFTISRDDSKSSVYLQMNSLRAEDTGIYYCTRLANWDWYFDVWGAGTTVTVSS

SEQ ID NO: 23593 - protein, 5 aa, Artificial Sequence
  Description of Artificial Sequence: Synthetic peptide
  XENP020523 vhCDR1
DAWMD

SEQ ID NO: 23594 - protein, 19 aa, Artificial Sequence
  Description of Artificial Sequence: Synthetic peptide
  XENP020523 vhCDR2
EIRTKAYNHATYYAESVKG

SEQ ID NO: 23595 - protein, 10 aa, Artificial Sequence
  Description of Artificial Sequence: Synthetic peptide
  XENP020523 vhCDR3
LANWDWYFDV

SEQ ID NO: 23596 - protein, 218 aa, Artificial Sequence; identical to SEQ ID NO: 22266
  Description of Artificial Sequence: Synthetic polypeptide
  XENP020523 7G8_H0.71_L0_IgG1_PVA_/S267K Light Chain

SEQ ID NO: 23597 - protein, 111 aa, Artificial Sequence; identical to SEQ ID NO: 22267
  Description of Artificial Sequence: Synthetic polypeptide
  VL of XENP020523

SEQ ID NO: 23598 - protein, 15 aa, Artificial Sequence
  Description of Artificial Sequence: Synthetic peptide
  XENP020523 vlCDR1
KASQSVDYDGDSYMN

SEQ ID NO: 23599 - protein, 7 aa, Artificial Sequence
  Description of Artificial Sequence: Synthetic peptide
  XENP020523 vlCDR2
AASNLES

SEQ ID NO: 23600 - protein, 9 aa, Artificial Sequence
  Description of Artificial Sequence: Synthetic peptide
  XENP020523 vlCDR3
QQSNEDPFT

SEQ ID NO: 23601 - protein, 450 aa, Artificial Sequence
  Description of Artificial Sequence: Synthetic polypeptide
  XENP020524 7G8_H0.72_L0_IgG1_PVA_/S267K Heavy Chain
EVKLEESGGGLVQPGGSMKLSCAASGFTFSDAWMDWVRQSPEKGLEWVAEIRTKANDHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 23602 - protein, 121 aa, Artificial Sequence
  Description of Artificial Sequence: Synthetic polypeptide
  VH of XENP020524
EVKLEESGGGLVQPGGSMKLSCAASGFTFSDAWMDWVRQSPEKGLEWVAEIRTKANDHATYYAESVKGRFTISRDDSKSSVYLQMNSLRAEDTGIYYCTRLANWDWYFDVWGAGTTVTVSS

SEQ ID NO: 23603 - protein, 5 aa, Artificial Sequence
  Description of Artificial Sequence: Synthetic peptide
  XENP020524 vhCDR1
DAWMD

SEQ ID NO: 23604 - protein, 19 aa, Artificial Sequence
  Description of Artificial Sequence: Synthetic peptide
  XENP020524 vhCDR2
EIRTKANDHATYYAESVKG

SEQ ID NO: 23605 - protein, 10 aa, Artificial Sequence
  Description of Artificial Sequence: Synthetic peptide
  XENP020524 vhCDR3
LANWDWYFDV

SEQ ID NO: 23606 - protein, 218 aa, Artificial Sequence; identical to SEQ ID NO: 22266
  Description of Artificial Sequence: Synthetic polypeptide
  XENP020524 7G8_H0.72_L0_IgG1_PVA_/S267K Light Chain

SEQ ID NO: 23607 - protein, 111 aa, Artificial Sequence; identical to SEQ ID NO: 22267
  Description of Artificial Sequence: Synthetic polypeptide
  VL of XENP020524

SEQ ID NO: 23608 - protein, 15 aa, Artificial Sequence
  Description of Artificial Sequence: Synthetic peptide
  XENP020524 vlCDR1
KASQSVDYDGDSYMN

SEQ ID NO: 23609 - protein, 7 aa, Artificial Sequence
  Description of Artificial Sequence: Synthetic peptide
  XENP020524 vlCDR2
AASNLES

SEQ ID NO: 23610 - protein, 9 aa, Artificial Sequence
  Description of Artificial Sequence: Synthetic peptide
  XENP020524 vlCDR3
QQSNEDPFT

SEQ ID NO: 23611 - protein, 450 aa, Artificial Sequence
  Description of Artificial Sequence: Synthetic polypeptide
  XENP020525 7G8_H0.73_L0_IgG1_PVA_/S267K Heavy Chain
EVKLEESGGGLVQPGGSMKLSCAASGFTFSDAWMDWVRQSPEKGLEWVAEIRTKANHHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 23612 - protein, 121 aa, Artificial Sequence
  Description of Artificial Sequence: Synthetic polypeptide
  VH of XENP020525
EVKLEESGGGLVQPGGSMKLSCAASGFTFSDAWMDWVRQSPEKGLEWVAEIRTKANHHATYYAESVKGRFTISRDDSKSSVYLQMNSLRAEDTGIYYCTRLANWDWYFDVWGAGTTVTVSS

SEQ ID NO: 23613 - protein, 5 aa, Artificial Sequence
  Description of Artificial Sequence: Synthetic peptide
  XENP020525 vhCDR1
DAWMD

SEQ ID NO: 23614 - protein, 19 aa, Artificial Sequence
  Description of Artificial Sequence: Synthetic peptide
  XENP020525 vhCDR2
EIRTKANHHATYYAESVKG

SEQ ID NO: 23615 - protein, 10 aa, Artificial Sequence
  Description of Artificial Sequence: Synthetic peptide
  XENP020525 vhCDR3
LANWDWYFDV

SEQ ID NO: 23616 - protein, 218 aa, Artificial Sequence; identical to SEQ ID NO: 22266
  Description of Artificial Sequence: Synthetic polypeptide
  XENP020525 7G8_H0.73_L0_IgG1_PVA_/S267K Light Chain

SEQ ID NO: 23617 - protein, 111 aa, Artificial Sequence; identical to SEQ ID NO: 22267
  Description of Artificial Sequence: Synthetic polypeptide
  VL of XENP020525

SEQ ID NO: 23618 - protein, 15 aa, Artificial Sequence
  Description of Artificial Sequence: Synthetic peptide
  XENP020525 vlCDR1
KASQSVDYDGDSYMN

SEQ ID NO: 23619 - protein, 7 aa, Artificial Sequence
  Description of Artificial Sequence: Synthetic peptide
  XENP020525 vlCDR2
AASNLES

SEQ ID NO: 23620 - protein, 9 aa, Artificial Sequence
  Description of Artificial Sequence: Synthetic peptide
  XENP020525 vlCDR3
QQSNEDPFT

SEQ ID NO: 23621 - protein, 450 aa, Artificial Sequence
  Description of Artificial Sequence: Synthetic polypeptide
  XENP020526 7G8_H0.74_L0_IgG1_PVA_/S267K Heavy Chain
EVKLEESGGGLVQPGGSMKLSCAASGFTFSDAWMDWVRQSPEKGLEWVAEIRTKANEHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 23622 - protein, 121 aa, Artificial Sequence
  Description of Artificial Sequence: Synthetic polypeptide
  VH of XENP020526
EVKLEESGGGLVQPGGSMKLSCAASGFTFSDAWMDWVRQSPEKGLEWVAEIRTKANEHATYYAESVKGRFTISRDDSKSSVYLQMNSLRAEDTGIYYCTRLANWDWYFDVWGAGTTVTVSS

SEQ ID NO: 23623 - protein, 5 aa, Artificial Sequence
  Description of Artificial Sequence: Synthetic peptide
  XENP020526 vhCDR1
DAWMD

SEQ ID NO: 23624 - protein, 19 aa, Artificial Sequence
  Description of Artificial Sequence: Synthetic peptide
  XENP020526 vhCDR2
EIRTKANEHATYYAESVKG

SEQ ID NO: 23625 - protein, 10 aa, Artificial Sequence
  Description of Artificial Sequence: Synthetic peptide
  XENP020526 vhCDR3
LANWDWYFDV

SEQ ID NO: 23626 - protein, 218 aa, Artificial Sequence; identical to SEQ ID NO: 22266
  Description of Artificial Sequence: Synthetic polypeptide
  XENP020526 7G8_H0.74_L0_IgG1_PVA_/S267K Light Chain

SEQ ID NO: 23627 - protein, 111 aa, Artificial Sequence; identical to SEQ ID NO: 22267
  Description of Artificial Sequence: Synthetic polypeptide
  VL of XENP020526

SEQ ID NO: 23628 - protein, 15 aa, Artificial Sequence
  Description of Artificial Sequence: Synthetic peptide
  XENP020526 vlCDR1
KASQSVDYDGDSYMN

SEQ ID NO: 23629 - protein, 7 aa, Artificial Sequence
  Description of Artificial Sequence: Synthetic peptide
  XENP020526 vlCDR2
AASNLES

SEQ ID NO: 23630 - protein, 9 aa, Artificial Sequence
  Description of Artificial Sequence: Synthetic peptide
  XENP020526 vlCDR3
QQSNEDPFT

SEQ ID NO: 23631 - protein, 450 aa, Artificial Sequence
  Description of Artificial Sequence: Synthetic polypeptide
  XENP020527 7G8_H0.75_L0_IgG1_PVA_/S267K Heavy Chain
EVKLEESGGGLVQPGGSMKLSCAASGFTFSDAWMDWVRQSPEKGLEWVAEIRTKANSHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 23632 - protein, 121 aa, Artificial Sequence
  Description of Artificial Sequence: Synthetic polypeptide
  VH of XENP020527
EVKLEESGGGLVQPGGSMKLSCAASGFTFSDAWMDWVRQSPEKGLEWVAEIRTKANSHATYYAESVKGRFTISRDDSKSSVYLQMNSLRAEDTGIYYCTRLANWDWYFDVWGAGTTVTVSS

SEQ ID NO: 23633 - protein, 5 aa, Artificial Sequence
  Description of Artificial Sequence: Synthetic peptide
  XENP020527 vhCDR1
DAWMD

SEQ ID NO: 23634 - protein, 19 aa, Artificial Sequence
  Description of Artificial Sequence: Synthetic peptide
  XENP020527 vhCDR2
EIRTKANSHATYYAESVKG

SEQ ID NO: 23635 - protein, 10 aa, Artificial Sequence
  Description of Artificial Sequence: Synthetic peptide
  XENP020527 vhCDR3
LANWDWYFDV

SEQ ID NO: 23636 - protein, 218 aa, Artificial Sequence; identical to SEQ ID NO: 22266
  Description of Artificial Sequence: Synthetic polypeptide
  XENP020527 7G8_H0.75_L0_IgG1_PVA_/S267K Light Chain

SEQ ID NO: 23637 - protein, 111 aa, Artificial Sequence; identical to SEQ ID NO: 22267
  Description of Artificial Sequence: Synthetic polypeptide
  VL of XENP020527

SEQ ID NO: 23638 - protein, 15 aa, Artificial Sequence
  Description of Artificial Sequence: Synthetic peptide
  XENP020527 vlCDR1
KASQSVDYDGDSYMN

SEQ ID NO: 23639 - protein, 7 aa, Artificial Sequence
  Description of Artificial Sequence: Synthetic peptide
  XENP020527 vlCDR2
AASNLES

SEQ ID NO: 23640 - protein, 9 aa, Artificial Sequence
  Description of Artificial Sequence: Synthetic peptide
  XENP020527 vlCDR3
QQSNEDPFT

SEQ ID NO: 23641 - protein, 450 aa, Artificial Sequence
  Description of Artificial Sequence: Synthetic polypeptide
  XENP020528 7G8_H0.76_L0_IgG1_PVA_/S267K Heavy Chain
EVKLEESGGGLVQPGGSMKLSCAASGFTFSDAWMDWVRQSPEKGLEWVAEIRTKANRHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 23642 - protein, 121 aa, Artificial Sequence
  Description of Artificial Sequence: Synthetic polypeptide
  VH of XENP020528
EVKLEESGGGLVQPGGSMKLSCAASGFTFSDAWMDWVRQSPEKGLEWVAEIRTKANRHATYYAESVKGRFTISRDDSKSSVYLQMNSLRAEDTGIYYCTRLANWDWYFDVWGAGTTVTVSS

SEQ ID NO: 23643 - protein, 5 aa, Artificial Sequence
  Description of Artificial Sequence: Synthetic peptide
  XENP020528 vhCDR1
DAWMD

SEQ ID NO: 23644 - protein, 19 aa, Artificial Sequence
  Description of Artificial Sequence: Synthetic peptide
  XENP020528 vhCDR2
EIRTKANRHATYYAESVKG

SEQ ID NO: 23645 - protein, 10 aa, Artificial Sequence
  Description of Artificial Sequence: Synthetic peptide
  XENP020528 vhCDR3
LANWDWYFDV

SEQ ID NO: 23646 - protein, 218 aa, Artificial Sequence; identical to SEQ ID NO: 22266
  Description of Artificial Sequence: Synthetic polypeptide
  XENP020528 7G8_H0.76_L0_IgG1_PVA_/S267K Light Chain

SEQ ID NO: 23647 - protein, 111 aa, Artificial Sequence; identical to SEQ ID NO: 22267
  Description of Artificial Sequence: Synthetic polypeptide
  VL of XENP020528

SEQ ID NO: 23648 - protein, 15 aa, Artificial Sequence
  Description of Artificial Sequence: Synthetic peptide
  XENP020528 vlCDR1
KASQSVDYDGDSYMN

SEQ ID NO: 23649 - protein, 7 aa, Artificial Sequence
  Description of Artificial Sequence: Synthetic peptide
  XENP020528 vlCDR2
AASNLES

SEQ ID NO: 23650 - protein, 9 aa, Artificial Sequence
  Description of Artificial Sequence: Synthetic peptide
  XENP020528 vlCDR3
QQSNEDPFT

SEQ ID NO: 23651 - protein, 450 aa, Artificial Sequence
  Description of Artificial Sequence: Synthetic polypeptide
  XENP020529 7G8_H0.77_L0_IgG1_PVA_/S267K Heavy Chain
EVKLEESGGGLVQPGGSMKLSCAASGFTFSDAWMDWVRQSPEKGLEWVAEIRTKANLHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 23652 - protein, 121 aa, Artificial Sequence
  Description of Artificial Sequence: Synthetic polypeptide
  VH of XENP020529
EVKLEESGGGLVQPGGSMKLSCAASGFTFSDAWMDWVRQSPEKGLEWVAEIRTKANLHATYYAESVKGRFTISRDDSKSSVYLQMNSLRAEDTGIYYCTRLANWDWYFDVWGAGTTVTVSS

SEQ ID NO: 23653 - protein, 5 aa, Artificial Sequence
  Description of Artificial Sequence: Synthetic peptide
  XENP020529 vhCDR1
DAWMD

SEQ ID NO: 23654 - protein, 19 aa, Artificial Sequence
  Description of Artificial Sequence: Synthetic peptide
  XENP020529 vhCDR2
EIRTKANLHATYYAESVKG

SEQ ID NO: 23655 - protein, 10 aa, Artificial Sequence
  Description of Artificial Sequence: Synthetic peptide
  XENP020529 vhCDR3
LANWDWYFDV

SEQ ID NO: 23656 - protein, 218 aa, Artificial Sequence; identical to SEQ ID NO: 22266
  Description of Artificial Sequence: Synthetic polypeptide
  XENP020529 7G8_H0.77_L0_IgG1_PVA_/S267K Light Chain

SEQ ID NO: 23657 - protein, 111 aa, Artificial Sequence; identical to SEQ ID NO: 22267
  Description of Artificial Sequence: Synthetic polypeptide
  VL of XENP020529

SEQ ID NO: 23658 - protein, 15 aa, Artificial Sequence
  Description of Artificial Sequence: Synthetic peptide
  XENP020529 vlCDR1
KASQSVDYDGDSYMN

SEQ ID NO: 23659 - protein, 7 aa, Artificial Sequence
  Description of Artificial Sequence: Synthetic peptide
  XENP020529 vlCDR2
AASNLES

SEQ ID NO: 23660 - protein, 9 aa, Artificial Sequence
  Description of Artificial Sequence: Synthetic peptide
  XENP020529 vlCDR3
QQSNEDPFT

SEQ ID NO: 23661 - protein, 450 aa, Artificial Sequence
  Description of Artificial Sequence: Synthetic polypeptide
  XENP020530 7G8_H0.78_L0_IgG1_PVA_/S267K Heavy Chain
EVKLEESGGGLVQPGGSMKLSCAASGFTFSDAWMDWVRQSPEKGLEWVAEIRTKANTHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 23662 - protein, 121 aa, Artificial Sequence
  Description of Artificial Sequence: Synthetic polypeptide
  VH of XENP020530
EVKLEESGGGLVQPGGSMKLSCAASGFTFSDAWMDWVRQSPEKGLEWVAEIRTKANTHATYYAESVKGRFTISRDDSKSSVYLQMNSLRAEDTGIYYCTRLANWDWYFDVWGAGTTVTVSS

SEQ ID NO: 23663 - protein, 5 aa, Artificial Sequence
  Description of Artificial Sequence: Synthetic peptide
  XENP020530 vhCDR1
DAWMD

SEQ ID NO: 23664 - protein, 19 aa, Artificial Sequence
  Description of Artificial Sequence: Synthetic peptide
  XENP020530 vhCDR2
EIRTKANTHATYYAESVKG

SEQ ID NO: 23665 - protein, 10 aa, Artificial Sequence
  Description of Artificial Sequence: Synthetic peptide
  XENP020530 vhCDR3
LANWDWYFDV

SEQ ID NO: 23666 - protein, 218 aa, Artificial Sequence; identical to SEQ ID NO: 22266
  Description of Artificial Sequence: Synthetic polypeptide
  XENP020530 7G8_H0.78_L0_IgG1_PVA_/S267K Light Chain

SEQ ID NO: 23667 - protein, 111 aa, Artificial Sequence; identical to SEQ ID NO: 22267
  Description of Artificial Sequence: Synthetic polypeptide
  VL of XENP020530

SEQ ID NO: 23668 - protein, 15 aa, Artificial Sequence
  Description of Artificial Sequence: Synthetic peptide
  XENP020530 vlCDR1
KASQSVDYDGDSYMN

SEQ ID NO: 23669 - protein, 7 aa, Artificial Sequence
  Description of Artificial Sequence: Synthetic peptide
  XENP020530 vlCDR2
AASNLES

SEQ ID NO: 23670 - protein, 9 aa, Artificial Sequence
  Description of Artificial Sequence: Synthetic peptide
  XENP020530 vlCDR3
QQSNEDPFT

SEQ ID NO: 23671 - protein, 450 aa, Artificial Sequence
  Description of Artificial Sequence: Synthetic polypeptide
  XENP020531 7G8_H0.79_L0_IgG1_PVA_/S267K Heavy Chain
EVKLEESGGGLVQPGGSMKLSCAASGFTFSDAWMDWVRQSPEKGLEWVAEIRTKANGHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 23672 - protein, 121 aa, Artificial Sequence
  Description of Artificial Sequence: Synthetic polypeptide
  VH of XENP020531
EVKLEESGGGLVQPGGSMKLSCAASGFTFSDAWMDWVRQSPEKGLEWVAEIRTKANGHATYYAESVKGRFTISRDDSKSSVYLQMNSLRAEDTGIYYCTRLANWDWYFDVWGAGTTVTVSS

SEQ ID NO: 23673 - protein, 5 aa, Artificial Sequence
  Description of Artificial Sequence: Synthetic peptide
  XENP020531 vhCDR1
DAWMD

SEQ ID NO: 23674 - protein, 19 aa, Artificial Sequence
  Description of Artificial Sequence: Synthetic peptide
  XENP020531 vhCDR2
EIRTKANGHATYYAESVKG

SEQ ID NO: 23675 - protein, 10 aa, Artificial Sequence
  Description of Artificial Sequence: Synthetic peptide
  XENP020531 vhCDR3
LANWDWYFDV

SEQ ID NO: 23676 - protein, 218 aa, Artificial Sequence; identical to SEQ ID NO: 22266
  Description of Artificial Sequence: Synthetic polypeptide
  XENP020531 7G8_H0.79_L0_IgG1_PVA_/S267K Light Chain

SEQ ID NO: 23677 - protein, 111 aa, Artificial Sequence; identical to SEQ ID NO: 22267
  Description of Artificial Sequence: Synthetic polypeptide
  VL of XENP020531

SEQ ID NO: 23678 - protein, 15 aa, Artificial Sequence
  Description of Artificial Sequence: Synthetic peptide
  XENP020531 vlCDR1
KASQSVDYDGDSYMN

SEQ ID NO: 23679 - protein, 7 aa, Artificial Sequence
  Description of Artificial Sequence: Synthetic peptide
  XENP020531 vlCDR2
AASNLES

SEQ ID NO: 23680 - protein, 9 aa, Artificial Sequence
  Description of Artificial Sequence: Synthetic peptide
  XENP020531 vlCDR3
QQSNEDPFT

SEQ ID NO: 23681 - protein, 450 aa, Artificial Sequence
  Description of Artificial Sequence: Synthetic polypeptide
  XENP020532 7G8_H0.80_L0_IgG1_PVA_/S267K Heavy Chain
EVKLEESGGGLVQPGGSMKLSCAASGFTFSDAWMDWVRQSPEKGLEWVAEIRTKANYHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 23682 - protein, 121 aa, Artificial Sequence
  Description of Artificial Sequence: Synthetic polypeptide
  VH of XENP020532
EVKLEESGGGLVQPGGSMKLSCAASGFTFSDAWMDWVRQSPEKGLEWVAEIRTKANYHATYYAESVKGRFTISRDDSKSSVYLQMNSLRAEDTGIYYCTRLANWDWYFDVWGAGTTVTVSS

SEQ ID NO: 23683 - protein, 5 aa, Artificial Sequence
  Description of Artificial Sequence: Synthetic peptide
  XENP020532 vhCDR1
DAWMD

SEQ ID NO: 23684 - protein, 19 aa, Artificial Sequence
  Description of Artificial Sequence: Synthetic peptide
  XENP020532 vhCDR2
EIRTKANYHATYYAESVKG

SEQ ID NO: 23685 - protein, 10 aa, Artificial Sequence
  Description of Artificial Sequence: Synthetic peptide
  XENP020532 vhCDR3
LANWDWYFDV

SEQ ID NO: 23686 - protein, 218 aa, Artificial Sequence; identical to SEQ ID NO: 22266
  Description of Artificial Sequence: Synthetic polypeptide
  XENP020532 7G8_H0.80_L0_IgG1_PVA_/S267K Light Chain

SEQ ID NO: 23687 - protein, 111 aa, Artificial Sequence; identical to SEQ ID NO: 22267
  Description of Artificial Sequence: Synthetic polypeptide
  VL of XENP020532

SEQ ID NO: 23688 - protein, 15 aa, Artificial Sequence
  Description of Artificial Sequence: Synthetic peptide
  XENP020532 vlCDR1
KASQSVDYDGDSYMN

SEQ ID NO: 23689 - protein, 7 aa, Artificial Sequence
  Description of Artificial Sequence: Synthetic peptide
  XENP020532 vlCDR2
AASNLES

SEQ ID NO: 23690 - protein, 9 aa, Artificial Sequence
  Description of Artificial Sequence: Synthetic peptide
  XENP020532 vlCDR3
QQSNEDPFT

SEQ ID NO: 23691 - protein, 450 aa, Artificial Sequence
  Description of Artificial Sequence: Synthetic polypeptide
  XENP020533 7G8_H0.81_L0_IgG1_PVA_/S267K Heavy Chain
EVKLEESGGGLVQPGGSMKLSCAASGFTFSDAWMDWVRQSPEKGLEWVAEIRTKANNYATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 23692 - protein, 121 aa, Artificial Sequence
  Description of Artificial Sequence: Synthetic polypeptide
  VH of XENP020533
EVKLEESGGGLVQPGGSMKLSCAASGFTFSDAWMDWVRQSPEKGLEWVAEIRTKANNYATYYAESVKGRFTISRDDSKSSVYLQMNSLRAEDTGIYYCTRLANWDWYFDVWGAGTTVTVSS

SEQ ID NO: 23693 - protein, 5 aa, Artificial Sequence
  Description of Artificial Sequence: Synthetic peptide
  XENP020533 vhCDR1
DAWMD

SEQ ID NO: 23694 - protein, 19 aa, Artificial Sequence
  Description of Artificial Sequence: Synthetic peptide
  XENP020533 vhCDR2
EIRTKANNYATYYAESVKG

SEQ ID NO: 23695 - protein, 10 aa, Artificial Sequence
  Description of Artificial Sequence: Synthetic peptide
  XENP020533 vhCDR3
LANWDWYFDV

SEQ ID NO: 23696 - protein, 218 aa, Artificial Sequence; identical to SEQ ID NO: 22266
  Description of Artificial Sequence: Synthetic polypeptide
  XENP020533 7G8_H0.81_L0_IgG1_PVA_/S267K Light Chain

SEQ ID NO: 23697 - protein, 111 aa, Artificial Sequence; identical to SEQ ID NO: 22267
  Description of Artificial Sequence: Synthetic polypeptide
  VL of XENP020533

SEQ ID NO: 23698 - protein, 15 aa, Artificial Sequence
  Description of Artificial Sequence: Synthetic peptide
  XENP020533 vlCDR1
KASQSVDYDGDSYMN

SEQ ID NO: 23699 - protein, 7 aa, Artificial Sequence
  Description of Artificial Sequence: Synthetic peptide
  XENP020533 vlCDR2
AASNLES

SEQ ID NO: 23700 - protein, 9 aa, Artificial Sequence
  Description of Artificial Sequence: Synthetic peptide
  XENP020533 vlCDR3
QQSNEDPFT

SEQ ID NO: 23701 - protein, 450 aa, Artificial Sequence
  Description of Artificial Sequence: Synthetic polypeptide
  XENP020534 7G8_H0.82_L0_IgG1_PVA_/S267K Heavy Chain
EVKLEESGGGLVQPGGSMKLSCAASGFTFSDAWMDWVRQSPEKGLEWVAEIRTKANNQATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 23702 - protein, 121 aa, Artificial Sequence
  Description of Artificial Sequence: Synthetic polypeptide
  VH of XENP020534
EVKLEESGGGLVQPGGSMKLSCAASGFTFSDAWMDWVRQSPEKGLEWVAEIRTKANNQATYYAESVKGRFTISRDDSKSSVYLQMNSLRAEDTGIYYCTRLANWDWYFDVWGAGTTVTVSS

SEQ ID NO: 23703 - protein, 5 aa, Artificial Sequence
  Description of Artificial Sequence: Synthetic peptide
  XENP020534 vhCDR1
DAWMD

SEQ ID NO: 23704 - protein, 19 aa, Artificial Sequence
  Description of Artificial Sequence: Synthetic peptide
  XENP020534 vhCDR2
EIRTKANNQATYYAESVKG

SEQ ID NO: 23705 - protein, 10 aa, Artificial Sequence
  Description of Artificial Sequence: Synthetic peptide
  XENP020534 vhCDR3
LANWDWYFDV

SEQ ID NO: 23706 - protein, 218 aa, Artificial Sequence; identical to SEQ ID NO: 22266
  Description of Artificial Sequence: Synthetic polypeptide
  XENP020534 7G8_H0.82_L0_IgG1_PVA_/S267K Light Chain

SEQ ID NO: 23707 - protein, 111 aa, Artificial Sequence; identical to SEQ ID NO: 22267
  Description of Artificial Sequence: Synthetic polypeptide
  VL of XENP020534

SEQ ID NO: 23708 - protein, 15 aa, Artificial Sequence
  Description of Artificial Sequence: Synthetic peptide
  XENP020534 vlCDR1
KASQSVDYDGDSYMN

SEQ ID NO: 23709 - protein, 7 aa, Artificial Sequence
  Description of Artificial Sequence: Synthetic peptide
  XENP020534 vlCDR2
AASNLES

SEQ ID NO: 23710 - protein, 9 aa, Artificial Sequence
  Description of Artificial Sequence: Synthetic peptide
  XENP020534 vlCDR3
QQSNEDPFT

SEQ ID NO: 23711 - protein, 450 aa, Artificial Sequence
  Description of Artificial Sequence: Synthetic polypeptide
  XENP020535 7G8_H0.83_L0_IgG1_PVA_/S267K Heavy Chain
EVKLEESGGGLVQPGGSMKLSCAASGFTFSDAWMDWVRQSPEKGLEWVAEIRTKANNDATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 23712 - protein, 121 aa, Artificial Sequence
  Description of Artificial Sequence: Synthetic polypeptide
  VH of XENP020535
EVKLEESGGGLVQPGGSMKLSCAASGFTFSDAWMDWVRQSPEKGLEWVAEIRTKANNDATYYAESVKGRFTISRDDSKSSVYLQMNSLRAEDTGIYYCTRLANWDWYFDVWGAGTTVTVSS

SEQ ID NO: 23713 - protein, 5 aa, Artificial Sequence
  Description of Artificial Sequence: Synthetic peptide
  XENP020535 vhCDR1
DAWMD

SEQ ID NO: 23714 - protein, 19 aa, Artificial Sequence
  Description of Artificial Sequence: Synthetic peptide
  XENP020535 vhCDR2
EIRTKANNDATYYAESVKG

SEQ ID NO: 23715 - protein, 10 aa, Artificial Sequence
  Description of Artificial Sequence: Synthetic peptide
  XENP020535 vhCDR3
LANWDWYFDV

SEQ ID NO: 23716 - protein, 218 aa, Artificial Sequence; identical to SEQ ID NO: 22266
  Description of Artificial Sequence: Synthetic polypeptide
  XENP020535 7G8_H0.83_L0_IgG1_PVA_/S267K Light Chain

SEQ ID NO: 23717 - protein, 111 aa, Artificial Sequence; identical to SEQ ID NO: 22267
  Description of Artificial Sequence: Synthetic polypeptide
  VL of XENP020535

SEQ ID NO: 23718 - protein, 15 aa, Artificial Sequence
  Description of Artificial Sequence: Synthetic peptide
  XENP020535 vlCDR1
KASQSVDYDGDSYMN

SEQ ID NO: 23719 - protein, 7 aa, Artificial Sequence
  Description of Artificial Sequence: Synthetic peptide
  XENP020535 vlCDR2
AASNLES

SEQ ID NO: 23720 - protein, 9 aa, Artificial Sequence
  Description of Artificial Sequence: Synthetic peptide
  XENP020535 vlCDR3
QQSNEDPFT

SEQ ID NO: 23721 - protein, 450 aa, Artificial Sequence
  Description of Artificial Sequence: Synthetic polypeptide
  XENP020536 7G8_H0.84_L0_IgG1_PVA_/S267K Heavy Chain
EVKLEESGGGLVQPGGSMKLSCAASGFTFSDAWMDWVRQSPEKGLEWVAEIRTKANNFATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 23722 - protein, 121 aa, Artificial Sequence
  Description of Artificial Sequence: Synthetic polypeptide
  VH of XENP020536
EVKLEESGGGLVQPGGSMKLSCAASGFTFSDAWMDWVRQSPEKGLEWVAEIRTKANNFATYYAESVKGRFTISRDDSKSSVYLQMNSLRAEDTGIYYCTRLANWDWYFDVWGAGTTVTVSS

SEQ ID NO: 23723 - protein, 5 aa, Artificial Sequence
  Description of Artificial Sequence: Synthetic peptide
  XENP020536 vhCDR1
DAWMD

SEQ ID NO: 23724 - protein, 19 aa, Artificial Sequence
  Description of Artificial Sequence: Synthetic peptide
  XENP020536 vhCDR2
EIRTKANNFATYYAESVKG

SEQ ID NO: 23725 - protein, 10 aa, Artificial Sequence
  Description of Artificial Sequence: Synthetic peptide
  XENP020536 vhCDR3
LANWDWYFDV

SEQ ID NO: 23726 - protein, 218 aa, Artificial Sequence; identical to SEQ ID NO: 22266
  Description of Artificial Sequence: Synthetic polypeptide
  XENP020536 7G8_H0.84_L0_IgG1_PVA_/S267K Light Chain

SEQ ID NO: 23727 - protein, 111 aa, Artificial Sequence; identical to SEQ ID NO: 22267
  Description of Artificial Sequence: Synthetic polypeptide
  VL of XENP020536

SEQ ID NO: 23728 - protein, 15 aa, Artificial Sequence
  Description of Artificial Sequence: Synthetic peptide
  XENP020536 vlCDR1
KASQSVDYDGDSYMN

SEQ ID NO: 23729 - protein, 7 aa, Artificial Sequence
  Description of Artificial Sequence: Synthetic peptide
  XENP020536 vlCDR2
AASNLES

SEQ ID NO: 23730 - protein, 9 aa, Artificial Sequence
  Description of Artificial Sequence: Synthetic peptide
  XENP020536 vlCDR3
QQSNEDPFT

SEQ ID NO: 23731 - protein, 450 aa, Artificial Sequence
  Description of Artificial Sequence: Synthetic polypeptide
  XENP020537 7G8_H0.85_L0_IgG1_PVA_/S267K Heavy Chain
EVKLEESGGGLVQPGGSMKLSCAASGFTFSDAWMDWVRQSPEKGLEWVAEIRTKANNAATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 23732 - protein, 121 aa, Artificial Sequence
  Description of Artificial Sequence: Synthetic polypeptide
  VH of XENP020537
EVKLEESGGGLVQPGGSMKLSCAASGFTFSDAWMDWVRQSPEKGLEWVAEIRTKANNAATYYAESVKGRFTISRDDSKSSVYLQMNSLRAEDTGIYYCTRLANWDWYFDVWGAGTTVTVSS

SEQ ID NO: 23733 - protein, 5 aa, Artificial Sequence
  Description of Artificial Sequence: Synthetic peptide
  XENP020537 vhCDR1
DAWMD

SEQ ID NO: 23734 - protein, 19 aa, Artificial Sequence
  Description of Artificial Sequence: Synthetic peptide
  XENP020537 vhCDR2
EIRTKANNAATYYAESVKG

SEQ ID NO: 23735 - protein, 10 aa, Artificial Sequence
  Description of Artificial Sequence: Synthetic peptide
  XENP020537 vhCDR3
LANWDWYFDV

SEQ ID NO: 23736 - protein, 218 aa, Artificial Sequence; identical to SEQ ID NO: 22266
  Description of Artificial Sequence: Synthetic polypeptide
  XENP020537 7G8_H0.85_L0_IgG1_PVA_/S267K Light Chain

SEQ ID NO: 23737 - protein, 111 aa, Artificial Sequence; identical to SEQ ID NO: 22267
  Description of Artificial Sequence: Synthetic polypeptide
  VL of XENP020537

SEQ ID NO: 23738 - protein, 15 aa, Artificial Sequence
  Description of Artificial Sequence: Synthetic peptide
  XENP020537 vlCDR1
KASQSVDYDGDSYMN

SEQ ID NO: 23739 - protein, 7 aa, Artificial Sequence
  Description of Artificial Sequence: Synthetic peptide
  XENP020537 vlCDR2
AASNLES

SEQ ID NO: 23740 - protein, 9 aa, Artificial Sequence
  Description of Artificial Sequence: Synthetic peptide
  XENP020537 vlCDR3
QQSNEDPFT

SEQ ID NO: 23741 - protein, 450 aa, Artificial Sequence
  Description of Artificial Sequence: Synthetic polypeptide
  XENP020538 7G8_H0.86_L0_IgG1_PVA_/S267K Heavy Chain
EVKLEESGGGLVQPGGSMKLSCAASGFTFSDAWMDWVRQSPEKGLEWVAEIRTKANNKATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 23742 - protein, 121 aa, Artificial Sequence
  Description of Artificial Sequence: Synthetic polypeptide
  VH of XENP020538
EVKLEESGGGLVQPGGSMKLSCAASGFTFSDAWMDWVRQSPEKGLEWVAEIRTKANNKATYYAESVKGRFTISRDDSKSSVYLQMNSLRAEDTGIYYCTRLANWDWYFDVWGAGTTVTVSS

SEQ ID NO: 23743 - protein, 5 aa, Artificial Sequence
  Description of Artificial Sequence: Synthetic peptide
  XENP020538 vhCDR1
DAWMD

SEQ ID NO: 23744 - protein, 19 aa, Artificial Sequence
  Description of Artificial Sequence: Synthetic peptide
  XENP020538 vhCDR2
EIRTKANNKATYYAESVKG

SEQ ID NO: 23745 - protein, 10 aa, Artificial Sequence
  Description of Artificial Sequence: Synthetic peptide
  XENP020538 vhCDR3
LANWDWYFDV

SEQ ID NO: 23746 - protein, 218 aa, Artificial Sequence; identical to SEQ ID NO: 22266
  Description of Artificial Sequence: Synthetic polypeptide
  XENP020538 7G8_H0.86_L0_IgG1_PVA_/S267K Light Chain

SEQ ID NO: 23747 - protein, 111 aa, Artificial Sequence; identical to SEQ ID NO: 22267
  Description of Artificial Sequence: Synthetic polypeptide
  VL of XENP020538

SEQ ID NO: 23748 - protein, 15 aa, Artificial Sequence
  Description of Artificial Sequence: Synthetic peptide
  XENP020538 vlCDR1
KASQSVDYDGDSYMN

SEQ ID NO: 23749 - protein, 7 aa, Artificial Sequence
  Description of Artificial Sequence: Synthetic peptide
  XENP020538 vlCDR2
AASNLES

SEQ ID NO: 23750 - protein, 9 aa, Artificial Sequence
  Description of Artificial Sequence: Synthetic peptide
  XENP020538 vlCDR3
QQSNEDPFT

SEQ ID NO: 23751 - protein, 450 aa, Artificial Sequence
  Description of Artificial Sequence: Synthetic polypeptide
  XENP020539 7G8_H0.87_L0_IgG1_PVA_/S267K Heavy Chain
EVKLEESGGGLVQPGGSMKLSCAASGFTFSDAWMDWVRQSPEKGLEWVAEIRTKANNGATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 23752 - protein, 121 aa, Artificial Sequence
  Description of Artificial Sequence: Synthetic polypeptide
  VH of XENP020539
EVKLEESGGGLVQPGGSMKLSCAASGFTFSDAWMDWVRQSPEKGLEWVAEIRTKANNGATYYAESVKGRFTISRDDSKSSVYLQMNSLRAEDTGIYYCTRLANWDWYFDVWGAGTTVTVSS

SEQ ID NO: 23753 - protein, 5 aa, Artificial Sequence
  Description of Artificial Sequence: Synthetic peptide
  XENP020539 vhCDR1
DAWMD

SEQ ID NO: 23754 - protein, 19 aa, Artificial Sequence
  Description of Artificial Sequence: Synthetic peptide
  XENP020539 vhCDR2
EIRTKANNGATYYAESVKG

SEQ ID NO: 23755 - protein, 10 aa, Artificial Sequence
  Description of Artificial Sequence: Synthetic peptide
  XENP020539 vhCDR3
LANWDWYFDV

SEQ ID NO: 23756 - protein, 218 aa, Artificial Sequence; identical to SEQ ID NO: 22266
  Description of Artificial Sequence: Synthetic polypeptide
  XENP020539 7G8_H0.87_L0_IgG1_PVA_/S267K Light Chain

SEQ ID NO: 23757 - protein, 111 aa, Artificial Sequence; identical to SEQ ID NO: 22267
  Description of Artificial Sequence: Synthetic polypeptide
  VL of XENP020539

SEQ ID NO: 23758 - protein, 15 aa, Artificial Sequence
  Description of Artificial Sequence: Synthetic peptide
  XENP020539 vlCDR1
KASQSVDYDGDSYMN

SEQ ID NO: 23759 - protein, 7 aa, Artificial Sequence
  Description of Artificial Sequence: Synthetic peptide
  XENP020539 vlCDR2
AASNLES

SEQ ID NO: 23760 - protein, 9 aa, Artificial Sequence
  Description of Artificial Sequence: Synthetic peptide
  XENP020539 vlCDR3
QQSNEDPFT

SEQ ID NO: 23761 - protein, 450 aa, Artificial Sequence
  Description of Artificial Sequence: Synthetic polypeptide
  XENP020540 7G8_H0.88_L0_IgG1_PVA_/S267K Heavy Chain
EVKLEESGGGLVQPGGSMKLSCAASGFTFSDAWMDWVRQSPEKGLEWVAEIRTKANNLATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 23762 - protein, 121 aa, Artificial Sequence
  Description of Artificial Sequence: Synthetic polypeptide
  VH of XENP020540
EVKLEESGGGLVQPGGSMKLSCAASGFTFSDAWMDWVRQSPEKGLEWVAEIRTKANNLATYYAESVKGRFTISRDDSKSSVYLQMNSLRAEDTGIYYCTRLANWDWYFDVWGAGTTVTVSS

SEQ ID NO: 23763 - protein, 5 aa, Artificial Sequence
  Description of Artificial Sequence: Synthetic peptide
  XENP020540 vhCDR1
DAWMD

SEQ ID NO: 23764 - protein, 19 aa, Artificial Sequence
  Description of Artificial Sequence: Synthetic peptide
  XENP020540 vhCDR2
EIRTKANNLATYYAESVKG

SEQ ID NO: 23765 - protein, 10 aa, Artificial Sequence
  Description of Artificial Sequence: Synthetic peptide
  XENP020540 vhCDR3
LANWDWYFDV

SEQ ID NO: 23766 - protein, 218 aa, Artificial Sequence; identical to SEQ ID NO: 22266
  Description of Artificial Sequence: Synthetic polypeptide
  XENP020540 7G8_H0.88_L0_IgG1_PVA_/S267K Light Chain

SEQ ID NO: 23767 - protein, 111 aa, Artificial Sequence; identical to SEQ ID NO: 22267
  Description of Artificial Sequence: Synthetic polypeptide
  VL of XENP020540

SEQ ID NO: 23768 - protein, 15 aa, Artificial Sequence
  Description of Artificial Sequence: Synthetic peptide
  XENP020540 vlCDR1
KASQSVDYDGDSYMN

SEQ ID NO: 23769 - protein, 7 aa, Artificial Sequence
  Description of Artificial Sequence: Synthetic peptide
  XENP020540 vlCDR2
AASNLES

SEQ ID NO: 23770 - protein, 9 aa, Artificial Sequence
  Description of Artificial Sequence: Synthetic peptide
  XENP020540 vlCDR3
QQSNEDPFT

SEQ ID NO: 23771 - protein, 450 aa, Artificial Sequence
  Description of Artificial Sequence: Synthetic polypeptide
  XENP020541 7G8_H0.89_L0_IgG1_PVA_/S267K Heavy Chain
EVKLEESGGGLVQPGGSMKLSCAASGFTFSDAWMDWVRQSPEKGLEWVAEIRTKANNHGTYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 23772 - protein, 121 aa, Artificial Sequence
  Description of Artificial Sequence: Synthetic polypeptide
  VH of XENP020541
EVKLEESGGGLVQPGGSMKLSCAASGFTFSDAWMDWVRQSPEKGLEWVAEIRTKANNHGTYYAESVKGRFTISRDDSKSSVYLQMNSLRAEDTGIYYCTRLANWDWYFDVWGAGTTVTVSS

SEQ ID NO: 23773 - protein, 5 aa, Artificial Sequence
  Description of Artificial Sequence: Synthetic peptide
  XENP020541 vhCDR1
DAWMD

SEQ ID NO: 23774 - protein, 19 aa, Artificial Sequence
  Description of Artificial Sequence: Synthetic peptide
  XENP020541 vhCDR2
EIRTKANNHGTYYAESVKG

SEQ ID NO: 23775 - protein, 10 aa, Artificial Sequence
  Description of Artificial Sequence: Synthetic peptide
  XENP020541 vhCDR3
LANWDWYFDV

SEQ ID NO: 23776 - protein, 218 aa, Artificial Sequence; identical to SEQ ID NO: 22266
  Description of Artificial Sequence: Synthetic polypeptide
  XENP020541 7G8_H0.89_L0_IgG1_PVA_/S267K Light Chain

SEQ ID NO: 23777 - protein, 111 aa, Artificial Sequence; identical to SEQ ID NO: 22267
  Description of Artificial Sequence: Synthetic polypeptide
  VL of XENP020541

SEQ ID NO: 23778 - protein, 15 aa, Artificial Sequence
  Description of Artificial Sequence: Synthetic peptide
  XENP020541 vlCDR1
KASQSVDYDGDSYMN

SEQ ID NO: 23779 - protein, 7 aa, Artificial Sequence
  Description of Artificial Sequence: Synthetic peptide
  XENP020541 vlCDR2
AASNLES

SEQ ID NO: 23780 - protein, 9 aa, Artificial Sequence
  Description of Artificial Sequence: Synthetic peptide
  XENP020541 vlCDR3
QQSNEDPFT

SEQ ID NO: 23781 - protein, 450 aa, Artificial Sequence
  Description of Artificial Sequence: Synthetic polypeptide
  XENP020542 7G8_H0.90_L0_IgG1_PVA_/S267K Heavy Chain
EVKLEESGGGLVQPGGSMKLSCAASGFTFSDAWMDWVRQSPEKGLEWVAEIRTKANNHHTYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 23782 - protein, 121 aa, Artificial Sequence
  Description of Artificial Sequence: Synthetic polypeptide
  VH of XENP020542
EVKLEESGGGLVQPGGSMKLSCAASGFTFSDAWMDWVRQSPEKGLEWVAEIRTKANNHHTYYAESVKGRFTISRDDSKSSVYLQMNSLRAEDTGIYYCTRLANWDWYFDVWGAGTTVTVSS

SEQ ID NO: 23783 - protein, 5 aa, Artificial Sequence
  Description of Artificial Sequence: Synthetic peptide
  XENP020542 vhCDR1
DAWMD

SEQ ID NO: 23784 - protein, 19 aa, Artificial Sequence
  Description of Artificial Sequence: Synthetic peptide
  XENP020542 vhCDR2
EIRTKANNHHTYYAESVKG

SEQ ID NO: 23785 - protein, 10 aa, Artificial Sequence
  Description of Artificial Sequence: Synthetic peptide
  XENP020542 vhCDR3
LANWDWYFDV

SEQ ID NO: 23786 - protein, 218 aa, Artificial Sequence; identical to SEQ ID NO: 22266
  Description of Artificial Sequence: Synthetic polypeptide
  XENP020542 7G8_H0.90_L0_IgG1_PVA_/S267K Light Chain

SEQ ID NO: 23787 - protein, 111 aa, Artificial Sequence; identical to SEQ ID NO: 22267
  Description of Artificial Sequence: Synthetic polypeptide
  VL of XENP020542

SEQ ID NO: 23788 - protein, 15 aa, Artificial Sequence
  Description of Artificial Sequence: Synthetic peptide
  XENP020542 vlCDR1
KASQSVDYDGDSYMN

SEQ ID NO: 23789 - protein, 7 aa, Artificial Sequence
  Description of Artificial Sequence: Synthetic peptide
  XENP020542 vlCDR2
AASNLES

SEQ ID NO: 23790 - protein, 9 aa, Artificial Sequence
  Description of Artificial Sequence: Synthetic peptide
  XENP020542 vlCDR3
QQSNEDPFT

SEQ ID NO: 23791 - protein, 450 aa, Artificial Sequence
  Description of Artificial Sequence: Synthetic polypeptide
  XENP020543 7G8_H0.91_L0_IgG1_PVA_/S267K Heavy Chain
EVKLEESGGGLVQPGGSMKLSCAASGFTFSDAWMDWVRQSPEKGLEWVAEIRTKANNHQTYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 23792 - protein, 121 aa, Artificial Sequence
  Description of Artificial Sequence: Synthetic polypeptide
  VH of XENP020543
EVKLEESGGGLVQPGGSMKLSCAASGFTFSDAWMDWVRQSPEKGLEWVAEIRTKANNHQTYYAESVKGRFTISRDDSKSSVYLQMNSLRAEDTGIYYCTRLANWDWYFDVWGAGTTVTVSS

SEQ ID NO: 23793 - protein, 5 aa, Artificial Sequence
  Description of Artificial Sequence: Synthetic peptide
  XENP020543 vhCDR1
DAWMD

SEQ ID NO: 23794 - protein, 19 aa, Artificial Sequence
  Description of Artificial Sequence: Synthetic peptide
  XENP020543 vhCDR2
EIRTKANNHQTYYAESVKG

SEQ ID NO: 23795 - protein, 10 aa, Artificial Sequence
  Description of Artificial Sequence: Synthetic peptide
  XENP020543 vhCDR3
LANWDWYFDV

SEQ ID NO: 23796 - protein, 218 aa, Artificial Sequence; identical to SEQ ID NO: 22266
  Description of Artificial Sequence: Synthetic polypeptide
  XENP020543 7G8_H0.91_L0_IgG1_PVA_/S267K Light Chain

SEQ ID NO: 23797 - protein, 111 aa, Artificial Sequence; identical to SEQ ID NO: 22267
  Description of Artificial Sequence: Synthetic polypeptide
  VL of XENP020543

SEQ ID NO: 23798 - protein, 15 aa, Artificial Sequence
  Description of Artificial Sequence: Synthetic peptide
  XENP020543 vlCDR1
KASQSVDYDGDSYMN

SEQ ID NO: 23799 - protein, 7 aa, Artificial Sequence
  Description of Artificial Sequence: Synthetic peptide
  XENP020543 vlCDR2
AASNLES

SEQ ID NO: 23800 - protein, 9 aa, Artificial Sequence
  Description of Artificial Sequence: Synthetic peptide
  XENP020543 vlCDR3
QQSNEDPFT

SEQ ID NO: 23801 - protein, 450 aa, Artificial Sequence
  Description of Artificial Sequence: Synthetic polypeptide
  XENP020544 7G8_H0.92_L0_IgG1_PVA_/S267K Heavy Chain
EVKLEESGGGLVQPGGSMKLSCAASGFTFSDAWMDWVRQSPEKGLEWVAEIRTKANNHDTYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 23802 - protein, 121 aa, Artificial Sequence
  Description of Artificial Sequence: Synthetic polypeptide
  VH of XENP020544
EVKLEESGGGLVQPGGSMKLSCAASGFTFSDAWMDWVRQSPEKGLEWVAEIRTKANNHDTYYAESVKGRFTISRDDSKSSVYLQMNSLRAEDTGIYYCTRLANWDWYFDVWGAGTTVTVSS

SEQ ID NO: 23803 - protein, 5 aa, Artificial Sequence
  Description of Artificial Sequence: Synthetic peptide
  XENP020544 vhCDR1
DAWMD

SEQ ID NO: 23804 - protein, 19 aa, Artificial Sequence
  Description of Artificial Sequence: Synthetic peptide
  XENP020544 vhCDR2
EIRTKANNHDTYYAESVKG

SEQ ID NO: 23805 - protein, 10 aa, Artificial Sequence
  Description of Artificial Sequence: Synthetic peptide
  XENP020544 vhCDR3
LANWDWYFDV

SEQ ID NO: 23806 - protein, 218 aa, Artificial Sequence; identical to SEQ ID NO: 22266
  Description of Artificial Sequence: Synthetic polypeptide
  XENP020544 7G8_H0.92_L0_IgG1_PVA_/S267K Light Chain

SEQ ID NO: 23807 - protein, 111 aa, Artificial Sequence; identical to SEQ ID NO: 22267
  Description of Artificial Sequence: Synthetic polypeptide
  VL of XENP020544

SEQ ID NO: 23808 - protein, 15 aa, Artificial Sequence
  Description of Artificial Sequence: Synthetic peptide
  XENP020544 vlCDR1
KASQSVDYDGDSYMN

SEQ ID NO: 23809 - protein, 7 aa, Artificial Sequence
  Description of Artificial Sequence: Synthetic peptide
  XENP020544 vlCDR2
AASNLES

SEQ ID NO: 23810 - protein, 9 aa, Artificial Sequence
  Description of Artificial Sequence: Synthetic peptide
  XENP020544 vlCDR3
QQSNEDPFT

SEQ ID NO: 23811 - protein, 450 aa, Artificial Sequence
  Description of Artificial Sequence: Synthetic polypeptide
  XENP020545 7G8_H0.93_L0_IgG1_PVA_/S267K Heavy Chain
EVKLEESGGGLVQPGGSMKLSCAASGFTFSDAWMDWVRQSPEKGLEWVAEIRTKANNHLTYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 23812 - protein, 121 aa, Artificial Sequence
  Description of Artificial Sequence: Synthetic polypeptide
  VH of XENP020545
EVKLEESGGGLVQPGGSMKLSCAASGFTFSDAWMDWVRQSPEKGLEWVAEIRTKANNHLTYYAESVKGRFTISRDDSKSSVYLQMNSLRAEDTGIYYCTRLANWDWYFDVWGAGTTVTVSS

SEQ ID NO: 23813 - protein, 5 aa, Artificial Sequence
  Description of Artificial Sequence: Synthetic peptide
  XENP020545 vhCDR1
DAWMD

SEQ ID NO: 23814 - protein, 19 aa, Artificial Sequence
  Description of Artificial Sequence: Synthetic peptide
  XENP020545 vhCDR2
EIRTKANNHLTYYAESVKG

SEQ ID NO: 23815 - protein, 10 aa, Artificial Sequence
  Description of Artificial Sequence: Synthetic peptide
  XENP020545 vhCDR3
LANWDWYFDV

SEQ ID NO: 23816 - protein, 218 aa, Artificial Sequence; identical to SEQ ID NO: 22266
  Description of Artificial Sequence: Synthetic polypeptide
  XENP020545 7G8_H0.93_L0_IgG1_PVA_/S267K Light Chain

SEQ ID NO: 23817 - protein, 111 aa, Artificial Sequence; identical to SEQ ID NO: 22267
  Description of Artificial Sequence: Synthetic polypeptide
  VL of XENP020545

SEQ ID NO: 23818 - protein, 15 aa, Artificial Sequence
  Description of Artificial Sequence: Synthetic peptide
  XENP020545 vlCDR1
KASQSVDYDGDSYMN

SEQ ID NO: 23819 - protein, 7 aa, Artificial Sequence
  Description of Artificial Sequence: Synthetic peptide
  XENP020545 vlCDR2
AASNLES

SEQ ID NO: 23820 - protein, 9 aa, Artificial Sequence
  Description of Artificial Sequence: Synthetic peptide
  XENP020545 vlCDR3
QQSNEDPFT

SEQ ID NO: 23821 - protein, 450 aa, Artificial Sequence
  Description of Artificial Sequence: Synthetic polypeptide
  XENP020546 7G8_H0.94_L0_IgG1_PVA_/S267K Heavy Chain
EVKLEESGGGLVQPGGSMKLSCAASGFTFSDAWMDWVRQSPEKGLEWVAEIRTKANNHKTYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 23822 - protein, 121 aa, Artificial Sequence
  Description of Artificial Sequence: Synthetic polypeptide
  VH of XENP020546
EVKLEESGGGLVQPGGSMKLSCAASGFTFSDAWMDWVRQSPEKGLEWVAEIRTKANNHKTYYAESVKGRFTISRDDSKSSVYLQMNSLRAEDTGIYYCTRLANWDWYFDVWGAGTTVTVSS

SEQ ID NO: 23823 - protein, 5 aa, Artificial Sequence
  Description of Artificial Sequence: Synthetic peptide
  XENP020546 vhCDR1
DAWMD

SEQ ID NO: 23824 - protein, 19 aa, Artificial Sequence
  Description of Artificial Sequence: Synthetic peptide
  XENP020546 vhCDR2
EIRTKANNHKTYYAESVKG

SEQ ID NO: 23825 - protein, 10 aa, Artificial Sequence
  Description of Artificial Sequence: Synthetic peptide
  XENP020546 vhCDR3
LANWDWYFDV

SEQ ID NO: 23826 - protein, 218 aa, Artificial Sequence; identical to SEQ ID NO: 22266
  Description of Artificial Sequence: Synthetic polypeptide
  XENP020546 7G8_H0.94_L0_IgG1_PVA_/S267K Light Chain

SEQ ID NO: 23827 - protein, 111 aa, Artificial Sequence; identical to SEQ ID NO: 22267
  Description of Artificial Sequence: Synthetic polypeptide
  VL of XENP020546

SEQ ID NO: 23828 - protein, 15 aa, Artificial Sequence
  Description of Artificial Sequence: Synthetic peptide
  XENP020546 vlCDR1
KASQSVDYDGDSYMN

SEQ ID NO: 23829 - protein, 7 aa, Artificial Sequence
  Description of Artificial Sequence: Synthetic peptide
  XENP020546 vlCDR2
AASNLES

SEQ ID NO: 23830 - protein, 9 aa, Artificial Sequence
  Description of Artificial Sequence: Synthetic peptide
  XENP020546 vlCDR3
QQSNEDPFT

SEQ ID NO: 23831 - protein, 450 aa, Artificial Sequence
  Description of Artificial Sequence: Synthetic polypeptide
  XENP020547 7G8_H0.95_L0_IgG1_PVA_/S267K Heavy Chain
EVKLEESGGGLVQPGGSMKLSCAASGFTFSDAWMDWVRQSPEKGLEWVAEIRTKANNHYTYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 23832 - protein, 121 aa, Artificial Sequence
  Description of Artificial Sequence: Synthetic polypeptide
  VH of XENP020547
EVKLEESGGGLVQPGGSMKLSCAASGFTFSDAWMDWVRQSPEKGLEWVAEIRTKANNHYTYYAESVKGRFTISRDDSKSSVYLQMNSLRAEDTGIYYCTRLANWDWYFDVWGAGTTVTVSS

SEQ ID NO: 23833 - protein, 5 aa, Artificial Sequence
  Description of Artificial Sequence: Synthetic peptide
  XENP020547 vhCDR1
DAWMD

SEQ ID NO: 23834 - protein, 19 aa, Artificial Sequence
  Description of Artificial Sequence: Synthetic peptide
  XENP020547 vhCDR2
EIRTKANNHYTYYAESVKG

SEQ ID NO: 23835 - protein, 10 aa, Artificial Sequence
  Description of Artificial Sequence: Synthetic peptide
  XENP020547 vhCDR3
LANWDWYFDV

SEQ ID NO: 23836 - protein, 218 aa, Artificial Sequence; identical to SEQ ID NO: 22266
  Description of Artificial Sequence: Synthetic polypeptide
  XENP020547 7G8_H0.95_L0_IgG1_PVA_/S267K Light Chain

SEQ ID NO: 23837 - protein, 111 aa, Artificial Sequence; identical to SEQ ID NO: 22267
  Description of Artificial Sequence: Synthetic polypeptide
  VL of XENP020547

SEQ ID NO: 23838 - protein, 15 aa, Artificial Sequence
  Description of Artificial Sequence: Synthetic peptide
  XENP020547 vlCDR1
KASQSVDYDGDSYMN

SEQ ID NO: 23839 - protein, 7 aa, Artificial Sequence
  Description of Artificial Sequence: Synthetic peptide
  XENP020547 vlCDR2
AASNLES

SEQ ID NO: 23840 - protein, 9 aa, Artificial Sequence
  Description of Artificial Sequence: Synthetic peptide
  XENP020547 vlCDR3
QQSNEDPFT

SEQ ID NO: 23841 - protein, 450 aa, Artificial Sequence
  Description of Artificial Sequence: Synthetic polypeptide
  XENP020548 7G8_H0.96_L0_IgG1_PVA_/S267K Heavy Chain
EVKLEESGGGLVQPGGSMKLSCAASGFTFSDAWMDWVRQSPEKGLEWVAEIRTKANNHATFYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 23842 - protein, 121 aa, Artificial Sequence
  Description of Artificial Sequence: Synthetic polypeptide
  VH of XENP020548
EVKLEESGGGLVQPGGSMKLSCAASGFTFSDAWMDWVRQSPEKGLEWVAEIRTKANNHATFYAESVKGRFTISRDDSKSSVYLQMNSLRAEDTGIYYCTRLANWDWYFDVWGAGTTVTVSS

SEQ ID NO: 23843 - protein, 5 aa, Artificial Sequence
  Description of Artificial Sequence: Synthetic peptide
  XENP020548 vhCDR1
DAWMD

SEQ ID NO: 23844 - protein, 19 aa, Artificial Sequence
  Description of Artificial Sequence: Synthetic peptide
  XENP020548 vhCDR2
EIRTKANNHATFYAESVKG

SEQ ID NO: 23845 - protein, 10 aa, Artificial Sequence
  Description of Artificial Sequence: Synthetic peptide
  XENP020548 vhCDR3
LANWDWYFDV

SEQ ID NO: 23846 - protein, 218 aa, Artificial Sequence; identical to SEQ ID NO: 22266
  Description of Artificial Sequence: Synthetic polypeptide
  XENP020548 7G8_H0.96_L0_IgG1_PVA_/S267K Light Chain

SEQ ID NO: 23847 - protein, 111 aa, Artificial Sequence; identical to SEQ ID NO: 22267
  Description of Artificial Sequence: Synthetic polypeptide
  VL of XENP020548

SEQ ID NO: 23848 - protein, 15 aa, Artificial Sequence
  Description of Artificial Sequence: Synthetic peptide
  XENP020548 vlCDR1
KASQSVDYDGDSYMN

SEQ ID NO: 23849 - protein, 7 aa, Artificial Sequence
  Description of Artificial Sequence: Synthetic peptide
  XENP020548 vlCDR2
AASNLES

SEQ ID NO: 23850 - protein, 9 aa, Artificial Sequence
  Description of Artificial Sequence: Synthetic peptide
  XENP020548 vlCDR3
QQSNEDPFT

SEQ ID NO: 23851 - protein, 450 aa, Artificial Sequence
  Description of Artificial Sequence: Synthetic polypeptide
  XENP020549 7G8_H0.97_L0_IgG1_PVA_/S267K Heavy Chain
EVKLEESGGGLVQPGGSMKLSCAASGFTFSDAWMDWVRQSPEKGLEWVAEIRTKANNHATHYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 23852 - protein, 121 aa, Artificial Sequence
  Description of Artificial Sequence: Synthetic polypeptide
  VH of XENP020549
EVKLEESGGGLVQPGGSMKLSCAASGFTFSDAWMDWVRQSPEKGLEWVAEIRTKANNHATHYAESVKGRFTISRDDSKSSVYLQMNSLRAEDTGIYYCTRLANWDWYFDVWGAGTTVTVSS

SEQ ID NO: 23853 - protein, 5 aa, Artificial Sequence
  Description of Artificial Sequence: Synthetic peptide
  XENP020549 vhCDR1
DAWMD

SEQ ID NO: 23854 - protein, 19 aa, Artificial Sequence
  Description of Artificial Sequence: Synthetic peptide
  XENP020549 vhCDR2
EIRTKANNHATHYAESVKG

SEQ ID NO: 23855 - protein, 10 aa, Artificial Sequence
  Description of Artificial Sequence: Synthetic peptide
  XENP020549 vhCDR3
LANWDWYFDV

SEQ ID NO: 23856 - protein, 218 aa, Artificial Sequence; identical to SEQ ID NO: 22266
  Description of Artificial Sequence: Synthetic polypeptide
  XENP020549 7G8_H0.97_L0_IgG1_PVA_/S267K Light Chain

SEQ ID NO: 23857 - protein, 111 aa, Artificial Sequence; identical to SEQ ID NO: 22267
  Description of Artificial Sequence: Synthetic polypeptide
  VL of XENP020549

SEQ ID NO: 23858 - protein, 15 aa, Artificial Sequence
  Description of Artificial Sequence: Synthetic peptide
  XENP020549 vlCDR1
KASQSVDYDGDSYMN

SEQ ID NO: 23859 - protein, 7 aa, Artificial Sequence
  Description of Artificial Sequence: Synthetic peptide
  XENP020549 vlCDR2
AASNLES

SEQ ID NO: 23860 - protein, 9 aa, Artificial Sequence
  Description of Artificial Sequence: Synthetic peptide
  XENP020549 vlCDR3
QQSNEDPFT

SEQ ID NO: 23861 - protein, 450 aa, Artificial Sequence
  Description of Artificial Sequence: Synthetic polypeptide
  XENP020550 7G8_H0.98_L0_IgG1_PVA_/S267K Heavy Chain
EVKLEESGGGLVQPGGSMKLSCAASGFTFSDAWMDWVRQSPEKGLEWVAEIRTKANNHATLYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 23862 - protein, 121 aa, Artificial Sequence
  Description of Artificial Sequence: Synthetic polypeptide
  VH of XENP020550
EVKLEESGGGLVQPGGSMKLSCAASGFTFSDAWMDWVRQSPEKGLEWVAEIRTKANNHATLYAESVKGRFTISRDDSKSSVYLQMNSLRAEDTGIYYCTRLANWDWYFDVWGAGTTVTVSS

SEQ ID NO: 23863 - protein, 5 aa, Artificial Sequence
  Description of Artificial Sequence: Synthetic peptide
  XENP020550 vhCDR1
DAWMD

SEQ ID NO: 23864 - protein, 19 aa, Artificial Sequence
  Description of Artificial Sequence: Synthetic peptide
  XENP020550 vhCDR2
EIRTKANNHATLYAESVKG

SEQ ID NO: 23865 - protein, 10 aa, Artificial Sequence
  Description of Artificial Sequence: Synthetic peptide
  XENP020550 vhCDR3
LANWDWYFDV

SEQ ID NO: 23866 - protein, 218 aa, Artificial Sequence; identical to SEQ ID NO: 22266
  Description of Artificial Sequence: Synthetic polypeptide
  XENP020550 7G8_H0.98_L0_IgG1_PVA_/S267K Light Chain

SEQ ID NO: 23867 - protein, 111 aa, Artificial Sequence; identical to SEQ ID NO: 22267
  Description of Artificial Sequence: Synthetic polypeptide
  VL of XENP020550

SEQ ID NO: 23868 - protein, 15 aa, Artificial Sequence
  Description of Artificial Sequence: Synthetic peptide
  XENP020550 vlCDR1
KASQSVDYDGDSYMN

SEQ ID NO: 23869 - protein, 7 aa, Artificial Sequence
  Description of Artificial Sequence: Synthetic peptide
  XENP020550 vlCDR2
AASNLES

SEQ ID NO: 23870 - protein, 9 aa, Artificial Sequence
  Description of Artificial Sequence: Synthetic peptide
  XENP020550 vlCDR3
QQSNEDPFT

SEQ ID NO: 23871 - protein, 450 aa, Artificial Sequence
  Description of Artificial Sequence: Synthetic polypeptide
  XENP020551 7G8_H0.99_L0_IgG1_PVA_/S267K Heavy Chain
EVKLEESGGGLVQPGGSMKLSCAASGFTFSDAWMDWVRQSPEKGLEWVAEIRTKANNHATWYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 23872 - protein, 121 aa, Artificial Sequence
  Description of Artificial Sequence: Synthetic polypeptide
  VH of XENP020551
EVKLEESGGGLVQPGGSMKLSCAASGFTFSDAWMDWVRQSPEKGLEWVAEIRTKANNHATWYAESVKGRFTISRDDSKSSVYLQMNSLRAEDTGIYYCTRLANWDWYFDVWGAGTTVTVSS

SEQ ID NO: 23873 - protein, 5 aa, Artificial Sequence
  Description of Artificial Sequence: Synthetic peptide
  XENP020551 vhCDR1
DAWMD

SEQ ID NO: 23874 - protein, 19 aa, Artificial Sequence
  Description of Artificial Sequence: Synthetic peptide
  XENP020551 vhCDR2
EIRTKANNHATWYAESVKG

SEQ ID NO: 23875 - protein, 10 aa, Artificial Sequence
  Description of Artificial Sequence: Synthetic peptide
  XENP020551 vhCDR3
LANWDWYFDV

SEQ ID NO: 23876 - protein, 218 aa, Artificial Sequence; identical to SEQ ID NO: 22266
  Description of Artificial Sequence: Synthetic polypeptide
  XENP020551 7G8_H0.99_L0_IgG1_PVA_/S267K Light Chain

SEQ ID NO: 23877 - protein, 111 aa, Artificial Sequence; identical to SEQ ID NO: 22267
  Description of Artificial Sequence: Synthetic polypeptide
  VL of XENP020551

SEQ ID NO: 23878 - protein, 15 aa, Artificial Sequence
  Description of Artificial Sequence: Synthetic peptide
  XENP020551 vlCDR1
KASQSVDYDGDSYMN

SEQ ID NO: 23879 - protein, 7 aa, Artificial Sequence
  Description of Artificial Sequence: Synthetic peptide
  XENP020551 vlCDR2
AASNLES

SEQ ID NO: 23880 - protein, 9 aa, Artificial Sequence
  Description of Artificial Sequence: Synthetic peptide
  XENP020551 vlCDR3
QQSNEDPFT

SEQ ID NO: 23881 - protein, 450 aa, Artificial Sequence
  Description of Artificial Sequence: Synthetic polypeptide
  XENP020552 7G8_H0.100_L0_IgG1_PVA_/S267K Heavy Chain
EVKLEESGGGLVQPGGSMKLSCAASGFTFSDAWMDWVRQSPEKGLEWVAEIRTKANNHATVYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 23882 - protein, 121 aa, Artificial Sequence
  Description of Artificial Sequence: Synthetic polypeptide
  VH of XENP020552
EVKLEESGGGLVQPGGSMKLSCAASGFTFSDAWMDWVRQSPEKGLEWVAEIRTKANNHATVYAESVKGRFTISRDDSKSSVYLQMNSLRAEDTGIYYCTRLANWDWYFDVWGAGTTVTVSS

SEQ ID NO: 23883 - protein, 5 aa, Artificial Sequence
  Description of Artificial Sequence: Synthetic peptide
  XENP020552 vhCDR1
DAWMD

SEQ ID NO: 23884 - protein, 19 aa, Artificial Sequence
  Description of Artificial Sequence: Synthetic peptide
  XENP020552 vhCDR2
EIRTKANNHATVYAESVKG

SEQ ID NO: 23885 - protein, 10 aa, Artificial Sequence
  Description of Artificial Sequence: Synthetic peptide
  XENP020552 vhCDR3
LANWDWYFDV

SEQ ID NO: 23886 - protein, 218 aa, Artificial Sequence; identical to SEQ ID NO: 22266
  Description of Artificial Sequence: Synthetic polypeptide
  XENP020552 7G8_H0.100_L0_IgG1_PVA_/S267K Light Chain

SEQ ID NO: 23887 - protein, 111 aa, Artificial Sequence; identical to SEQ ID NO: 22267
  Description of Artificial Sequence: Synthetic polypeptide
  VL of XENP020552

SEQ ID NO: 23888 - protein, 15 aa, Artificial Sequence
  Description of Artificial Sequence: Synthetic peptide
  XENP020552 vlCDR1
KASQSVDYDGDSYMN

SEQ ID NO: 23889 - protein, 7 aa, Artificial Sequence
  Description of Artificial Sequence: Synthetic peptide
  XENP020552 vlCDR2
AASNLES

SEQ ID NO: 23890 - protein, 9 aa, Artificial Sequence
  Description of Artificial Sequence: Synthetic peptide
  XENP020552 vlCDR3
QQSNEDPFT

SEQ ID NO: 23891 - protein, 450 aa, Artificial Sequence
  Description of Artificial Sequence: Synthetic polypeptide
  XENP020553 7G8_H0.101_L0_IgG1_PVA_/S267K Heavy Chain
EVKLEESGGGLVQPGGSMKLSCAASGFTFSDAWMDWVRQSPEKGLEWVAEIRTKANNHATAYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 23892 - protein, 121 aa, Artificial Sequence
  Description of Artificial Sequence: Synthetic polypeptide
  VH of XENP020553
EVKLEESGGGLVQPGGSMKLSCAASGFTFSDAWMDWVRQSPEKGLEWVAEIRTKANNHATAYAESVKGRFTISRDDSKSSVYLQMNSLRAEDTGIYYCTRLANWDWYFDVWGAGTTVTVSS

SEQ ID NO: 23893 - protein, 5 aa, Artificial Sequence
  Description of Artificial Sequence: Synthetic peptide
  XENP020553 vhCDR1
DAWMD

SEQ ID NO: 23894 - protein, 19 aa, Artificial Sequence
  Description of Artificial Sequence: Synthetic peptide
  XENP020553 vhCDR2
EIRTKANNHATAYAESVKG

SEQ ID NO: 23895 - protein, 10 aa, Artificial Sequence
  Description of Artificial Sequence: Synthetic peptide
  XENP020553 vhCDR3
LANWDWYFDV

SEQ ID NO: 23896 - protein, 218 aa, Artificial Sequence; identical to SEQ ID NO: 22266
  Description of Artificial Sequence: Synthetic polypeptide
  XENP020553 7G8_H0.101_L0_IgG1_PVA_/S267K Light Chain

SEQ ID NO: 23897 - protein, 111 aa, Artificial Sequence; identical to SEQ ID NO: 22267
  Description of Artificial Sequence: Synthetic polypeptide
  VL of XENP020553

SEQ ID NO: 23898 - protein, 15 aa, Artificial Sequence
  Description of Artificial Sequence: Synthetic peptide
  XENP020553 vlCDR1
KASQSVDYDGDSYMN

SEQ ID NO: 23899 - protein, 7 aa, Artificial Sequence
  Description of Artificial Sequence: Synthetic peptide
  XENP020553 vlCDR2
AASNLES

SEQ ID NO: 23900 - protein, 9 aa, Artificial Sequence
  Description of Artificial Sequence: Synthetic peptide
  XENP020553 vlCDR3
QQSNEDPFT

SEQ ID NO: 23901 - protein, 450 aa, Artificial Sequence
  Description of Artificial Sequence: Synthetic polypeptide
  XENP020554 7G8_H0.102_L0_IgG1_PVA_/S267K Heavy Chain
EVKLEESGGGLVQPGGSMKLSCAASGFTFSDAWMDWVRQSPEKGLEWVAEIRTKANNHATQYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 23902 - protein, 121 aa, Artificial Sequence
  Description of Artificial Sequence: Synthetic polypeptide
  VH of XENP020554
EVKLEESGGGLVQPGGSMKLSCAASGFTFSDAWMDWVRQSPEKGLEWVAEIRTKANNHATQYAESVKGRFTISRDDSKSSVYLQMNSLRAEDTGIYYCTRLANWDWYFDVWGAGTTVTVSS

SEQ ID NO: 23903 - protein, 5 aa, Artificial Sequence
  Description of Artificial Sequence: Synthetic peptide
  XENP020554 vhCDR1
DAWMD

SEQ ID NO: 23904 - protein, 19 aa, Artificial Sequence
  Description of Artificial Sequence: Synthetic peptide
  XENP020554 vhCDR2
EIRTKANNHATQYAESVKG

SEQ ID NO: 23905 - protein, 10 aa, Artificial Sequence
  Description of Artificial Sequence: Synthetic peptide
  XENP020554 vhCDR3
LANWDWYFDV

SEQ ID NO: 23906 - protein, 218 aa, Artificial Sequence; identical to SEQ ID NO: 22266
  Description of Artificial Sequence: Synthetic polypeptide
  XENP020554 7G8_H0.102_L0_IgG1_PVA_/S267K Light Chain

SEQ ID NO: 23907 - protein, 111 aa, Artificial Sequence; identical to SEQ ID NO: 22267
  Description of Artificial Sequence: Synthetic polypeptide
  VL of XENP020554

SEQ ID NO: 23908 - protein, 15 aa, Artificial Sequence
  Description of Artificial Sequence: Synthetic peptide
  XENP020554 vlCDR1
KASQSVDYDGDSYMN

SEQ ID NO: 23909 - protein, 7 aa, Artificial Sequence
  Description of Artificial Sequence: Synthetic peptide
  XENP020554 vlCDR2
AASNLES

SEQ ID NO: 23910 - protein, 9 aa, Artificial Sequence
  Description of Artificial Sequence: Synthetic peptide
  XENP020554 vlCDR3
QQSNEDPFT

SEQ ID NO: 23911 - protein, 450 aa, Artificial Sequence
  Description of Artificial Sequence: Synthetic polypeptide
  XENP020555 7G8_H0.103_L0_IgG1_PVA_/S267K Heavy Chain
EVKLEESGGGLVQPGGSMKLSCAASGFTFSDAWMDWVRQSPEKGLEWVAEIRTKANNHATDYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 23912 - protein, 121 aa, Artificial Sequence
  Description of Artificial Sequence: Synthetic polypeptide
  VH of XENP020555
EVKLEESGGGLVQPGGSMKLSCAASGFTFSDAWMDWVRQSPEKGLEWVAEIRTKANNHATDYAESVKGRFTISRDDSKSSVYLQMNSLRAEDTGIYYCTRLANWDWYFDVWGAGTTVTVSS

SEQ ID NO: 23913 - protein, 5 aa, Artificial Sequence
  Description of Artificial Sequence: Synthetic peptide
  XENP020555 vhCDR1
DAWMD

SEQ ID NO: 23914 - protein, 19 aa, Artificial Sequence
  Description of Artificial Sequence: Synthetic peptide
  XENP020555 vhCDR2
EIRTKANNHATDYAESVKG

SEQ ID NO: 23915 - protein, 10 aa, Artificial Sequence
  Description of Artificial Sequence: Synthetic peptide
  XENP020555 vhCDR3
LANWDWYFDV

SEQ ID NO: 23916 - protein, 218 aa, Artificial Sequence; identical to SEQ ID NO: 22266
  Description of Artificial Sequence: Synthetic polypeptide
  XENP020555 7G8_H0.103_L0_IgG1_PVA_/S267K Light Chain

SEQ ID NO: 23917 - protein, 111 aa, Artificial Sequence; identical to SEQ ID NO: 22267
  Description of Artificial Sequence: Synthetic polypeptide
  VL of XENP020555

SEQ ID NO: 23918 - protein, 15 aa, Artificial Sequence
  Description of Artificial Sequence: Synthetic peptide
  XENP020555 vlCDR1
KASQSVDYDGDSYMN

SEQ ID NO: 23919 - protein, 7 aa, Artificial Sequence
  Description of Artificial Sequence: Synthetic peptide
  XENP020555 vlCDR2
AASNLES

SEQ ID NO: 23920 - protein, 9 aa, Artificial Sequence
  Description of Artificial Sequence: Synthetic peptide
  XENP020555 vlCDR3
QQSNEDPFT

SEQ ID NO: 23921 - protein, 450 aa, Artificial Sequence
  Description of Artificial Sequence: Synthetic polypeptide
  XENP020556 7G8_H0.104_L0_IgG1_PVA_/S267K Heavy Chain
EVKLEESGGGLVQPGGSMKLSCAASGFTFSDAWMDWVRQSPEKGLEWVAEIRTKANNHATKYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 23922 - protein, 121 aa, Artificial Sequence
  Description of Artificial Sequence: Synthetic polypeptide
  VH of XENP020556
EVKLEESGGGLVQPGGSMKLSCAASGFTFSDAWMDWVRQSPEKGLEWVAEIRTKANNHATKYAESVKGRFTISRDDSKSSVYLQMNSLRAEDTGIYYCTRLANWDWYFDVWGAGTTVTVSS

SEQ ID NO: 23923 - protein, 5 aa, Artificial Sequence
  Description of Artificial Sequence: Synthetic peptide
  XENP020556 vhCDR1
DAWMD

SEQ ID NO: 23924 - protein, 19 aa, Artificial Sequence
  Description of Artificial Sequence: Synthetic peptide
  XENP020556 vhCDR2
EIRTKANNHATKYAESVKG

SEQ ID NO: 23925 - protein, 10 aa, Artificial Sequence
  Description of Artificial Sequence: Synthetic peptide
  XENP020556 vhCDR3
LANWDWYFDV

SEQ ID NO: 23926 - protein, 218 aa, Artificial Sequence; identical to SEQ ID NO: 22266
  Description of Artificial Sequence: Synthetic polypeptide
  XENP020556 7G8_H0.104_L0_IgG1_PVA_/S267K Light Chain

SEQ ID NO: 23927 - protein, 111 aa, Artificial Sequence; identical to SEQ ID NO: 22267
  Description of Artificial Sequence: Synthetic polypeptide
  VL of XENP020556

SEQ ID NO: 23928 - protein, 15 aa, Artificial Sequence
  Description of Artificial Sequence: Synthetic peptide
  XENP020556 vlCDR1
KASQSVDYDGDSYMN

SEQ ID NO: 23929 - protein, 7 aa, Artificial Sequence
  Description of Artificial Sequence: Synthetic peptide
  XENP020556 vlCDR2
AASNLES

SEQ ID NO: 23930 - protein, 9 aa, Artificial Sequence
  Description of Artificial Sequence: Synthetic peptide
  XENP020556 vlCDR3
QQSNEDPFT

SEQ ID NO: 23931 - protein, 450 aa, Artificial Sequence
  Description of Artificial Sequence: Synthetic polypeptide
  XENP020557 7G8_H0.105_L0_IgG1_PVA_/S267K Heavy Chain
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRIANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 23932 - protein, 121 aa, Artificial Sequence
  Description of Artificial Sequence: Synthetic polypeptide
  VH of XENP020557
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRIANWDWYFDVWGAGTTVTVSS

SEQ ID NO: 23933 - protein, 5 aa, Artificial Sequence
  Description of Artificial Sequence: Synthetic peptide
  XENP020557 vhCDR1
DAWMD

SEQ ID NO: 23934 - protein, 19 aa, Artificial Sequence
  Description of Artificial Sequence: Synthetic peptide
  XENP020557 vhCDR2
EIRTKANNHATYYAESVKG

SEQ ID NO: 23935 - protein, 10 aa, Artificial Sequence
  Description of Artificial Sequence: Synthetic peptide
  XENP020557 vhCDR3
IANWDWYFDV

SEQ ID NO: 23936 - protein, 218 aa, Artificial Sequence; identical to SEQ ID NO: 22266
  Description of Artificial Sequence: Synthetic polypeptide
  XENP020557 7G8_H0.105_L0_IgG1_PVA_/S267K Light Chain

SEQ ID NO: 23937 - protein, 111 aa, Artificial Sequence; identical to SEQ ID NO: 22267
  Description of Artificial Sequence: Synthetic polypeptide
  VL of XENP020557

SEQ ID NO: 23938 - protein, 15 aa, Artificial Sequence
  Description of Artificial Sequence: Synthetic peptide
  XENP020557 vlCDR1
KASQSVDYDGDSYMN

SEQ ID NO: 23939 - protein, 7 aa, Artificial Sequence
  Description of Artificial Sequence: Synthetic peptide
  XENP020557 vlCDR2
AASNLES

SEQ ID NO: 23940 - protein, 9 aa, Artificial Sequence
  Description of Artificial Sequence: Synthetic peptide
  XENP020557 vlCDR3
QQSNEDPFT

SEQ ID NO: 23941 - protein, 450 aa, Artificial Sequence
  Description of Artificial Sequence: Synthetic polypeptide
  XENP020558 7G8_H0.106_L0_IgG1_PVA_/S267K Heavy Chain
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRFANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 23942 - protein, 121 aa, Artificial Sequence
  Description of Artificial Sequence: Synthetic polypeptide
  VH of XENP020558
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRFANWDWYFDVWGAGTTVTVSS

SEQ ID NO: 23943 - protein, 5 aa, Artificial Sequence
  Description of Artificial Sequence: Synthetic peptide
  XENP020558 vhCDR1
DAWMD

SEQ ID NO: 23944 - protein, 19 aa, Artificial Sequence
  Description of Artificial Sequence: Synthetic peptide
  XENP020558 vhCDR2
EIRTKANNHATYYAESVKG

SEQ ID NO: 23945 - protein, 10 aa, Artificial Sequence
  Description of Artificial Sequence: Synthetic peptide
  XENP020558 vhCDR3
FANWDWYFDV

SEQ ID NO: 23946 - protein, 218 aa, Artificial Sequence; identical to SEQ ID NO: 22266
  Description of Artificial Sequence: Synthetic polypeptide
  XENP020558 7G8_H0.106_L0_IgG1_PVA_/S267K Light Chain

SEQ ID NO: 23947 - protein, 111 aa, Artificial Sequence; identical to SEQ ID NO: 22267
  Description of Artificial Sequence: Synthetic polypeptide
  VL of XENP020558

SEQ ID NO: 23948 - protein, 15 aa, Artificial Sequence
  Description of Artificial Sequence: Synthetic peptide
  XENP020558 vlCDR1
KASQSVDYDGDSYMN

SEQ ID NO: 23949 - protein, 7 aa, Artificial Sequence
  Description of Artificial Sequence: Synthetic peptide
  XENP020558 vlCDR2
AASNLES

SEQ ID NO: 23950 - protein, 9 aa, Artificial Sequence
  Description of Artificial Sequence: Synthetic peptide
  XENP020558 vlCDR3
QQSNEDPFT

SEQ ID NO: 23951 - protein, 450 aa, Artificial Sequence
  Description of Artificial Sequence: Synthetic polypeptide
  XENP020559 7G8_H0.107_L0_IgG1_PVA_/S267K Heavy Chain
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRVANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 23952 - protein, 121 aa, Artificial Sequence
  Description of Artificial Sequence: Synthetic polypeptide
  VH of XENP020559
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRVANWDWYFDVWGAGTTVTVSS

SEQ ID NO: 23953 - protein, 5 aa, Artificial Sequence
  Description of Artificial Sequence: Synthetic peptide
  XENP020559 vhCDR1
DAWMD

SEQ ID NO: 23954 - protein, 19 aa, Artificial Sequence
  Description of Artificial Sequence: Synthetic peptide
  XENP020559 vhCDR2
EIRTKANNHATYYAESVKG

SEQ ID NO: 23955 - protein, 10 aa, Artificial Sequence
  Description of Artificial Sequence: Synthetic peptide
  XENP020559 vhCDR3
VANWDWYFDV

SEQ ID NO: 23956 - protein, 218 aa, Artificial Sequence; identical to SEQ ID NO: 22266
  Description of Artificial Sequence: Synthetic polypeptide
  XENP020559 7G8_H0.107_L0_IgG1_PVA_/S267K Light Chain

SEQ ID NO: 23957 - protein, 111 aa, Artificial Sequence; identical to SEQ ID NO: 22267
  Description of Artificial Sequence: Synthetic polypeptide
  VL of XENP020559

SEQ ID NO: 23958 - protein, 15 aa, Artificial Sequence
  Description of Artificial Sequence: Synthetic peptide
  XENP020559 vlCDR1
KASQSVDYDGDSYMN

SEQ ID NO: 23959 - protein, 7 aa, Artificial Sequence
  Description of Artificial Sequence: Synthetic peptide
  XENP020559 vlCDR2
AASNLES

SEQ ID NO: 23960 - protein, 9 aa, Artificial Sequence
  Description of Artificial Sequence: Synthetic peptide
  XENP020559 vlCDR3
QQSNEDPFT

SEQ ID NO: 23961 - protein, 450 aa, Artificial Sequence
  Description of Artificial Sequence: Synthetic polypeptide
  XENP020560 7G8_H0.108_L0_IgG1_PVA_/S267K Heavy Chain
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRYANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 23962 - protein, 121 aa, Artificial Sequence
  Description of Artificial Sequence: Synthetic polypeptide
  VH of XENP020560
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRYANWDWYFDVWGAGTTVTVSS

SEQ ID NO: 23963 - protein, 5 aa, Artificial Sequence
  Description of Artificial Sequence: Synthetic peptide
  XENP020560 vhCDR1
DAWMD

SEQ ID NO: 23964 - protein, 19 aa, Artificial Sequence
  Description of Artificial Sequence: Synthetic peptide
  XENP020560 vhCDR2
EIRTKANNHATYYAESVKG

SEQ ID NO: 23965 - protein, 10 aa, Artificial Sequence
  Description of Artificial Sequence: Synthetic peptide
  XENP020560 vhCDR3
YANWDWYFDV

SEQ ID NO: 23966 - protein, 218 aa, Artificial Sequence; identical to SEQ ID NO: 22266
  Description of Artificial Sequence: Synthetic polypeptide
  XENP020560 7G8_H0.108_L0_IgG1_PVA_/S267K Light Chain

SEQ ID NO: 23967 - protein, 111 aa, Artificial Sequence; identical to SEQ ID NO: 22267
  Description of Artificial Sequence: Synthetic polypeptide
  VL of XENP020560

SEQ ID NO: 23968 - protein, 15 aa, Artificial Sequence
  Description of Artificial Sequence: Synthetic peptide
  XENP020560 vlCDR1
KASQSVDYDGDSYMN

SEQ ID NO: 23969 - protein, 7 aa, Artificial Sequence
  Description of Artificial Sequence: Synthetic peptide
  XENP020560 vlCDR2
AASNLES

SEQ ID NO: 23970 - protein, 9 aa, Artificial Sequence
  Description of Artificial Sequence: Synthetic peptide
  XENP020560 vlCDR3
QQSNEDPFT

SEQ ID NO: 23971 - protein, 450 aa, Artificial Sequence
  Description of Artificial Sequence: Synthetic polypeptide
  XENP020561 7G8_H0.109_L0_IgG1_PVA_/S267K Heavy Chain
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRWANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 23972 - protein, 121 aa, Artificial Sequence
  Description of Artificial Sequence: Synthetic polypeptide
  VH of XENP020561
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRWANWDWYFDVWGAGTTVTVSS

SEQ ID NO: 23973 - protein, 5 aa, Artificial Sequence
  Description of Artificial Sequence: Synthetic peptide
  XENP020561 vhCDR1
DAWMD

SEQ ID NO: 23974 - protein, 19 aa, Artificial Sequence
  Description of Artificial Sequence: Synthetic peptide
  XENP020561 vhCDR2
EIRTKANNHATYYAESVKG

SEQ ID NO: 23975 - protein, 10 aa, Artificial Sequence
  Description of Artificial Sequence: Synthetic peptide
  XENP020561 vhCDR3
WANWDWYFDV

SEQ ID NO: 23976 - protein, 218 aa, Artificial Sequence; identical to SEQ ID NO: 22266
  Description of Artificial Sequence: Synthetic polypeptide
  XENP020561 7G8_H0.109_L0_IgG1_PVA_/S267K Light Chain

SEQ ID NO: 23977 - protein, 111 aa, Artificial Sequence; identical to SEQ ID NO: 22267
  Description of Artificial Sequence: Synthetic polypeptide
  VL of XENP020561

SEQ ID NO: 23978 - protein, 15 aa, Artificial Sequence
  Description of Artificial Sequence: Synthetic peptide
  XENP020561 vlCDR1
KASQSVDYDGDSYMN

SEQ ID NO: 23979 - protein, 7 aa, Artificial Sequence
  Description of Artificial Sequence: Synthetic peptide
  XENP020561 vlCDR2
AASNLES

SEQ ID NO: 23980 - protein, 9 aa, Artificial Sequence
  Description of Artificial Sequence: Synthetic peptide
  XENP020561 vlCDR3
QQSNEDPFT

SEQ ID NO: 23981 - protein, 450 aa, Artificial Sequence
  Description of Artificial Sequence: Synthetic polypeptide
  XENP020562 7G8_H0.110_L0_IgG1_PVA_/S267K Heavy Chain
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRDANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 23982 - protein, 121 aa, Artificial Sequence
  Description of Artificial Sequence: Synthetic polypeptide
  VH of XENP020562
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRDANWDWYFDVWGAGTTVTVSS

SEQ ID NO: 23983 - protein, 5 aa, Artificial Sequence
  Description of Artificial Sequence: Synthetic peptide
  XENP020562 vhCDR1
DAWMD

SEQ ID NO: 23984 - protein, 19 aa, Artificial Sequence
  Description of Artificial Sequence: Synthetic peptide
  XENP020562 vhCDR2
EIRTKANNHATYYAESVKG

SEQ ID NO: 23985 - protein, 10 aa, Artificial Sequence
  Description of Artificial Sequence: Synthetic peptide
  XENP020562 vhCDR3
DANWDWYFDV

SEQ ID NO: 23986 - protein, 218 aa, Artificial Sequence; identical to SEQ ID NO: 22266
  Description of Artificial Sequence: Synthetic polypeptide
  XENP020562 7G8_H0.110_L0_IgG1_PVA_/S267K Light Chain

SEQ ID NO: 23987 - protein, 111 aa, Artificial Sequence; identical to SEQ ID NO: 22267
  Description of Artificial Sequence: Synthetic polypeptide
  VL of XENP020562

SEQ ID NO: 23988 - protein, 15 aa, Artificial Sequence
  Description of Artificial Sequence: Synthetic peptide
  XENP020562 vlCDR1
KASQSVDYDGDSYMN

SEQ ID NO: 23989 - protein, 7 aa, Artificial Sequence
  Description of Artificial Sequence: Synthetic peptide
  XENP020562 vlCDR2
AASNLES

SEQ ID NO: 23990 - protein, 9 aa, Artificial Sequence
  Description of Artificial Sequence: Synthetic peptide
  XENP020562 vlCDR3
QQSNEDPFT

SEQ ID NO: 23991 - protein, 450 aa, Artificial Sequence
  Description of Artificial Sequence: Synthetic polypeptide
  XENP020563 7G8_H0.111_L0_IgG1_PVA_/S267K Heavy Chain
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRAANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 23992 - protein, 121 aa, Artificial Sequence
  Description of Artificial Sequence: Synthetic polypeptide
  VH of XENP020563
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRAANWDWYFDVWGAGTTVTVSS

SEQ ID NO: 23993 - protein, 5 aa, Artificial Sequence
  Description of Artificial Sequence: Synthetic peptide
  XENP020563 vhCDR1
DAWMD

SEQ ID NO: 23994 - protein, 19 aa, Artificial Sequence
  Description of Artificial Sequence: Synthetic peptide
  XENP020563 vhCDR2
EIRTKANNHATYYAESVKG

SEQ ID NO: 23995 - protein, 10 aa, Artificial Sequence
  Description of Artificial Sequence: Synthetic peptide
  XENP020563 vhCDR3
AANWDWYFDV

SEQ ID NO: 23996 - protein, 218 aa, Artificial Sequence; identical to SEQ ID NO: 22266
  Description of Artificial Sequence: Synthetic polypeptide
  XENP020563 7G8_H0.111_L0_IgG1_PVA_/S267K Light Chain

SEQ ID NO: 23997 - protein, 111 aa, Artificial Sequence; identical to SEQ ID NO: 22267
  Description of Artificial Sequence: Synthetic polypeptide
  VL of XENP020563

SEQ ID NO: 23998 - protein, 15 aa, Artificial Sequence
  Description of Artificial Sequence: Synthetic peptide
  XENP020563 vlCDR1
KASQSVDYDGDSYMN

SEQ ID NO: 23999 - protein, 7 aa, Artificial Sequence
  Description of Artificial Sequence: Synthetic peptide
  XENP020563 vlCDR2
AASNLES

SEQ ID NO: 24000 - protein, 9 aa, Artificial Sequence
  Description of Artificial Sequence: Synthetic peptide
  XENP020563 vlCDR3
QQSNEDPFT

SEQ ID NO: 24001 - protein, 450 aa, Artificial Sequence
  Description of Artificial Sequence: Synthetic polypeptide
  XENP020564 7G8_H0.112_L0_IgG1_PVA_/S267K Heavy Chain
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRQANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 24002 - protein, 121 aa, Artificial Sequence
  Description of Artificial Sequence: Synthetic polypeptide
  VH of XENP020564
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRQANWDWYFDVWGAGTTVTVSS

SEQ ID NO: 24003 - protein, 5 aa, Artificial Sequence
  Description of Artificial Sequence: Synthetic peptide
  XENP020564 vhCDR1
DAWMD

SEQ ID NO: 24004 - protein, 19 aa, Artificial Sequence
  Description of Artificial Sequence: Synthetic peptide
  XENP020564 vhCDR2
EIRTKANNHATYYAESVKG

SEQ ID NO: 24005 - protein, 10 aa, Artificial Sequence
  Description of Artificial Sequence: Synthetic peptide
  XENP020564 vhCDR3
QANWDWYFDV

SEQ ID NO: 24006 - protein, 218 aa, Artificial Sequence; identical to SEQ ID NO: 22266
  Description of Artificial Sequence: Synthetic polypeptide
  XENP020564 7G8_H0.112_L0_IgG1_PVA_/S267K Light Chain

SEQ ID NO: 24007 - protein, 111 aa, Artificial Sequence; identical to SEQ ID NO: 22267
  Description of Artificial Sequence: Synthetic polypeptide
  VL of XENP020564

SEQ ID NO: 24008 - protein, 15 aa, Artificial Sequence
  Description of Artificial Sequence: Synthetic peptide
  XENP020564 vlCDR1
KASQSVDYDGDSYMN

SEQ ID NO: 24009 - protein, 7 aa, Artificial Sequence
  Description of Artificial Sequence: Synthetic peptide
  XENP020564 vlCDR2
AASNLES

SEQ ID NO: 24010 - protein, 9 aa, Artificial Sequence
  Description of Artificial Sequence: Synthetic peptide
  XENP020564 vlCDR3
QQSNEDPFT

SEQ ID NO: 24011 - protein, 450 aa, Artificial Sequence
  Description of Artificial Sequence: Synthetic polypeptide
  XENP020565 7G8_H0.113_L0_IgG1_PVA_/S267K Heavy Chain
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRKANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 24012 - protein, 121 aa, Artificial Sequence
  Description of Artificial Sequence: Synthetic polypeptide
  VH of XENP020565
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRKANWDWYFDVWGAGTTVTVSS

SEQ ID NO: 24013 - protein, 5 aa, Artificial Sequence
  Description of Artificial Sequence: Synthetic peptide
  XENP020565 vhCDR1
DAWMD

SEQ ID NO: 24014 - protein, 19 aa, Artificial Sequence
  Description of Artificial Sequence: Synthetic peptide
  XENP020565 vhCDR2
EIRTKANNHATYYAESVKG

SEQ ID NO: 24015 - protein, 10 aa, Artificial Sequence
  Description of Artificial Sequence: Synthetic peptide
  XENP020565 vhCDR3
KANWDWYFDV

SEQ ID NO: 24016 - protein, 218 aa, Artificial Sequence; identical to SEQ ID NO: 22266
  Description of Artificial Sequence: Synthetic polypeptide
  XENP020565 7G8_H0.113_L0_IgG1_PVA_/S267K Light Chain

SEQ ID NO: 24017 - protein, 111 aa, Artificial Sequence; identical to SEQ ID NO: 22267
  Description of Artificial Sequence: Synthetic polypeptide
  VL of XENP020565

SEQ ID NO: 24018 - protein, 15 aa, Artificial Sequence
  Description of Artificial Sequence: Synthetic peptide
  XENP020565 vlCDR1
KASQSVDYDGDSYMN

SEQ ID NO: 24019 - protein, 7 aa, Artificial Sequence
  Description of Artificial Sequence: Synthetic peptide
  XENP020565 vlCDR2
AASNLES

SEQ ID NO: 24020 - protein, 9 aa, Artificial Sequence
  Description of Artificial Sequence: Synthetic peptide
  XENP020565 vlCDR3
QQSNEDPFT

SEQ ID NO: 24021 - protein, 450 aa, Artificial Sequence
  Description of Artificial Sequence: Synthetic polypeptide
  XENP020566 7G8_H0.114_L0_IgG1_PVA_/S267K Heavy Chain
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLSNWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 24022 - protein, 121 aa, Artificial Sequence
  Description of Artificial Sequence: Synthetic polypeptide
  VH of XENP020566
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLSNWDWYFDVWGAGTTVTVSS

SEQ ID NO: 24023 - protein, 5 aa, Artificial Sequence
  Description of Artificial Sequence: Synthetic peptide
  XENP020566 vhCDR1
DAWMD

SEQ ID NO: 24024 - protein, 19 aa, Artificial Sequence
  Description of Artificial Sequence: Synthetic peptide
  XENP020566 vhCDR2
EIRTKANNHATYYAESVKG

SEQ ID NO: 24025 - protein, 10 aa, Artificial Sequence
  Description of Artificial Sequence: Synthetic peptide
  XENP020566 vhCDR3
LSNWDWYFDV

SEQ ID NO: 24026 - protein, 218 aa, Artificial Sequence; identical to SEQ ID NO: 22266
  Description of Artificial Sequence: Synthetic polypeptide
  XENP020566 7G8_H0.114_L0_IgG1_PVA_/S267K Light Chain

SEQ ID NO: 24027 - protein, 111 aa, Artificial Sequence; identical to SEQ ID NO: 22267
  Description of Artificial Sequence: Synthetic polypeptide
  VL of XENP020566

SEQ ID NO: 24028 - protein, 15 aa, Artificial Sequence
  Description of Artificial Sequence: Synthetic peptide
  XENP020566 vlCDR1
KASQSVDYDGDSYMN

SEQ ID NO: 24029 - protein, 7 aa, Artificial Sequence
  Description of Artificial Sequence: Synthetic peptide
  XENP020566 vlCDR2
AASNLES

SEQ ID NO: 24030 - protein, 9 aa, Artificial Sequence
  Description of Artificial Sequence: Synthetic peptide
  XENP020566 vlCDR3
QQSNEDPFT

SEQ ID NO: 24031 - protein, 450 aa, Artificial Sequence
  Description of Artificial Sequence: Synthetic polypeptide
  XENP020567 7G8_H0.115_L0_IgG1_PVA_/S267K Heavy Chain
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLTNWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 24032 - protein, 121 aa, Artificial Sequence
  Description of Artificial Sequence: Synthetic polypeptide
  VH of XENP020567
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLTNWDWYFDVWGAGTTVTVSS

SEQ ID NO: 24033 - protein, 5 aa, Artificial Sequence
  Description of Artificial Sequence: Synthetic peptide
  XENP020567 vhCDR1
DAWMD

SEQ ID NO: 24034 - protein, 19 aa, Artificial Sequence
  Description of Artificial Sequence: Synthetic peptide
  XENP020567 vhCDR2
EIRTKANNHATYYAESVKG

SEQ ID NO: 24035 - protein, 10 aa, Artificial Sequence
  Description of Artificial Sequence: Synthetic peptide
  XENP020567 vhCDR3
LTNWDWYFDV

SEQ ID NO: 24036 - protein, 218 aa, Artificial Sequence; identical to SEQ ID NO: 22266
  Description of Artificial Sequence: Synthetic polypeptide
  XENP020567 7G8_H0.115_L0_IgG1_PVA_/S267K Light Chain

SEQ ID NO: 24037 - protein, 111 aa, Artificial Sequence; identical to SEQ ID NO: 22267
  Description of Artificial Sequence: Synthetic polypeptide
  VL of XENP020567

SEQ ID NO: 24038 - protein, 15 aa, Artificial Sequence
  Description of Artificial Sequence: Synthetic peptide
  XENP020567 vlCDR1
KASQSVDYDGDSYMN

SEQ ID NO: 24039 - protein, 7 aa, Artificial Sequence
  Description of Artificial Sequence: Synthetic peptide
  XENP020567 vlCDR2
AASNLES

SEQ ID NO: 24040 - protein, 9 aa, Artificial Sequence
  Description of Artificial Sequence: Synthetic peptide
  XENP020567 vlCDR3
QQSNEDPFT

SEQ ID NO: 24041 - protein, 450 aa, Artificial Sequence
  Description of Artificial Sequence: Synthetic polypeptide
  XENP020568 7G8_H0.116_L0_IgG1_PVA_/S267K Heavy Chain
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLGNWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 24042 - protein, 121 aa, Artificial Sequence
  Description of Artificial Sequence: Synthetic polypeptide
  VH of XENP020568
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLGNWDWYFDVWGAGTTVTVSS

SEQ ID NO: 24043 - protein, 5 aa, Artificial Sequence
  Description of Artificial Sequence: Synthetic peptide
  XENP020568 vhCDR1
DAWMD

SEQ ID NO: 24044 - protein, 19 aa, Artificial Sequence
  Description of Artificial Sequence: Synthetic peptide
  XENP020568 vhCDR2
EIRTKANNHATYYAESVKG

SEQ ID NO: 24045 - protein, 10 aa, Artificial Sequence
  Description of Artificial Sequence: Synthetic peptide
  XENP020568 vhCDR3
LGNWDWYFDV

SEQ ID NO: 24046 - protein, 218 aa, Artificial Sequence; identical to SEQ ID NO: 22266
  Description of Artificial Sequence: Synthetic polypeptide
  XENP020568 7G8_H0.116_L0_IgG1_PVA_/S267K Light Chain

SEQ ID NO: 24047 - protein, 111 aa, Artificial Sequence; identical to SEQ ID NO: 22267
  Description of Artificial Sequence: Synthetic polypeptide
  VL of XENP020568

SEQ ID NO: 24048 - protein, 15 aa, Artificial Sequence
  Description of Artificial Sequence: Synthetic peptide
  XENP020568 vlCDR1
KASQSVDYDGDSYMN

SEQ ID NO: 24049 - protein, 7 aa, Artificial Sequence
  Description of Artificial Sequence: Synthetic peptide
  XENP020568 vlCDR2
AASNLES

SEQ ID NO: 24050 - protein, 9 aa, Artificial Sequence
  Description of Artificial Sequence: Synthetic peptide
  XENP020568 vlCDR3
QQSNEDPFT

SEQ ID NO: 24051 - protein, 450 aa, Artificial Sequence
  Description of Artificial Sequence: Synthetic polypeptide
  XENP020569 7G8_H0.117_L0_IgG1_PVA_/S267K Heavy Chain
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLHNWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 24052 - protein, 121 aa, Artificial Sequence
  Description of Artificial Sequence: Synthetic polypeptide
  VH of XENP020569
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLHNWDWYFDVWGAGTTVTVSS

SEQ ID NO: 24053 - protein, 5 aa, Artificial Sequence
  Description of Artificial Sequence: Synthetic peptide
  XENP020569 vhCDR1
DAWMD

SEQ ID NO: 24054 - protein, 19 aa, Artificial Sequence
  Description of Artificial Sequence: Synthetic peptide
  XENP020569 vhCDR2
EIRTKANNHATYYAESVKG

SEQ ID NO: 24055 - protein, 10 aa, Artificial Sequence
  Description of Artificial Sequence: Synthetic peptide
  XENP020569 vhCDR3
LHNWDWYFDV

SEQ ID NO: 24056 - protein, 218 aa, Artificial Sequence; identical to SEQ ID NO: 22266
  Description of Artificial Sequence: Synthetic polypeptide
  XENP020569 7G8_H0.117_L0_IgG1_PVA_/S267K Light Chain

SEQ ID NO: 24057 - protein, 111 aa, Artificial Sequence; identical to SEQ ID NO: 22267
  Description of Artificial Sequence: Synthetic polypeptide
  VL of XENP020569

SEQ ID NO: 24058 - protein, 15 aa, Artificial Sequence
  Description of Artificial Sequence: Synthetic peptide
  XENP020569 vlCDR1
KASQSVDYDGDSYMN

SEQ ID NO: 24059 - protein, 7 aa, Artificial Sequence
  Description of Artificial Sequence: Synthetic peptide
  XENP020569 vlCDR2
AASNLES

SEQ ID NO: 24060 - protein, 9 aa, Artificial Sequence
  Description of Artificial Sequence: Synthetic peptide
  XENP020569 vlCDR3
QQSNEDPFT

SEQ ID NO: 24061 - protein, 450 aa, Artificial Sequence
  Description of Artificial Sequence: Synthetic polypeptide
  XENP020570 7G8_H0.118_L0_IgG1_PVA_/S267K Heavy Chain
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLQNWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 24062 - protein, 121 aa, Artificial Sequence
  Description of Artificial Sequence: Synthetic polypeptide
  VH of XENP020570
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLQNWDWYFDVWGAGTTVTVSS

SEQ ID NO: 24063 - protein, 5 aa, Artificial Sequence
  Description of Artificial Sequence: Synthetic peptide
  XENP020570 vhCDR1
DAWMD

SEQ ID NO: 24064 - protein, 19 aa, Artificial Sequence
  Description of Artificial Sequence: Synthetic peptide
  XENP020570 vhCDR2
EIRTKANNHATYYAESVKG

SEQ ID NO: 24065 - protein, 10 aa, Artificial Sequence
  Description of Artificial Sequence: Synthetic peptide
  XENP020570 vhCDR3
LQNWDWYFDV

SEQ ID NO: 24066 - protein, 218 aa, Artificial Sequence; identical to SEQ ID NO: 22266
  Description of Artificial Sequence: Synthetic polypeptide
  XENP020570 7G8_H0.118_L0_IgG1_PVA_/S267K Light Chain

SEQ ID NO: 24067 - protein, 111 aa, Artificial Sequence; identical to SEQ ID NO: 22267
  Description of Artificial Sequence: Synthetic polypeptide
  VL of XENP020570

SEQ ID NO: 24068 - protein, 15 aa, Artificial Sequence
  Description of Artificial Sequence: Synthetic peptide
  XENP020570 vlCDR1
KASQSVDYDGDSYMN

SEQ ID NO: 24069 - protein, 7 aa, Artificial Sequence
  Description of Artificial Sequence: Synthetic peptide
  XENP020570 vlCDR2
AASNLES

SEQ ID NO: 24070 - protein, 9 aa, Artificial Sequence
  Description of Artificial Sequence: Synthetic peptide
  XENP020570 vlCDR3
QQSNEDPFT

SEQ ID NO: 24071 - protein, 450 aa, Artificial Sequence
  Description of Artificial Sequence: Synthetic polypeptide
  XENP020571 7G8_H0.119_L0_IgG1_PVA_/S267K Heavy Chain
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLDNWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 24072 - protein, 121 aa, Artificial Sequence
  Description of Artificial Sequence: Synthetic polypeptide
  VH of XENP020571
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLDNWDWYFDVWGAGTTVTVSS

SEQ ID NO: 24073 - protein, 5 aa, Artificial Sequence
  Description of Artificial Sequence: Synthetic peptide
  XENP020571 vhCDR1
DAWMD

SEQ ID NO: 24074 - protein, 19 aa, Artificial Sequence
  Description of Artificial Sequence: Synthetic peptide
  XENP020571 vhCDR2
EIRTKANNHATYYAESVKG

SEQ ID NO: 24075 - protein, 10 aa, Artificial Sequence
  Description of Artificial Sequence: Synthetic peptide
  XENP020571 vhCDR3
LDNWDWYFDV

SEQ ID NO: 24076 - protein, 218 aa, Artificial Sequence; identical to SEQ ID NO: 22266
  Description of Artificial Sequence: Synthetic polypeptide
  XENP020571 7G8_H0.119_L0_IgG1_PVA_/S267K Light Chain

SEQ ID NO: 24077 - protein, 111 aa, Artificial Sequence; identical to SEQ ID NO: 22267
  Description of Artificial Sequence: Synthetic polypeptide
  VL of XENP020571

SEQ ID NO: 24078 - protein, 15 aa, Artificial Sequence
  Description of Artificial Sequence: Synthetic peptide
  XENP020571 vlCDR1
KASQSVDYDGDSYMN

SEQ ID NO: 24079 - protein, 7 aa, Artificial Sequence
  Description of Artificial Sequence: Synthetic peptide
  XENP020571 vlCDR2
AASNLES

SEQ ID NO: 24080 - protein, 9 aa, Artificial Sequence
  Description of Artificial Sequence: Synthetic peptide
  XENP020571 vlCDR3
QQSNEDPFT

SEQ ID NO: 24081 - protein, 450 aa, Artificial Sequence
  Description of Artificial Sequence: Synthetic polypeptide
  XENP020572 7G8_H0.120_L0_IgG1_PVA_/S267K Heavy Chain
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLLNWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 24082 - protein, 121 aa, Artificial Sequence
  Description of Artificial Sequence: Synthetic polypeptide
  VH of XENP020572
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLLNWDWYFDVWGAGTTVTVSS

SEQ ID NO: 24083 - protein, 5 aa, Artificial Sequence
  Description of Artificial Sequence: Synthetic peptide
  XENP020572 vhCDR1
DAWMD

SEQ ID NO: 24084 - protein, 19 aa, Artificial Sequence
  Description of Artificial Sequence: Synthetic peptide
  XENP020572 vhCDR2
EIRTKANNHATYYAESVKG

SEQ ID NO: 24085 - protein, 10 aa, Artificial Sequence
  Description of Artificial Sequence: Synthetic peptide
  XENP020572 vhCDR3
LLNWDWYFDV

SEQ ID NO: 24086 - protein, 218 aa, Artificial Sequence; identical to SEQ ID NO: 22266
  Description of Artificial Sequence: Synthetic polypeptide
  XENP020572 7G8_H0.120_L0_IgG1_PVA_/S267K Light Chain

SEQ ID NO: 24087 - protein, 111 aa, Artificial Sequence; identical to SEQ ID NO: 22267
  Description of Artificial Sequence: Synthetic polypeptide
  VL of XENP020572

SEQ ID NO: 24088 - protein, 15 aa, Artificial Sequence
  Description of Artificial Sequence: Synthetic peptide
  XENP020572 vlCDR1
KASQSVDYDGDSYMN

SEQ ID NO: 24089 - protein, 7 aa, Artificial Sequence
  Description of Artificial Sequence: Synthetic peptide
  XENP020572 vlCDR2
AASNLES

SEQ ID NO: 24090 - protein, 9 aa, Artificial Sequence
  Description of Artificial Sequence: Synthetic peptide
  XENP020572 vlCDR3
QQSNEDPFT

SEQ ID NO: 24091 - protein, 450 aa, Artificial Sequence
  Description of Artificial Sequence: Synthetic polypeptide
  XENP020573 7G8_H0.121_L0_IgG1_PVA_/S267K Heavy Chain
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLKNWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 24092 - protein, 121 aa, Artificial Sequence
  Description of Artificial Sequence: Synthetic polypeptide
  VH of XENP020573
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLKNWDWYFDVWGAGTTVTVSS

SEQ ID NO: 24093 - protein, 5 aa, Artificial Sequence
  Description of Artificial Sequence: Synthetic peptide
  XENP020573 vhCDR1
DAWMD

SEQ ID NO: 24094 - protein, 19 aa, Artificial Sequence
  Description of Artificial Sequence: Synthetic peptide
  XENP020573 vhCDR2
EIRTKANNHATYYAESVKG

SEQ ID NO: 24095 - protein, 10 aa, Artificial Sequence
  Description of Artificial Sequence: Synthetic peptide
  XENP020573 vhCDR3
LKNWDWYFDV

SEQ ID NO: 24096 - protein, 218 aa, Artificial Sequence; identical to SEQ ID NO: 22266
  Description of Artificial Sequence: Synthetic polypeptide
  XENP020573 7G8_H0.121_L0_IgG1_PVA_/S267K Light Chain

SEQ ID NO: 24097 - protein, 111 aa, Artificial Sequence; identical to SEQ ID NO: 22267
  Description of Artificial Sequence: Synthetic polypeptide
  VL of XENP020573

SEQ ID NO: 24098 - protein, 15 aa, Artificial Sequence
  Description of Artificial Sequence: Synthetic peptide
  XENP020573 vlCDR1
KASQSVDYDGDSYMN

SEQ ID NO: 24099 - protein, 7 aa, Artificial Sequence
  Description of Artificial Sequence: Synthetic peptide
  XENP020573 vlCDR2
AASNLES

SEQ ID NO: 24100 - protein, 9 aa, Artificial Sequence
  Description of Artificial Sequence: Synthetic peptide
  XENP020573 vlCDR3
QQSNEDPFT

SEQ ID NO: 24101 - protein, 450 aa, Artificial Sequence
  Description of Artificial Sequence: Synthetic polypeptide
  XENP020574 7G8_H0.122_L0_IgG1_PVA_/S267K Heavy Chain
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLYNWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 24102 - protein, 121 aa, Artificial Sequence
  Description of Artificial Sequence: Synthetic polypeptide
  VH of XENP020574
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLYNWDWYFDVWGAGTTVTVSS

SEQ ID NO: 24103 - protein, 5 aa, Artificial Sequence
  Description of Artificial Sequence: Synthetic peptide
  XENP020574 vhCDR1
DAWMD

SEQ ID NO: 24104 - protein, 19 aa, Artificial Sequence
  Description of Artificial Sequence: Synthetic peptide
  XENP020574 vhCDR2
EIRTKANNHATYYAESVKG

SEQ ID NO: 24105 - protein, 10 aa, Artificial Sequence
  Description of Artificial Sequence: Synthetic peptide
  XENP020574 vhCDR3
LYNWDWYFDV

SEQ ID NO: 24106 - protein, 218 aa, Artificial Sequence; identical to SEQ ID NO: 22266
  Description of Artificial Sequence: Synthetic polypeptide
  XENP020574 7G8_H0.122_L0_IgG1_PVA_/S267K Light Chain

SEQ ID NO: 24107 - protein, 111 aa, Artificial Sequence; identical to SEQ ID NO: 22267
  Description of Artificial Sequence: Synthetic polypeptide
  VL of XENP020574

SEQ ID NO: 24108 - protein, 15 aa, Artificial Sequence
  Description of Artificial Sequence: Synthetic peptide
  XENP020574 vlCDR1
KASQSVDYDGDSYMN

SEQ ID NO: 24109 - protein, 7 aa, Artificial Sequence
  Description of Artificial Sequence: Synthetic peptide
  XENP020574 vlCDR2
AASNLES

SEQ ID NO: 24110 - protein, 9 aa, Artificial Sequence
  Description of Artificial Sequence: Synthetic peptide
  XENP020574 vlCDR3
QQSNEDPFT

SEQ ID NO: 24111 - protein, 450 aa, Artificial Sequence
  Description of Artificial Sequence: Synthetic polypeptide
  XENP020575 7G8_H0.123_L0_IgG1_PVA_/S267K Heavy Chain
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLADWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 24112 - protein, 121 aa, Artificial Sequence
  Description of Artificial Sequence: Synthetic polypeptide
  VH of XENP020575
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLADWDWYFDVWGAGTTVTVSS

SEQ ID NO: 24113 - protein, 5 aa, Artificial Sequence
  Description of Artificial Sequence: Synthetic peptide
  XENP020575 vhCDR1
DAWMD

SEQ ID NO: 24114 - protein, 19 aa, Artificial Sequence
  Description of Artificial Sequence: Synthetic peptide
  XENP020575 vhCDR2
EIRTKANNHATYYAESVKG

SEQ ID NO: 24115 - protein, 10 aa, Artificial Sequence
  Description of Artificial Sequence: Synthetic peptide
  XENP020575 vhCDR3
LADWDWYFDV

SEQ ID NO: 24116 - protein, 218 aa, Artificial Sequence; identical to SEQ ID NO: 22266
  Description of Artificial Sequence: Synthetic polypeptide
  XENP020575 7G8_H0.123_L0_IgG1_PVA_/S267K Light Chain

SEQ ID NO: 24117 - protein, 111 aa, Artificial Sequence; identical to SEQ ID NO: 22267
  Description of Artificial Sequence: Synthetic polypeptide
  VL of XENP020575

SEQ ID NO: 24118 - protein, 15 aa, Artificial Sequence
  Description of Artificial Sequence: Synthetic peptide
  XENP020575 vlCDR1
KASQSVDYDGDSYMN

SEQ ID NO: 24119 - protein, 7 aa, Artificial Sequence
  Description of Artificial Sequence: Synthetic peptide
  XENP020575 vlCDR2
AASNLES

SEQ ID NO: 24120 - protein, 9 aa, Artificial Sequence
  Description of Artificial Sequence: Synthetic peptide
  XENP020575 vlCDR3
QQSNEDPFT

SEQ ID NO: 24121 - protein, 450 aa, Artificial Sequence
  Description of Artificial Sequence: Synthetic polypeptide
  XENP020576 7G8_H0.124_L0_IgG1_PVA_/S267K Heavy Chain
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLAHWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 24122 - protein, 121 aa, Artificial Sequence
  Description of Artificial Sequence: Synthetic polypeptide
  VH of XENP020576
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLAHWDWYFDVWGAGTTVTVSS

SEQ ID NO: 24123 - protein, 5 aa, Artificial Sequence
  Description of Artificial Sequence: Synthetic peptide
  XENP020576 vhCDR1
DAWMD

SEQ ID NO: 24124 - protein, 19 aa, Artificial Sequence
  Description of Artificial Sequence: Synthetic peptide
  XENP020576 vhCDR2
EIRTKANNHATYYAESVKG

SEQ ID NO: 24125 - protein, 10 aa, Artificial Sequence
  Description of Artificial Sequence: Synthetic peptide
  XENP020576 vhCDR3
LAHWDWYFDV

SEQ ID NO: 24126 - protein, 218 aa, Artificial Sequence; identical to SEQ ID NO: 22266
  Description of Artificial Sequence: Synthetic polypeptide
  XENP020576 7G8_H0.124_L0_IgG1_PVA_/S267K Light Chain

SEQ ID NO: 24127 - protein, 111 aa, Artificial Sequence; identical to SEQ ID NO: 22267
  Description of Artificial Sequence: Synthetic polypeptide
  VL of XENP020576

SEQ ID NO: 24128 - protein, 15 aa, Artificial Sequence
  Description of Artificial Sequence: Synthetic peptide
  XENP020576 vlCDR1
KASQSVDYDGDSYMN

SEQ ID NO: 24129 - protein, 7 aa, Artificial Sequence
  Description of Artificial Sequence: Synthetic peptide
  XENP020576 vlCDR2
AASNLES

SEQ ID NO: 24130 - protein, 9 aa, Artificial Sequence
  Description of Artificial Sequence: Synthetic peptide
  XENP020576 vlCDR3
QQSNEDPFT

SEQ ID NO: 24131 - protein, 450 aa, Artificial Sequence
  Description of Artificial Sequence: Synthetic polypeptide
  XENP020577 7G8_H0.125_L0_IgG1_PVA_/S267K Heavy Chain
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLAEWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 24132 - protein, 121 aa, Artificial Sequence
  Description of Artificial Sequence: Synthetic polypeptide
  VH of XENP020577
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLAEWDWYFDVWGAGTTVTVSS

SEQ ID NO: 24133 - protein, 5 aa, Artificial Sequence
  Description of Artificial Sequence: Synthetic peptide
  XENP020577 vhCDR1
DAWMD

SEQ ID NO: 24134 - protein, 19 aa, Artificial Sequence
  Description of Artificial Sequence: Synthetic peptide
  XENP020577 vhCDR2
EIRTKANNHATYYAESVKG

SEQ ID NO: 24135 - protein, 10 aa, Artificial Sequence
  Description of Artificial Sequence: Synthetic peptide
  XENP020577 vhCDR3
LAEWDWYFDV

SEQ ID NO: 24136 - protein, 218 aa, Artificial Sequence; identical to SEQ ID NO: 22266
  Description of Artificial Sequence: Synthetic polypeptide
  XENP020577 7G8_H0.125_L0_IgG1_PVA_/S267K Light Chain

SEQ ID NO: 24137 - protein, 111 aa, Artificial Sequence; identical to SEQ ID NO: 22267
  Description of Artificial Sequence: Synthetic polypeptide
  VL of XENP020577

SEQ ID NO: 24138 - protein, 15 aa, Artificial Sequence
  Description of Artificial Sequence: Synthetic peptide
  XENP020577 vlCDR1
KASQSVDYDGDSYMN

SEQ ID NO: 24139 - protein, 7 aa, Artificial Sequence
  Description of Artificial Sequence: Synthetic peptide
  XENP020577 vlCDR2
AASNLES

SEQ ID NO: 24140 - protein, 9 aa, Artificial Sequence
  Description of Artificial Sequence: Synthetic peptide
  XENP020577 vlCDR3
QQSNEDPFT

SEQ ID NO: 24141 - protein, 450 aa, Artificial Sequence
  Description of Artificial Sequence: Synthetic polypeptide
  XENP020578 7G8_H0.126_L0_IgG1_PVA_/S267K Heavy Chain
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLASWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 24142 - protein, 121 aa, Artificial Sequence
  Description of Artificial Sequence: Synthetic polypeptide
  VH of XENP020578
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLASWDWYFDVWGAGTTVTVSS

SEQ ID NO: 24143 - protein, 5 aa, Artificial Sequence
  Description of Artificial Sequence: Synthetic peptide
  XENP020578 vhCDR1
DAWMD

SEQ ID NO: 24144 - protein, 19 aa, Artificial Sequence
  Description of Artificial Sequence: Synthetic peptide
  XENP020578 vhCDR2
EIRTKANNHATYYAESVKG

SEQ ID NO: 24145 - protein, 10 aa, Artificial Sequence
  Description of Artificial Sequence: Synthetic peptide
  XENP020578 vhCDR3
LASWDWYFDV

SEQ ID NO: 24146 - protein, 218 aa, Artificial Sequence; identical to SEQ ID NO: 22266
  Description of Artificial Sequence: Synthetic polypeptide
  XENP020578 7G8_H0.126_L0_IgG1_PVA_/S267K Light Chain

SEQ ID NO: 24147 - protein, 111 aa, Artificial Sequence; identical to SEQ ID NO: 22267
  Description of Artificial Sequence: Synthetic polypeptide
  VL of XENP020578

SEQ ID NO: 24148 - protein, 15 aa, Artificial Sequence
  Description of Artificial Sequence: Synthetic peptide
  XENP020578 vlCDR1
KASQSVDYDGDSYMN

SEQ ID NO: 24149 - protein, 7 aa, Artificial Sequence
  Description of Artificial Sequence: Synthetic peptide
  XENP020578 vlCDR2
AASNLES

SEQ ID NO: 24150 - protein, 9 aa, Artificial Sequence
  Description of Artificial Sequence: Synthetic peptide
  XENP020578 vlCDR3
QQSNEDPFT

SEQ ID NO: 24151 - protein, 450 aa, Artificial Sequence
  Description of Artificial Sequence: Synthetic polypeptide
  XENP020579 7G8_H0.127_L0_IgG1_PVA_/S267K Heavy Chain
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLARWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 24152 - protein, 121 aa, Artificial Sequence
  Description of Artificial Sequence: Synthetic polypeptide
  VH of XENP020579
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLARWDWYFDVWGAGTTVTVSS

SEQ ID NO: 24153 - protein, 5 aa, Artificial Sequence
  Description of Artificial Sequence: Synthetic peptide
  XENP020579 vhCDR1
DAWMD

SEQ ID NO: 24154 - protein, 19 aa, Artificial Sequence
  Description of Artificial Sequence: Synthetic peptide
  XENP020579 vhCDR2
EIRTKANNHATYYAESVKG

SEQ ID NO: 24155 - protein, 10 aa, Artificial Sequence
  Description of Artificial Sequence: Synthetic peptide
  XENP020579 vhCDR3
LARWDWYFDV

SEQ ID NO: 24156 - protein, 218 aa, Artificial Sequence; identical to SEQ ID NO: 22266
  Description of Artificial Sequence: Synthetic polypeptide
  XENP020579 7G8_H0.127_L0_IgG1_PVA_/S267K Light Chain

SEQ ID NO: 24157 - protein, 111 aa, Artificial Sequence; identical to SEQ ID NO: 22267
  Description of Artificial Sequence: Synthetic polypeptide
  VL of XENP020579

SEQ ID NO: 24158 - protein, 15 aa, Artificial Sequence
  Description of Artificial Sequence: Synthetic peptide
  XENP020579 vlCDR1
KASQSVDYDGDSYMN

SEQ ID NO: 24159 - protein, 7 aa, Artificial Sequence
  Description of Artificial Sequence: Synthetic peptide
  XENP020579 vlCDR2
AASNLES

SEQ ID NO: 24160 - protein, 9 aa, Artificial Sequence
  Description of Artificial Sequence: Synthetic peptide
  XENP020579 vlCDR3
QQSNEDPFT

SEQ ID NO: 24161 - protein, 450 aa, Artificial Sequence
  Description of Artificial Sequence: Synthetic polypeptide
  XENP020580 7G8_H0.128_L0_IgG1_PVA_/S267K Heavy Chain
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLALWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 24162 - protein, 121 aa, Artificial Sequence
  Description of Artificial Sequence: Synthetic polypeptide
  VH of XENP020580
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLALWDWYFDVWGAGTTVTVSS

SEQ ID NO: 24163 - protein, 5 aa, Artificial Sequence
  Description of Artificial Sequence: Synthetic peptide
  XENP020580 vhCDR1
DAWMD

SEQ ID NO: 24164 - protein, 19 aa, Artificial Sequence
  Description of Artificial Sequence: Synthetic peptide
  XENP020580 vhCDR2
EIRTKANNHATYYAESVKG

SEQ ID NO: 24165 - protein, 10 aa, Artificial Sequence
  Description of Artificial Sequence: Synthetic peptide
  XENP020580 vhCDR3
LALWDWYFDV

SEQ ID NO: 24166 - protein, 218 aa, Artificial Sequence; identical to SEQ ID NO: 22266
  Description of Artificial Sequence: Synthetic polypeptide
  XENP020580 7G8_H0.128_L0_IgG1_PVA_/S267K Light Chain

SEQ ID NO: 24167 - protein, 111 aa, Artificial Sequence; identical to SEQ ID NO: 22267
  Description of Artificial Sequence: Synthetic polypeptide
  VL of XENP020580

SEQ ID NO: 24168 - protein, 15 aa, Artificial Sequence
  Description of Artificial Sequence: Synthetic peptide
  XENP020580 vlCDR1
KASQSVDYDGDSYMN

SEQ ID NO: 24169 - protein, 7 aa, Artificial Sequence
  Description of Artificial Sequence: Synthetic peptide
  XENP020580 vlCDR2
AASNLES

SEQ ID NO: 24170 - protein, 9 aa, Artificial Sequence
  Description of Artificial Sequence: Synthetic peptide
  XENP020580 vlCDR3
QQSNEDPFT

SEQ ID NO: 24171 - protein, 450 aa, Artificial Sequence
  Description of Artificial Sequence: Synthetic polypeptide
  XENP020581 7G8_H0.129_L0_IgG1_PVA_/S267K Heavy Chain
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLATWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 24172 - protein, 121 aa, Artificial Sequence
  Description of Artificial Sequence: Synthetic polypeptide
  VH of XENP020581
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLATWDWYFDVWGAGTTVTVSS

SEQ ID NO: 24173 - protein, 5 aa, Artificial Sequence
  Description of Artificial Sequence: Synthetic peptide
  XENP020581 vhCDR1
DAWMD

SEQ ID NO: 24174 - protein, 19 aa, Artificial Sequence
  Description of Artificial Sequence: Synthetic peptide
  XENP020581 vhCDR2
EIRTKANNHATYYAESVKG

SEQ ID NO: 24175 - protein, 10 aa, Artificial Sequence
  Description of Artificial Sequence: Synthetic peptide
  XENP020581 vhCDR3
LATWDWYFDV

SEQ ID NO: 24176 - protein, 218 aa, Artificial Sequence; identical to SEQ ID NO: 22266
  Description of Artificial Sequence: Synthetic polypeptide
  XENP020581 7G8_H0.129_L0_IgG1_PVA_/S267K Light Chain

SEQ ID NO: 24177 - protein, 111 aa, Artificial Sequence; identical to SEQ ID NO: 22267
  Description of Artificial Sequence: Synthetic polypeptide
  VL of XENP020581

SEQ ID NO: 24178 - protein, 15 aa, Artificial Sequence
  Description of Artificial Sequence: Synthetic peptide
  XENP020581 vlCDR1
KASQSVDYDGDSYMN

SEQ ID NO: 24179 - protein, 7 aa, Artificial Sequence
  Description of Artificial Sequence: Synthetic peptide
  XENP020581 vlCDR2
AASNLES

SEQ ID NO: 24180 - protein, 9 aa, Artificial Sequence
  Description of Artificial Sequence: Synthetic peptide
  XENP020581 vlCDR3
QQSNEDPFT

SEQ ID NO: 24181 - protein, 450 aa, Artificial Sequence
  Description of Artificial Sequence: Synthetic polypeptide
  XENP020582 7G8_H0.130_L0_IgG1_PVA_/S267K Heavy Chain
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLAGWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 24182 - protein, 121 aa, Artificial Sequence
  Description of Artificial Sequence: Synthetic polypeptide
  VH of XENP020582
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLAGWDWYFDVWGAGTTVTVSS

SEQ ID NO: 24183 - protein, 5 aa, Artificial Sequence
  Description of Artificial Sequence: Synthetic peptide
  XENP020582 vhCDR1
DAWMD

SEQ ID NO: 24184 - protein, 19 aa, Artificial Sequence
  Description of Artificial Sequence: Synthetic peptide
  XENP020582 vhCDR2
EIRTKANNHATYYAESVKG

SEQ ID NO: 24185 - protein, 10 aa, Artificial Sequence
  Description of Artificial Sequence: Synthetic peptide
  XENP020582 vhCDR3
LAGWDWYFDV

SEQ ID NO: 24186 - protein, 218 aa, Artificial Sequence; identical to SEQ ID NO: 22266
  Description of Artificial Sequence: Synthetic polypeptide
  XENP020582 7G8_H0.130_L0_IgG1_PVA_/S267K Light Chain

SEQ ID NO: 24187 - protein, 111 aa, Artificial Sequence; identical to SEQ ID NO: 22267
  Description of Artificial Sequence: Synthetic polypeptide
  VL of XENP020582

SEQ ID NO: 24188 - protein, 15 aa, Artificial Sequence
  Description of Artificial Sequence: Synthetic peptide
  XENP020582 vlCDR1
KASQSVDYDGDSYMN

SEQ ID NO: 24189 - protein, 7 aa, Artificial Sequence
  Description of Artificial Sequence: Synthetic peptide
  XENP020582 vlCDR2
AASNLES

SEQ ID NO: 24190 - protein, 9 aa, Artificial Sequence
  Description of Artificial Sequence: Synthetic peptide
  XENP020582 vlCDR3
QQSNEDPFT

SEQ ID NO: 24191 - protein, 450 aa, Artificial Sequence
  Description of Artificial Sequence: Synthetic polypeptide
  XENP020583 7G8_H0.131_L0_IgG1_PVA_/S267K Heavy Chain
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLAYWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 24192 - protein, 121 aa, Artificial Sequence
  Description of Artificial Sequence: Synthetic polypeptide
  VH of XENP020583
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLAYWDWYFDVWGAGTTVTVSS

SEQ ID NO: 24193 - protein, 5 aa, Artificial Sequence
  Description of Artificial Sequence: Synthetic peptide
  XENP020583 vhCDR1
DAWMD

SEQ ID NO: 24194 - protein, 19 aa, Artificial Sequence
  Description of Artificial Sequence: Synthetic peptide
  XENP020583 vhCDR2
EIRTKANNHATYYAESVKG

SEQ ID NO: 24195 - protein, 10 aa, Artificial Sequence
  Description of Artificial Sequence: Synthetic peptide
  XENP020583 vhCDR3
LAYWDWYFDV

SEQ ID NO: 24196 - protein, 218 aa, Artificial Sequence; identical to SEQ ID NO: 22266
  Description of Artificial Sequence: Synthetic polypeptide
  XENP020583 7G8_H0.131_L0_IgG1_PVA_/S267K Light Chain

SEQ ID NO: 24197 - protein, 111 aa, Artificial Sequence; identical to SEQ ID NO: 22267
  Description of Artificial Sequence: Synthetic polypeptide
  VL of XENP020583

SEQ ID NO: 24198 - protein, 15 aa, Artificial Sequence
  Description of Artificial Sequence: Synthetic peptide
  XENP020583 vlCDR1
KASQSVDYDGDSYMN

SEQ ID NO: 24199 - protein, 7 aa, Artificial Sequence
  Description of Artificial Sequence: Synthetic peptide
  XENP020583 vlCDR2
AASNLES

SEQ ID NO: 24200 - protein, 9 aa, Artificial Sequence
  Description of Artificial Sequence: Synthetic peptide
  XENP020583 vlCDR3
QQSNEDPFT

SEQ ID NO: 24201 - protein, 450 aa, Artificial Sequence
  Description of Artificial Sequence: Synthetic polypeptide
  XENP020584 7G8_H0.132_L0_IgG1_PVA_/S267K Heavy Chain
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLANFDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 24202 - protein, 121 aa, Artificial Sequence
  Description of Artificial Sequence: Synthetic polypeptide
  VH of XENP020584
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLANFDWYFDVWGAGTTVTVSS

SEQ ID NO: 24203 - protein, 5 aa, Artificial Sequence
  Description of Artificial Sequence: Synthetic peptide
  XENP020584 vhCDR1
DAWMD

SEQ ID NO: 24204 - protein, 19 aa, Artificial Sequence
  Description of Artificial Sequence: Synthetic peptide
  XENP020584 vhCDR2
EIRTKANNHATYYAESVKG

SEQ ID NO: 24205 - protein, 10 aa, Artificial Sequence
  Description of Artificial Sequence: Synthetic peptide
  XENP020584 vhCDR3
LANFDWYFDV

SEQ ID NO: 24206 - protein, 218 aa, Artificial Sequence; identical to SEQ ID NO: 22266
  Description of Artificial Sequence: Synthetic polypeptide
  XENP020584 7G8_H0.132_L0_IgG1_PVA_/S267K Light Chain

SEQ ID NO: 24207 - protein, 111 aa, Artificial Sequence; identical to SEQ ID NO: 22267
  Description of Artificial Sequence: Synthetic polypeptide
  VL of XENP020584

SEQ ID NO: 24208 - protein, 15 aa, Artificial Sequence
  Description of Artificial Sequence: Synthetic peptide
  XENP020584 vlCDR1
KASQSVDYDGDSYMN

SEQ ID NO: 24209 - protein, 7 aa, Artificial Sequence
  Description of Artificial Sequence: Synthetic peptide
  XENP020584 vlCDR2
AASNLES

SEQ ID NO: 24210 - protein, 9 aa, Artificial Sequence
  Description of Artificial Sequence: Synthetic peptide
  XENP020584 vlCDR3
QQSNEDPFT

SEQ ID NO: 24211 - protein, 450 aa, Artificial Sequence
  Description of Artificial Sequence: Synthetic polypeptide
  XENP020585 7G8_H0.133_L0_IgG1_PVA_/S267K Heavy Chain
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLANLDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 24212 - protein, 121 aa, Artificial Sequence
  Description of Artificial Sequence: Synthetic polypeptide
  VH of XENP020585
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLANLDWYFDVWGAGTTVTVSS

SEQ ID NO: 24213 - protein, 5 aa, Artificial Sequence
  Description of Artificial Sequence: Synthetic peptide
  XENP020585 vhCDR1
DAWMD

SEQ ID NO: 24214 - protein, 19 aa, Artificial Sequence
  Description of Artificial Sequence: Synthetic peptide
  XENP020585 vhCDR2
EIRTKANNHATYYAESVKG

SEQ ID NO: 24215 - protein, 10 aa, Artificial Sequence
  Description of Artificial Sequence: Synthetic peptide
  XENP020585 vhCDR3
LANLDWYFDV

SEQ ID NO: 24216 - protein, 218 aa, Artificial Sequence; identical to SEQ ID NO: 22266
  Description of Artificial Sequence: Synthetic polypeptide
  XENP020585 7G8_H0.133_L0_IgG1_PVA_/S267K Light Chain

SEQ ID NO: 24217 - protein, 111 aa, Artificial Sequence; identical to SEQ ID NO: 22267
  Description of Artificial Sequence: Synthetic polypeptide
  VL of XENP020585

SEQ ID NO: 24218 - protein, 15 aa, Artificial Sequence
  Description of Artificial Sequence: Synthetic peptide
  XENP020585 vlCDR1
KASQSVDYDGDSYMN

SEQ ID NO: 24219 - protein, 7 aa, Artificial Sequence
  Description of Artificial Sequence: Synthetic peptide
  XENP020585 vlCDR2
AASNLES

SEQ ID NO: 24220 - protein, 9 aa, Artificial Sequence
  Description of Artificial Sequence: Synthetic peptide
  XENP020585 vlCDR3
QQSNEDPFT

SEQ ID NO: 24221 - protein, 450 aa, Artificial Sequence
  Description of Artificial Sequence: Synthetic polypeptide
  XENP020586 7G8_H0.134_L0_IgG1_PVA_/S267K Heavy Chain
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLANYDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 24222 - protein, 121 aa, Artificial Sequence
  Description of Artificial Sequence: Synthetic polypeptide
  VH of XENP020586
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLANYDWYFDVWGAGTTVTVSS

SEQ ID NO: 24223 - protein, 5 aa, Artificial Sequence
  Description of Artificial Sequence: Synthetic peptide
  XENP020586 vhCDR1
DAWMD

SEQ ID NO: 24224 - protein, 19 aa, Artificial Sequence
  Description of Artificial Sequence: Synthetic peptide
  XENP020586 vhCDR2
EIRTKANNHATYYAESVKG

SEQ ID NO: 24225 - protein, 10 aa, Artificial Sequence
  Description of Artificial Sequence: Synthetic peptide
  XENP020586 vhCDR3
LANYDWYFDV

SEQ ID NO: 24226 - protein, 218 aa, Artificial Sequence; identical to SEQ ID NO: 22266
  Description of Artificial Sequence: Synthetic polypeptide
  XENP020586 7G8_H0.134_L0_IgG1_PVA_/S267K Light Chain

SEQ ID NO: 24227 - protein, 111 aa, Artificial Sequence; identical to SEQ ID NO: 22267
  Description of Artificial Sequence: Synthetic polypeptide
  VL of XENP020586

SEQ ID NO: 24228 - protein, 15 aa, Artificial Sequence
  Description of Artificial Sequence: Synthetic peptide
  XENP020586 vlCDR1
KASQSVDYDGDSYMN

SEQ ID NO: 24229 - protein, 7 aa, Artificial Sequence
  Description of Artificial Sequence: Synthetic peptide
  XENP020586 vlCDR2
AASNLES

SEQ ID NO: 24230 - protein, 9 aa, Artificial Sequence
  Description of Artificial Sequence: Synthetic peptide
  XENP020586 vlCDR3
QQSNEDPFT

SEQ ID NO: 24231 - protein, 450 aa, Artificial Sequence
  Description of Artificial Sequence: Synthetic polypeptide
  XENP020587 7G8_H0.135_L0_IgG1_PVA_/S267K Heavy Chain
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLANIDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 24232 - protein, 121 aa, Artificial Sequence
  Description of Artificial Sequence: Synthetic polypeptide
  VH of XENP020587
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLANIDWYFDVWGAGTTVTVSS

SEQ ID NO: 24233 - protein, 5 aa, Artificial Sequence
  Description of Artificial Sequence: Synthetic peptide
  XENP020587 vhCDR1
DAWMD

SEQ ID NO: 24234 - protein, 19 aa, Artificial Sequence
  Description of Artificial Sequence: Synthetic peptide
  XENP020587 vhCDR2
EIRTKANNHATYYAESVKG

SEQ ID NO: 24235 - protein, 10 aa, Artificial Sequence
  Description of Artificial Sequence: Synthetic peptide
  XENP020587 vhCDR3
LANIDWYFDV

SEQ ID NO: 24236 - protein, 218 aa, Artificial Sequence; identical to SEQ ID NO: 22266
  Description of Artificial Sequence: Synthetic polypeptide
  XENP020587 7G8_H0.135_L0_IgG1_PVA_/S267K Light Chain

SEQ ID NO: 24237 - protein, 111 aa, Artificial Sequence; identical to SEQ ID NO: 22267
  Description of Artificial Sequence: Synthetic polypeptide
  VL of XENP020587

SEQ ID NO: 24238 - protein, 15 aa, Artificial Sequence
  Description of Artificial Sequence: Synthetic peptide
  XENP020587 vlCDR1
KASQSVDYDGDSYMN

SEQ ID NO: 24239 - protein, 7 aa, Artificial Sequence
  Description of Artificial Sequence: Synthetic peptide
  XENP020587 vlCDR2
AASNLES

SEQ ID NO: 24240 - protein, 9 aa, Artificial Sequence
  Description of Artificial Sequence: Synthetic peptide
  XENP020587 vlCDR3
QQSNEDPFT

SEQ ID NO: 24241 - protein, 450 aa, Artificial Sequence
  Description of Artificial Sequence: Synthetic polypeptide
  XENP020588 7G8_H0.136_L0_IgG1_PVA_/S267K Heavy Chain
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLANHDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 24242 - protein, 121 aa, Artificial Sequence
  Description of Artificial Sequence: Synthetic polypeptide
  VH of XENP020588
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLANHDWYFDVWGAGTTVTVSS

SEQ ID NO: 24243 - protein, 5 aa, Artificial Sequence
  Description of Artificial Sequence: Synthetic peptide
  XENP020588 vhCDR1
DAWMD

SEQ ID NO: 24244 - protein, 19 aa, Artificial Sequence
  Description of Artificial Sequence: Synthetic peptide
  XENP020588 vhCDR2
EIRTKANNHATYYAESVKG

SEQ ID NO: 24245 - protein, 10 aa, Artificial Sequence
  Description of Artificial Sequence: Synthetic peptide
  XENP020588 vhCDR3
LANHDWYFDV

SEQ ID NO: 24246 - protein, 218 aa, Artificial Sequence; identical to SEQ ID NO: 22266
  Description of Artificial Sequence: Synthetic polypeptide
  XENP020588 7G8_H0.136_L0_IgG1_PVA_/S267K Light Chain

SEQ ID NO: 24247 - protein, 111 aa, Artificial Sequence; identical to SEQ ID NO: 22267
  Description of Artificial Sequence: Synthetic polypeptide
  VL of XENP020588

SEQ ID NO: 24248 - protein, 15 aa, Artificial Sequence
  Description of Artificial Sequence: Synthetic peptide
  XENP020588 vlCDR1
KASQSVDYDGDSYMN

SEQ ID NO: 24249 - protein, 7 aa, Artificial Sequence
  Description of Artificial Sequence: Synthetic peptide
  XENP020588 vlCDR2
AASNLES

SEQ ID NO: 24250 - protein, 9 aa, Artificial Sequence
  Description of Artificial Sequence: Synthetic peptide
  XENP020588 vlCDR3
QQSNEDPFT

SEQ ID NO: 24251 - protein, 450 aa, Artificial Sequence
  Description of Artificial Sequence: Synthetic polypeptide
  XENP020589 7G8_H0.137_L0_IgG1_PVA_/S267K Heavy Chain
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLANQDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 24252 - protein, 121 aa, Artificial Sequence
  Description of Artificial Sequence: Synthetic polypeptide
  VH of XENP020589
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLANQDWYFDVWGAGTTVTVSS

SEQ ID NO: 24253 - protein, 5 aa, Artificial Sequence
  Description of Artificial Sequence: Synthetic peptide
  XENP020589 vhCDR1
DAWMD

SEQ ID NO: 24254 - protein, 19 aa, Artificial Sequence
  Description of Artificial Sequence: Synthetic peptide
  XENP020589 vhCDR2
EIRTKANNHATYYAESVKG

SEQ ID NO: 24255 - protein, 10 aa, Artificial Sequence
  Description of Artificial Sequence: Synthetic peptide
  XENP020589 vhCDR3
LANQDWYFDV

SEQ ID NO: 24256 - protein, 218 aa, Artificial Sequence; identical to SEQ ID NO: 22266
  Description of Artificial Sequence: Synthetic polypeptide
  XENP020589 7G8_H0.137_L0_IgG1_PVA_/S267K Light Chain

SEQ ID NO: 24257 - protein, 111 aa, Artificial Sequence; identical to SEQ ID NO: 22267
  Description of Artificial Sequence: Synthetic polypeptide
  VL of XENP020589

SEQ ID NO: 24258 - protein, 15 aa, Artificial Sequence
  Description of Artificial Sequence: Synthetic peptide
  XENP020589 vlCDR1
KASQSVDYDGDSYMN

SEQ ID NO: 24259 - protein, 7 aa, Artificial Sequence
  Description of Artificial Sequence: Synthetic peptide
  XENP020589 vlCDR2
AASNLES

SEQ ID NO: 24260 - protein, 9 aa, Artificial Sequence
  Description of Artificial Sequence: Synthetic peptide
  XENP020589 vlCDR3
QQSNEDPFT

SEQ ID NO: 24261 - protein, 450 aa, Artificial Sequence
  Description of Artificial Sequence: Synthetic polypeptide
  XENP020590 7G8_H0.138_L0_IgG1_PVA_/S267K Heavy Chain
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLANSDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 24262 - protein, 121 aa, Artificial Sequence
  Description of Artificial Sequence: Synthetic polypeptide
  VH of XENP020590
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLANSDWYFDVWGAGTTVTVSS

SEQ ID NO: 24263 - protein, 5 aa, Artificial Sequence
  Description of Artificial Sequence: Synthetic peptide
  XENP020590 vhCDR1
DAWMD

SEQ ID NO: 24264 - protein, 19 aa, Artificial Sequence
  Description of Artificial Sequence: Synthetic peptide
  XENP020590 vhCDR2
EIRTKANNHATYYAESVKG

SEQ ID NO: 24265 - protein, 10 aa, Artificial Sequence
  Description of Artificial Sequence: Synthetic peptide
  XENP020590 vhCDR3
LANSDWYFDV

SEQ ID NO: 24266 - protein, 218 aa, Artificial Sequence; identical to SEQ ID NO: 22266
  Description of Artificial Sequence: Synthetic polypeptide
  XENP020590 7G8_H0.138_L0_IgG1_PVA_/S267K Light Chain

SEQ ID NO: 24267 - protein, 111 aa, Artificial Sequence; identical to SEQ ID NO: 22267
  Description of Artificial Sequence: Synthetic polypeptide
  VL of XENP020590

SEQ ID NO: 24268 - protein, 15 aa, Artificial Sequence
  Description of Artificial Sequence: Synthetic peptide
  XENP020590 vlCDR1
KASQSVDYDGDSYMN

SEQ ID NO: 24269 - protein, 7 aa, Artificial Sequence
  Description of Artificial Sequence: Synthetic peptide
  XENP020590 vlCDR2
AASNLES

SEQ ID NO: 24270 - protein, 9 aa, Artificial Sequence
  Description of Artificial Sequence: Synthetic peptide
  XENP020590 vlCDR3
QQSNEDPFT

SEQ ID NO: 24271 - protein, 450 aa, Artificial Sequence
  Description of Artificial Sequence: Synthetic polypeptide
  XENP020591 7G8_H0.139_L0_IgG1_PVA_/S267K Heavy Chain
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLANDDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 24272 - protein, 121 aa, Artificial Sequence
  Description of Artificial Sequence: Synthetic polypeptide
  VH of XENP020591
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLANDDWYFDVWGAGTTVTVSS

SEQ ID NO: 24273 - protein, 5 aa, Artificial Sequence
  Description of Artificial Sequence: Synthetic peptide
  XENP020591 vhCDR1
DAWMD

SEQ ID NO: 24274 - protein, 19 aa, Artificial Sequence
  Description of Artificial Sequence: Synthetic peptide
  XENP020591 vhCDR2
EIRTKANNHATYYAESVKG

SEQ ID NO: 24275 - protein, 10 aa, Artificial Sequence
  Description of Artificial Sequence: Synthetic peptide
  XENP020591 vhCDR3
LANDDWYFDV

SEQ ID NO: 24276 - protein, 218 aa, Artificial Sequence; identical to SEQ ID NO: 22266
  Description of Artificial Sequence: Synthetic polypeptide
  XENP020591 7G8_H0.139_L0_IgG1_PVA_/S267K Light Chain

SEQ ID NO: 24277 - protein, 111 aa, Artificial Sequence; identical to SEQ ID NO: 22267
  Description of Artificial Sequence: Synthetic polypeptide
  VL of XENP020591

SEQ ID NO: 24278 - protein, 15 aa, Artificial Sequence
  Description of Artificial Sequence: Synthetic peptide
  XENP020591 vlCDR1
KASQSVDYDGDSYMN

SEQ ID NO: 24279 - protein, 7 aa, Artificial Sequence
  Description of Artificial Sequence: Synthetic peptide
  XENP020591 vlCDR2
AASNLES

SEQ ID NO: 24280 - protein, 9 aa, Artificial Sequence
  Description of Artificial Sequence: Synthetic peptide
  XENP020591 vlCDR3
QQSNEDPFT

SEQ ID NO: 24281 - protein, 450 aa, Artificial Sequence
  Description of Artificial Sequence: Synthetic polypeptide
  XENP020592 7G8_H0.140_L0_IgG1_PVA_/S267K Heavy Chain
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLANRDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 24282 - protein, 121 aa, Artificial Sequence
  Description of Artificial Sequence: Synthetic polypeptide
  VH of XENP020592
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLANRDWYFDVWGAGTTVTVSS

SEQ ID NO: 24283 - protein, 5 aa, Artificial Sequence
  Description of Artificial Sequence: Synthetic peptide
  XENP020592 vhCDR1
DAWMD

SEQ ID NO: 24284 - protein, 19 aa, Artificial Sequence
  Description of Artificial Sequence: Synthetic peptide
  XENP020592 vhCDR2
EIRTKANNHATYYAESVKG

SEQ ID NO: 24285 - protein, 10 aa, Artificial Sequence
  Description of Artificial Sequence: Synthetic peptide
  XENP020592 vhCDR3
LANRDWYFDV

SEQ ID NO: 24286 - protein, 218 aa, Artificial Sequence; identical to SEQ ID NO: 22266
  Description of Artificial Sequence: Synthetic polypeptide
  XENP020592 7G8_H0.140_L0_IgG1_PVA_/S267K Light Chain

SEQ ID NO: 24287 - protein, 111 aa, Artificial Sequence; identical to SEQ ID NO: 22267
  Description of Artificial Sequence: Synthetic polypeptide
  VL of XENP020592

SEQ ID NO: 24288 - protein, 15 aa, Artificial Sequence
  Description of Artificial Sequence: Synthetic peptide
  XENP020592 vlCDR1
KASQSVDYDGDSYMN

SEQ ID NO: 24289 - protein, 7 aa, Artificial Sequence
  Description of Artificial Sequence: Synthetic peptide
  XENP020592 vlCDR2
AASNLES

SEQ ID NO: 24290 - protein, 9 aa, Artificial Sequence
  Description of Artificial Sequence: Synthetic peptide
  XENP020592 vlCDR3
QQSNEDPFT

SEQ ID NO: 24291 - protein, 450 aa, Artificial Sequence
  Description of Artificial Sequence: Synthetic polypeptide
  XENP020593 7G8_H0.141_L0_IgG1_PVA_/S267K Heavy Chain
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLANWNWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 24292 - protein, 121 aa, Artificial Sequence
  Description of Artificial Sequence: Synthetic polypeptide
  VH of XENP020593
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLANWNWYFDVWGAGTTVTVSS

SEQ ID NO: 24293 - protein, 5 aa, Artificial Sequence
  Description of Artificial Sequence: Synthetic peptide
  XENP020593 vhCDR1
DAWMD

SEQ ID NO: 24294 - protein, 19 aa, Artificial Sequence
  Description of Artificial Sequence: Synthetic peptide
  XENP020593 vhCDR2
EIRTKANNHATYYAESVKG

SEQ ID NO: 24295 - protein, 10 aa, Artificial Sequence
  Description of Artificial Sequence: Synthetic peptide
  XENP020593 vhCDR3
LANWNWYFDV

SEQ ID NO: 24296 - protein, 218 aa, Artificial Sequence; identical to SEQ ID NO: 22266
  Description of Artificial Sequence: Synthetic polypeptide
  XENP020593 7G8_H0.141_L0_IgG1_PVA_/S267K Light Chain

SEQ ID NO: 24297 - protein, 111 aa, Artificial Sequence; identical to SEQ ID NO: 22267
  Description of Artificial Sequence: Synthetic polypeptide
  VL of XENP020593

SEQ ID NO: 24298 - protein, 15 aa, Artificial Sequence
  Description of Artificial Sequence: Synthetic peptide
  XENP020593 vlCDR1
KASQSVDYDGDSYMN

SEQ ID NO: 24299 - protein, 7 aa, Artificial Sequence
  Description of Artificial Sequence: Synthetic peptide
  XENP020593 vlCDR2
AASNLES

SEQ ID NO: 24300 - protein, 9 aa, Artificial Sequence
  Description of Artificial Sequence: Synthetic peptide
  XENP020593 vlCDR3
QQSNEDPFT

SEQ ID NO: 24301 - protein, 450 aa, Artificial Sequence
  Description of Artificial Sequence: Synthetic polypeptide
  XENP020594 7G8_H0.142_L0_IgG1_PVA_/S267K Heavy Chain
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLANWEWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 24302 - protein, 121 aa, Artificial Sequence
  Description of Artificial Sequence: Synthetic polypeptide
  VH of XENP020594
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLANWEWYFDVWGAGTTVTVSS

SEQ ID NO: 24303 - protein, 5 aa, Artificial Sequence
  Description of Artificial Sequence: Synthetic peptide
  XENP020594 vhCDR1
DAWMD

SEQ ID NO: 24304 - protein, 19 aa, Artificial Sequence
  Description of Artificial Sequence: Synthetic peptide
  XENP020594 vhCDR2
EIRTKANNHATYYAESVKG

SEQ ID NO: 24305 - protein, 10 aa, Artificial Sequence
  Description of Artificial Sequence: Synthetic peptide
  XENP020594 vhCDR3
LANWEWYFDV

SEQ ID NO: 24306 - protein, 218 aa, Artificial Sequence; identical to SEQ ID NO: 22266
  Description of Artificial Sequence: Synthetic polypeptide
  XENP020594 7G8_H0.142_L0_IgG1_PVA_/S267K Light Chain

SEQ ID NO: 24307 - protein, 111 aa, Artificial Sequence; identical to SEQ ID NO: 22267
  Description of Artificial Sequence: Synthetic polypeptide
  VL of XENP020594

SEQ ID NO: 24308 - protein, 15 aa, Artificial Sequence
  Description of Artificial Sequence: Synthetic peptide
  XENP020594 vlCDR1
KASQSVDYDGDSYMN

SEQ ID NO: 24309 - protein, 7 aa, Artificial Sequence
  Description of Artificial Sequence: Synthetic peptide
  XENP020594 vlCDR2
AASNLES

SEQ ID NO: 24310 - protein, 9 aa, Artificial Sequence
  Description of Artificial Sequence: Synthetic peptide
  XENP020594 vlCDR3
QQSNEDPFT

SEQ ID NO: 24311 - protein, 450 aa, Artificial Sequence
  Description of Artificial Sequence: Synthetic polypeptide
  XENP020595 7G8_H0.143_L0_IgG1_PVA_/S267K Heavy Chain
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLANWHWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 24312 - protein, 121 aa, Artificial Sequence
  Description of Artificial Sequence: Synthetic polypeptide
  VH of XENP020595
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLANWHWYFDVWGAGTTVTVSS

SEQ ID NO: 24313 - protein, 5 aa, Artificial Sequence
  Description of Artificial Sequence: Synthetic peptide
  XENP020595 vhCDR1
DAWMD

SEQ ID NO: 24314 - protein, 19 aa, Artificial Sequence
  Description of Artificial Sequence: Synthetic peptide
  XENP020595 vhCDR2
EIRTKANNHATYYAESVKG

SEQ ID NO: 24315 - protein, 10 aa, Artificial Sequence
  Description of Artificial Sequence: Synthetic peptide
  XENP020595 vhCDR3
LANWHWYFDV

SEQ ID NO: 24316 - protein, 218 aa, Artificial Sequence; identical to SEQ ID NO: 22266
  Description of Artificial Sequence: Synthetic polypeptide
  XENP020595 7G8_H0.143_L0_IgG1_PVA_/S267K Light Chain

SEQ ID NO: 24317 - protein, 111 aa, Artificial Sequence; identical to SEQ ID NO: 22267
  Description of Artificial Sequence: Synthetic polypeptide
  VL of XENP020595

SEQ ID NO: 24318 - protein, 15 aa, Artificial Sequence
  Description of Artificial Sequence: Synthetic peptide
  XENP020595 vlCDR1
KASQSVDYDGDSYMN

SEQ ID NO: 24319 - protein, 7 aa, Artificial Sequence
  Description of Artificial Sequence: Synthetic peptide
  XENP020595 vlCDR2
AASNLES

SEQ ID NO: 24320 - protein, 9 aa, Artificial Sequence
  Description of Artificial Sequence: Synthetic peptide
  XENP020595 vlCDR3
QQSNEDPFT

SEQ ID NO: 24321 - protein, 450 aa, Artificial Sequence
  Description of Artificial Sequence: Synthetic polypeptide
  XENP020596 7G8_H0.144_L0_IgG1_PVA_/S267K Heavy Chain
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLANWRWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 24322 - protein, 121 aa, Artificial Sequence
  Description of Artificial Sequence: Synthetic polypeptide
  VH of XENP020596
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLANWRWYFDVWGAGTTVTVSS

SEQ ID NO: 24323 - protein, 5 aa, Artificial Sequence
  Description of Artificial Sequence: Synthetic peptide
  XENP020596 vhCDR1
DAWMD

SEQ ID NO: 24324 - protein, 19 aa, Artificial Sequence
  Description of Artificial Sequence: Synthetic peptide
  XENP020596 vhCDR2
EIRTKANNHATYYAESVKG

SEQ ID NO: 24325 - protein, 10 aa, Artificial Sequence
  Description of Artificial Sequence: Synthetic peptide
  XENP020596 vhCDR3
LANWRWYFDV

SEQ ID NO: 24326 - protein, 218 aa, Artificial Sequence; identical to SEQ ID NO: 22266
  Description of Artificial Sequence: Synthetic polypeptide
  XENP020596 7G8_H0.144_L0_IgG1_PVA_/S267K Light Chain

SEQ ID NO: 24327 - protein, 111 aa, Artificial Sequence; identical to SEQ ID NO: 22267
  Description of Artificial Sequence: Synthetic polypeptide
  VL of XENP020596

SEQ ID NO: 24328 - protein, 15 aa, Artificial Sequence
  Description of Artificial Sequence: Synthetic peptide
  XENP020596 vlCDR1
KASQSVDYDGDSYMN

SEQ ID NO: 24329 - protein, 7 aa, Artificial Sequence
  Description of Artificial Sequence: Synthetic peptide
  XENP020596 vlCDR2
AASNLES

SEQ ID NO: 24330 - protein, 9 aa, Artificial Sequence
  Description of Artificial Sequence: Synthetic peptide
  XENP020596 vlCDR3
QQSNEDPFT

SEQ ID NO: 24331 - protein, 450 aa, Artificial Sequence
  Description of Artificial Sequence: Synthetic polypeptide
  XENP020601 7G8_H0.145_L0_IgG1_PVA_/S267K Heavy Chain
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLANWLWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 24332 - protein, 121 aa, Artificial Sequence
  Description of Artificial Sequence: Synthetic polypeptide
  VH of XENP020601
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLANWLWYFDVWGAGTTVTVSS

SEQ ID NO: 24333 - protein, 5 aa, Artificial Sequence
  Description of Artificial Sequence: Synthetic peptide
  XENP020601 vhCDR1
DAWMD

SEQ ID NO: 24334 - protein, 19 aa, Artificial Sequence
  Description of Artificial Sequence: Synthetic peptide
  XENP020601 vhCDR2
EIRTKANNHATYYAESVKG

SEQ ID NO: 24335 - protein, 10 aa, Artificial Sequence
  Description of Artificial Sequence: Synthetic peptide
  XENP020601 vhCDR3
LANWLWYFDV

SEQ ID NO: 24336 - protein, 218 aa, Artificial Sequence; identical to SEQ ID NO: 22266
  Description of Artificial Sequence: Synthetic polypeptide
  XENP020601 7G8_H0.145_L0_IgG1_PVA_/S267K Light Chain

SEQ ID NO: 24337 - protein, 111 aa, Artificial Sequence; identical to SEQ ID NO: 22267
  Description of Artificial Sequence: Synthetic polypeptide
  VL of XENP020601

SEQ ID NO: 24338 - protein, 15 aa, Artificial Sequence
  Description of Artificial Sequence: Synthetic peptide
  XENP020601 vlCDR1
KASQSVDYDGDSYMN

SEQ ID NO: 24339 - protein, 7 aa, Artificial Sequence
  Description of Artificial Sequence: Synthetic peptide
  XENP020601 vlCDR2
AASNLES

SEQ ID NO: 24340 - protein, 9 aa, Artificial Sequence
  Description of Artificial Sequence: Synthetic peptide
  XENP020601 vlCDR3
QQSNEDPFT

SEQ ID NO: 24341 - protein, 450 aa, Artificial Sequence
  Description of Artificial Sequence: Synthetic polypeptide
  XENP020602 7G8_H0.146_L0_IgG1_PVA_/S267K Heavy Chain
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLANWGWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 24342 - protein, 121 aa, Artificial Sequence
  Description of Artificial Sequence: Synthetic polypeptide
  VH of XENP020602
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLANWGWYFDVWGAGTTVTVSS

SEQ ID NO: 24343 - protein, 5 aa, Artificial Sequence
  Description of Artificial Sequence: Synthetic peptide
  XENP020602 vhCDR1
DAWMD

SEQ ID NO: 24344 - protein, 19 aa, Artificial Sequence
  Description of Artificial Sequence: Synthetic peptide
  XENP020602 vhCDR2
EIRTKANNHATYYAESVKG

SEQ ID NO: 24345 - protein, 10 aa, Artificial Sequence
  Description of Artificial Sequence: Synthetic peptide
  XENP020602 vhCDR3
LANWGWYFDV

SEQ ID NO: 24346 - protein, 218 aa, Artificial Sequence; identical to SEQ ID NO: 22266
  Description of Artificial Sequence: Synthetic polypeptide
  XENP020602 7G8_H0.146_L0_IgG1_PVA_/S267K Light Chain

SEQ ID NO: 24347 - protein, 111 aa, Artificial Sequence; identical to SEQ ID NO: 22267
  Description of Artificial Sequence: Synthetic polypeptide
  VL of XENP020602

SEQ ID NO: 24348 - protein, 15 aa, Artificial Sequence
  Description of Artificial Sequence: Synthetic peptide
  XENP020602 vlCDR1
KASQSVDYDGDSYMN

SEQ ID NO: 24349 - protein, 7 aa, Artificial Sequence
  Description of Artificial Sequence: Synthetic peptide
  XENP020602 vlCDR2
AASNLES

SEQ ID NO: 24350 - protein, 9 aa, Artificial Sequence
  Description of Artificial Sequence: Synthetic peptide
  XENP020602 vlCDR3
QQSNEDPFT

SEQ ID NO: 24351 - protein, 450 aa, Artificial Sequence
  Description of Artificial Sequence: Synthetic polypeptide
  XENP020603 7G8_H0.147_L0_IgG1_PVA_/S267K Heavy Chain
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLANWYWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 24352 - protein, 121 aa, Artificial Sequence
  Description of Artificial Sequence: Synthetic polypeptide
  VH of XENP020603
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLANWYWYFDVWGAGTTVTVSS

SEQ ID NO: 24353 - protein, 5 aa, Artificial Sequence
  Description of Artificial Sequence: Synthetic peptide
  XENP020603 vhCDR1
DAWMD

SEQ ID NO: 24354 - protein, 19 aa, Artificial Sequence
  Description of Artificial Sequence: Synthetic peptide
  XENP020603 vhCDR2
EIRTKANNHATYYAESVKG

SEQ ID NO: 24355 - protein, 10 aa, Artificial Sequence
  Description of Artificial Sequence: Synthetic peptide
  XENP020603 vhCDR3
LANWYWYFDV

SEQ ID NO: 24356 - protein, 218 aa, Artificial Sequence; identical to SEQ ID NO: 22266
  Description of Artificial Sequence: Synthetic polypeptide
  XENP020603 7G8_H0.147_L0_IgG1_PVA_/S267K Light Chain

SEQ ID NO: 24357 - protein, 111 aa, Artificial Sequence; identical to SEQ ID NO: 22267
  Description of Artificial Sequence: Synthetic polypeptide
  VL of XENP020603

SEQ ID NO: 24358 - protein, 15 aa, Artificial Sequence
  Description of Artificial Sequence: Synthetic peptide
  XENP020603 vlCDR1
KASQSVDYDGDSYMN

SEQ ID NO: 24359 - protein, 7 aa, Artificial Sequence
  Description of Artificial Sequence: Synthetic peptide
  XENP020603 vlCDR2
AASNLES

SEQ ID NO: 24360 - protein, 9 aa, Artificial Sequence
  Description of Artificial Sequence: Synthetic peptide
  XENP020603 vlCDR3
QQSNEDPFT

SEQ ID NO: 24361 - protein, 450 aa, Artificial Sequence
  Description of Artificial Sequence: Synthetic polypeptide
  XENP020604 7G8_H0.148_L0_IgG1_PVA_/S267K Heavy Chain
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLANWDYYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 24362 - protein, 121 aa, Artificial Sequence
  Description of Artificial Sequence: Synthetic polypeptide
  VH of XENP020604
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLANWDYYFDVWGAGTTVTVSS

SEQ ID NO: 24363 - protein, 5 aa, Artificial Sequence
  Description of Artificial Sequence: Synthetic peptide
  XENP020604 vhCDR1
DAWMD

SEQ ID NO: 24364 - protein, 19 aa, Artificial Sequence
  Description of Artificial Sequence: Synthetic peptide
  XENP020604 vhCDR2
EIRTKANNHATYYAESVKG

SEQ ID NO: 24365 - protein, 10 aa, Artificial Sequence
  Description of Artificial Sequence: Synthetic peptide
  XENP020604 vhCDR3
LANWDYYFDV

SEQ ID NO: 24366 - protein, 218 aa, Artificial Sequence; identical to SEQ ID NO: 22266
  Description of Artificial Sequence: Synthetic polypeptide
  XENP020604 7G8_H0.148_L0_IgG1_PVA_/S267K Light Chain

SEQ ID NO: 24367 - protein, 111 aa, Artificial Sequence; identical to SEQ ID NO: 22267
  Description of Artificial Sequence: Synthetic polypeptide
  VL of XENP020604

SEQ ID NO: 24368 - protein, 15 aa, Artificial Sequence
  Description of Artificial Sequence: Synthetic peptide
  XENP020604 vlCDR1
KASQSVDYDGDSYMN

SEQ ID NO: 24369 - protein, 7 aa, Artificial Sequence
  Description of Artificial Sequence: Synthetic peptide
  XENP020604 vlCDR2
AASNLES

SEQ ID NO: 24370 - protein, 9 aa, Artificial Sequence
  Description of Artificial Sequence: Synthetic peptide
  XENP020604 vlCDR3
QQSNEDPFT

SEQ ID NO: 24371 - protein, 450 aa, Artificial Sequence; identical to SEQ ID NO: 22261
  Description of Artificial Sequence: Synthetic polypeptide
  XENP020605 7G8_H0_L0.1_IgG1_PVA_/S267K Heavy Chain

SEQ ID NO: 24372 - protein, 121 aa, Artificial Sequence; identical to SEQ ID NO: 22262
  Description of Artificial Sequence: Synthetic polypeptide
  VH of XENP020605

SEQ ID NO: 24373 - protein, 5 aa, Artificial Sequence
  Description of Artificial Sequence: Synthetic peptide
  XENP020605 vhCDR1
DAWMD

SEQ ID NO: 24374 - protein, 19 aa, Artificial Sequence
  Description of Artificial Sequence: Synthetic peptide
  XENP020605 vhCDR2
EIRTKANNHATYYAESVKG

SEQ ID NO: 24375 - protein, 10 aa, Artificial Sequence
  Description of Artificial Sequence: Synthetic peptide
  XENP020605 vhCDR3
LANWDWYFDV

SEQ ID NO: 24376 - protein, 218 aa, Artificial Sequence
  Description of Artificial Sequence: Synthetic polypeptide
  XENP020605 7G8_H0_L0.1_IgG1_PVA_/S267K Light Chain
DTVLTQSPASLAVSLGQRATISCKASQSVNYDGDSYMNWYQQKPGQPPKLLIYAASNLESGIPARLSGSGSGTDFTLNIHPVEEEDAATYYCQQSNEDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 24377 - protein, 111 aa, Artificial Sequence
  Description of Artificial Sequence: Synthetic polypeptide
  VL of XENP020605
DTVLTQSPASLAVSLGQRATISCKASQSVNYDGDSYMNWYQQKPGQPPKLLIYAASNLESGIPARLSGSGSGTDFTLNIHPVEEEDAATYYCQQSNEDPFTFGSGTKLEVK

SEQ ID NO: 24378 - protein, 15 aa, Artificial Sequence
  Description of Artificial Sequence: Synthetic peptide
  XENP020605 vlCDR1
KASQSVNYDGDSYMN

SEQ ID NO: 24379 - protein, 7 aa, Artificial Sequence
  Description of Artificial Sequence: Synthetic peptide
  XENP020605 vlCDR2
AASNLES

SEQ ID NO: 24380 - protein, 9 aa, Artificial Sequence
  Description of Artificial Sequence: Synthetic peptide
  XENP020605 vlCDR3
QQSNEDPFT

SEQ ID NO: 24381 - protein, 450 aa, Artificial Sequence; identical to SEQ ID NO: 22261
  Description of Artificial Sequence: Synthetic polypeptide
  XENP020606 7G8_H0_L0.2_IgG1_PVA_/S267K Heavy Chain

SEQ ID NO: 24382 - protein, 121 aa, Artificial Sequence; identical to SEQ ID NO: 22262
  Description of Artificial Sequence: Synthetic polypeptide
  VH of XENP020606

SEQ ID NO: 24383 - protein, 5 aa, Artificial Sequence
  Description of Artificial Sequence: Synthetic peptide
  XENP020606 vhCDR1
DAWMD

SEQ ID NO: 24384 - protein, 19 aa, Artificial Sequence
  Description of Artificial Sequence: Synthetic peptide
  XENP020606 vhCDR2
EIRTKANNHATYYAESVKG

SEQ ID NO: 24385 - protein, 10 aa, Artificial Sequence
  Description of Artificial Sequence: Synthetic peptide
  XENP020606 vhCDR3
LANWDWYFDV

SEQ ID NO: 24386 - protein, 218 aa, Artificial Sequence
  Description of Artificial Sequence: Synthetic polypeptide
  XENP020606 7G8_H0_L0.2_IgG1_PVA_/S267K Light Chain
DTVLTQSPASLAVSLGQRATISCKASQSVEYDGDSYMNWYQQKPGQPPKLLIYAASNLESGIPARLSGSGSGTDFTLNIHPVEEEDAATYYCQQSNEDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 24387 - protein, 111 aa, Artificial Sequence
  Description of Artificial Sequence: Synthetic polypeptide
  VL of XENP020606
DTVLTQSPASLAVSLGQRATISCKASQSVEYDGDSYMNWYQQKPGQPPKLLIYAASNLESGIPARLSGSGSGTDFTLNIHPVEEEDAATYYCQQSNEDPFTFGSGTKLEVK

SEQ ID NO: 24388 - protein, 15 aa, Artificial Sequence
  Description of Artificial Sequence: Synthetic peptide
  XENP020606 vlCDR1
KASQSVEYDGDSYMN

SEQ ID NO: 24389 - protein, 7 aa, Artificial Sequence
  Description of Artificial Sequence: Synthetic peptide
  XENP020606 vlCDR2
AASNLES

SEQ ID NO: 24390 - protein, 9 aa, Artificial Sequence
  Description of Artificial Sequence: Synthetic peptide
  XENP020606 vlCDR3
QQSNEDPFT

SEQ ID NO: 24391 - protein, 450 aa, Artificial Sequence; identical to SEQ ID NO: 22261
  Description of Artificial Sequence: Synthetic polypeptide
  XENP020607 7G8_H0_L0.3_IgG1_PVA_/S267K Heavy Chain

SEQ ID NO: 24392 - protein, 121 aa, Artificial Sequence; identical to SEQ ID NO: 22262
  Description of Artificial Sequence: Synthetic polypeptide
  VH of XENP020607

SEQ ID NO: 24393 - protein, 5 aa, Artificial Sequence
  Description of Artificial Sequence: Synthetic peptide
  XENP020607 vhCDR1
DAWMD

SEQ ID NO: 24394 - protein, 19 aa, Artificial Sequence
  Description of Artificial Sequence: Synthetic peptide
  XENP020607 vhCDR2
EIRTKANNHATYYAESVKG

SEQ ID NO: 24395 - protein, 10 aa, Artificial Sequence
  Description of Artificial Sequence: Synthetic peptide
  XENP020607 vhCDR3
LANWDWYFDV

SEQ ID NO: 24396 - protein, 218 aa, Artificial Sequence
  Description of Artificial Sequence: Synthetic polypeptide
  XENP020607 7G8_H0_L0.3_IgG1_PVA_/S267K Light Chain
DTVLTQSPASLAVSLGQRATISCKASQSVHYDGDSYMNWYQQKPGQPPKLLIYAASNLESGIPARLSGSGSGTDFTLNIHPVEEEDAATYYCQQSNEDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 24397 - protein, 111 aa, Artificial Sequence
  Description of Artificial Sequence: Synthetic polypeptide
  VL of XENP020607
DTVLTQSPASLAVSLGQRATISCKASQSVHYDGDSYMNWYQQKPGQPPKLLIYAASNLESGIPARLSGSGSGTDFTLNIHPVEEEDAATYYCQQSNEDPFTFGSGTKLEVK

SEQ ID NO: 24398 - protein, 15 aa, Artificial Sequence
  Description of Artificial Sequence: Synthetic peptide
  XENP020607 vlCDR1
KASQSVHYDGDSYMN

SEQ ID NO: 24399 - protein, 7 aa, Artificial Sequence
  Description of Artificial Sequence: Synthetic peptide
  XENP020607 vlCDR2
AASNLES

SEQ ID NO: 24400 - protein, 9 aa, Artificial Sequence
  Description of Artificial Sequence: Synthetic peptide
  XENP020607 vlCDR3
QQSNEDPFT

SEQ ID NO: 24401 - protein, 450 aa, Artificial Sequence; identical to SEQ ID NO: 22261
  Description of Artificial Sequence: Synthetic polypeptide
  XENP020608 7G8_H0_L0.4_IgG1_PVA_/S267K Heavy Chain

SEQ ID NO: 24402 - protein, 121 aa, Artificial Sequence; identical to SEQ ID NO: 22262
  Description of Artificial Sequence: Synthetic polypeptide
  VH of XENP020608

SEQ ID NO: 24403 - protein, 5 aa, Artificial Sequence
  Description of Artificial Sequence: Synthetic peptide
  XENP020608 vhCDR1
DAWMD

SEQ ID NO: 24404 - protein, 19 aa, Artificial Sequence
  Description of Artificial Sequence: Synthetic peptide
  XENP020608 vhCDR2
EIRTKANNHATYYAESVKG

SEQ ID NO: 24405 - protein, 10 aa, Artificial Sequence
  Description of Artificial Sequence: Synthetic peptide
  XENP020608 vhCDR3
LANWDWYFDV

SEQ ID NO: 24406 - protein, 218 aa, Artificial Sequence
  Description of Artificial Sequence: Synthetic polypeptide
  XENP020608 7G8_H0_L0.4_IgG1_PVA_/S267K Light Chain
DTVLTQSPASLAVSLGQRATISCKASQSVSYDGDSYMNWYQQKPGQPPKLLIYAASNLESGIPARLSGSGSGTDFTLNIHPVEEEDAATYYCQQSNEDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 24407 - protein, 111 aa, Artificial Sequence
  Description of Artificial Sequence: Synthetic polypeptide
  VL of XENP020608
DTVLTQSPASLAVSLGQRATISCKASQSVSYDGDSYMNWYQQKPGQPPKLLIYAASNLESGIPARLSGSGSGTDFTLNIHPVEEEDAATYYCQQSNEDPFTFGSGTKLEVK

SEQ ID NO: 24408 - protein, 15 aa, Artificial Sequence
  Description of Artificial Sequence: Synthetic peptide
  XENP020608 vlCDR1
KASQSVSYDGDSYMN

SEQ ID NO: 24409 - protein, 7 aa, Artificial Sequence
  Description of Artificial Sequence: Synthetic peptide
  XENP020608 vlCDR2
AASNLES

SEQ ID NO: 24410 - protein, 9 aa, Artificial Sequence
  Description of Artificial Sequence: Synthetic peptide
  XENP020608 vlCDR3
QQSNEDPFT

SEQ ID NO: 24411 - protein, 450 aa, Artificial Sequence; identical to SEQ ID NO: 22261
  Description of Artificial Sequence: Synthetic polypeptide
  XENP020609 7G8_H0_L0.5_IgG1_PVA_/S267K Heavy Chain

SEQ ID NO: 24412 - protein, 121 aa, Artificial Sequence; identical to SEQ ID NO: 22262
  Description of Artificial Sequence: Synthetic polypeptide
  VH of XENP020609

SEQ ID NO: 24413 - protein, 5 aa, Artificial Sequence
  Description of Artificial Sequence: Synthetic peptide
  XENP020609 vhCDR1
DAWMD

SEQ ID NO: 24414 - protein, 19 aa, Artificial Sequence
  Description of Artificial Sequence: Synthetic peptide
  XENP020609 vhCDR2
EIRTKANNHATYYAESVKG

SEQ ID NO: 24415 - protein, 10 aa, Artificial Sequence
  Description of Artificial Sequence: Synthetic peptide
  XENP020609 vhCDR3
LANWDWYFDV

SEQ ID NO: 24416 - protein, 218 aa, Artificial Sequence
  Description of Artificial Sequence: Synthetic polypeptide
  XENP020609 7G8_H0_L0.5_IgG1_PVA_/S267K Light Chain
DTVLTQSPASLAVSLGQRATISCKASQSVRYDGDSYMNWYQQKPGQPPKLLIYAASNLESGIPARLSGSGSGTDFTLNIHPVEEEDAATYYCQQSNEDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 24417 - protein, 111 aa, Artificial Sequence
  Description of Artificial Sequence: Synthetic polypeptide
  VL of XENP020609
DTVLTQSPASLAVSLGQRATISCKASQSVRYDGDSYMNWYQQKPGQPPKLLIYAASNLESGIPARLSGSGSGTDFTLNIHPVEEEDAATYYCQQSNEDPFTFGSGTKLEVK

SEQ ID NO: 24418 - protein, 15 aa, Artificial Sequence
  Description of Artificial Sequence: Synthetic peptide
  XENP020609 vlCDR1
KASQSVRYDGDSYMN

SEQ ID NO: 24419 - protein, 7 aa, Artificial Sequence
  Description of Artificial Sequence: Synthetic peptide
  XENP020609 vlCDR2
AASNLES

SEQ ID NO: 24420 - protein, 9 aa, Artificial Sequence
  Description of Artificial Sequence: Synthetic peptide
  XENP020609 vlCDR3
QQSNEDPFT

SEQ ID NO: 24421 - protein, 450 aa, Artificial Sequence; identical to SEQ ID NO: 22261
  Description of Artificial Sequence: Synthetic polypeptide
  XENP020610 7G8_H0_L0.6_IgG1_PVA_/S267K Heavy Chain

SEQ ID NO: 24422 - protein, 121 aa, Artificial Sequence; identical to SEQ ID NO: 22262
  Description of Artificial Sequence: Synthetic polypeptide
  VH of XENP020610

SEQ ID NO: 24423 - protein, 5 aa, Artificial Sequence
  Description of Artificial Sequence: Synthetic peptide
  XENP020610 vhCDR1
DAWMD

SEQ ID NO: 24424 - protein, 19 aa, Artificial Sequence
  Description of Artificial Sequence: Synthetic peptide
  XENP020610 vhCDR2
EIRTKANNHATYYAESVKG

SEQ ID NO: 24425 - protein, 10 aa, Artificial Sequence
  Description of Artificial Sequence: Synthetic peptide
  XENP020610 vhCDR3
LANWDWYFDV

SEQ ID NO: 24426 - protein, 218 aa, Artificial Sequence
  Description of Artificial Sequence: Synthetic polypeptide
  XENP020610 7G8_H0_L0.6_IgG1_PVA_/S267K Light Chain
DTVLTQSPASLAVSLGQRATISCKASQSVLYDGDSYMNWYQQKPGQPPKLLIYAASNLESGIPARLSGSGSGTDFTLNIHPVEEEDAATYYCQQSNEDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 24427 - protein, 111 aa, Artificial Sequence
  Description of Artificial Sequence: Synthetic polypeptide
  VL of XENP020610
DTVLTQSPASLAVSLGQRATISCKASQSVLYDGDSYMNWYQQKPGQPPKLLIYAASNLESGIPARLSGSGSGTDFTLNIHPVEEEDAATYYCQQSNEDPFTFGSGTKLEVK

SEQ ID NO: 24428 - protein, 15 aa, Artificial Sequence
  Description of Artificial Sequence: Synthetic peptide
  XENP020610 vlCDR1
KASQSVLYDGDSYMN

SEQ ID NO: 24429 - protein, 7 aa, Artificial Sequence
  Description of Artificial Sequence: Synthetic peptide
  XENP020610 vlCDR2
AASNLES

SEQ ID NO: 24430 - protein, 9 aa, Artificial Sequence
  Description of Artificial Sequence: Synthetic peptide
  XENP020610 vlCDR3
QQSNEDPFT

SEQ ID NO: 24431 - protein, 450 aa, Artificial Sequence; identical to SEQ ID NO: 22261
  Description of Artificial Sequence: Synthetic polypeptide
  XENP020611 7G8_H0_L0.7_IgG1_PVA_/S267K Heavy Chain

SEQ ID NO: 24432 - protein, 121 aa, Artificial Sequence; identical to SEQ ID NO: 22262
  Description of Artificial Sequence: Synthetic polypeptide
  VH of XENP020611

SEQ ID NO: 24433 - protein, 5 aa, Artificial Sequence
  Description of Artificial Sequence: Synthetic peptide
  XENP020611 vhCDR1
DAWMD

SEQ ID NO: 24434 - protein, 19 aa, Artificial Sequence
  Description of Artificial Sequence: Synthetic peptide
  XENP020611 vhCDR2
EIRTKANNHATYYAESVKG

SEQ ID NO: 24435 - protein, 10 aa, Artificial Sequence
  Description of Artificial Sequence: Synthetic peptide
  XENP020611 vhCDR3
LANWDWYFDV

SEQ ID NO: 24436 - protein, 218 aa, Artificial Sequence
  Description of Artificial Sequence: Synthetic polypeptide
  XENP020611 7G8_H0_L0.7_IgG1_PVA_/S267K Light Chain
DTVLTQSPASLAVSLGQRATISCKASQSVTYDGDSYMNWYQQKPGQPPKLLIYAASNLESGIPARLSGSGSGTDFTLNIHPVEEEDAATYYCQQSNEDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 24437 - protein, 111 aa, Artificial Sequence
  Description of Artificial Sequence: Synthetic polypeptide
  VL of XENP020611
DTVLTQSPASLAVSLGQRATISCKASQSVTYDGDSYMNWYQQKPGQPPKLLIYAASNLESGIPARLSGSGSGTDFTLNIHPVEEEDAATYYCQQSNEDPFTFGSGTKLEVK

SEQ ID NO: 24438 - protein, 15 aa, Artificial Sequence
  Description of Artificial Sequence: Synthetic peptide
  XENP020611 vlCDR1
KASQSVTYDGDSYMN

SEQ ID NO: 24439 - protein, 7 aa, Artificial Sequence
  Description of Artificial Sequence: Synthetic peptide
  XENP020611 vlCDR2
AASNLES

SEQ ID NO: 24440 - protein, 9 aa, Artificial Sequence
  Description of Artificial Sequence: Synthetic peptide
  XENP020611 vlCDR3
QQSNEDPFT

SEQ ID NO: 24441 - protein, 450 aa, Artificial Sequence; identical to SEQ ID NO: 22261
  Description of Artificial Sequence: Synthetic polypeptide
  XENP020612 7G8_H0_L0.8_IgG1_PVA_/S267K Heavy Chain

SEQ ID NO: 24442 - protein, 121 aa, Artificial Sequence; identical to SEQ ID NO: 22262
  Description of Artificial Sequence: Synthetic polypeptide
  VH of XENP020612

SEQ ID NO: 24443 - protein, 5 aa, Artificial Sequence
  Description of Artificial Sequence: Synthetic peptide
  XENP020612 vhCDR1
DAWMD

SEQ ID NO: 24444 - protein, 19 aa, Artificial Sequence
  Description of Artificial Sequence: Synthetic peptide
  XENP020612 vhCDR2
EIRTKANNHATYYAESVKG

SEQ ID NO: 24445 - protein, 10 aa, Artificial Sequence
  Description of Artificial Sequence: Synthetic peptide
  XENP020612 vhCDR3
LANWDWYFDV

SEQ ID NO: 24446 - protein, 218 aa, Artificial Sequence
  Description of Artificial Sequence: Synthetic polypeptide
  XENP020612 7G8_H0_L0.8_IgG1_PVA_/S267K Light Chain
DTVLTQSPASLAVSLGQRATISCKASQSVGYDGDSYMNWYQQKPGQPPKLLIYAASNLESGIPARLSGSGSGTDFTLNIHPVEEEDAATYYCQQSNEDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 24447 - protein, 111 aa, Artificial Sequence
  Description of Artificial Sequence: Synthetic polypeptide
  VL of XENP020612
DTVLTQSPASLAVSLGQRATISCKASQSVGYDGDSYMNWYQQKPGQPPKLLIYAASNLESGIPARLSGSGSGTDFTLNIHPVEEEDAATYYCQQSNEDPFTFGSGTKLEVK

SEQ ID NO: 24448 - protein, 15 aa, Artificial Sequence
  Description of Artificial Sequence: Synthetic peptide
  XENP020612 vlCDR1
KASQSVGYDGDSYMN

SEQ ID NO: 24449 - protein, 7 aa, Artificial Sequence
  Description of Artificial Sequence: Synthetic peptide
  XENP020612 vlCDR2
AASNLES

SEQ ID NO: 24450 - protein, 9 aa, Artificial Sequence
  Description of Artificial Sequence: Synthetic peptide
  XENP020612 vlCDR3
QQSNEDPFT

SEQ ID NO: 24451 - protein, 450 aa, Artificial Sequence; identical to SEQ ID NO: 22261
  Description of Artificial Sequence: Synthetic polypeptide
  XENP020613 7G8_H0_L0.9_IgG1_PVA_/S267K Heavy Chain

SEQ ID NO: 24452 - protein, 121 aa, Artificial Sequence; identical to SEQ ID NO: 22262
  Description of Artificial Sequence: Synthetic polypeptide
  VH of XENP020613

SEQ ID NO: 24453 - protein, 5 aa, Artificial Sequence
  Description of Artificial Sequence: Synthetic peptide
  XENP020613 vhCDR1
DAWMD

SEQ ID NO: 24454 - protein, 19 aa, Artificial Sequence
  Description of Artificial Sequence: Synthetic peptide
  XENP020613 vhCDR2
EIRTKANNHATYYAESVKG

SEQ ID NO: 24455 - protein, 10 aa, Artificial Sequence
  Description of Artificial Sequence: Synthetic peptide
  XENP020613 vhCDR3
LANWDWYFDV

SEQ ID NO: 24456 - protein, 218 aa, Artificial Sequence
  Description of Artificial Sequence: Synthetic polypeptide
  XENP020613 7G8_H0_L0.9_IgG1_PVA_/S267K Light Chain
DTVLTQSPASLAVSLGQRATISCKASQSVYYDGDSYMNWYQQKPGQPPKLLIYAASNLESGIPARLSGSGSGTDFTLNIHPVEEEDAATYYCQQSNEDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 24457 - protein, 111 aa, Artificial Sequence
  Description of Artificial Sequence: Synthetic polypeptide
  VL of XENP020613
DTVLTQSPASLAVSLGQRATISCKASQSVYYDGDSYMNWYQQKPGQPPKLLIYAASNLESGIPARLSGSGSGTDFTLNIHPVEEEDAATYYCQQSNEDPFTFGSGTKLEVK

SEQ ID NO: 24458 - protein, 15 aa, Artificial Sequence
  Description of Artificial Sequence: Synthetic peptide
  XENP020613 vlCDR1
KASQSVYYDGDSYMN

SEQ ID NO: 24459 - protein, 7 aa, Artificial Sequence
  Description of Artificial Sequence: Synthetic peptide
  XENP020613 vlCDR2
AASNLES

SEQ ID NO: 24460 - protein, 9 aa, Artificial Sequence
  Description of Artificial Sequence: Synthetic peptide
  XENP020613 vlCDR3
QQSNEDPFT

SEQ ID NO: 24461 - protein, 450 aa, Artificial Sequence; identical to SEQ ID NO: 22261
  Description of Artificial Sequence: Synthetic polypeptide
  XENP020614 7G8_H0_L0.10_IgG1_PVA_/S267K Heavy Chain

SEQ ID NO: 24462 - protein, 121 aa, Artificial Sequence; identical to SEQ ID NO: 22262
  Description of Artificial Sequence: Synthetic polypeptide
  VH of XENP020614

SEQ ID NO: 24463 - protein, 5 aa, Artificial Sequence
  Description of Artificial Sequence: Synthetic peptide
  XENP020614 vhCDR1
DAWMD

SEQ ID NO: 24464 - protein, 19 aa, Artificial Sequence
  Description of Artificial Sequence: Synthetic peptide
  XENP020614 vhCDR2
EIRTKANNHATYYAESVKG

SEQ ID NO: 24465 - protein, 10 aa, Artificial Sequence
  Description of Artificial Sequence: Synthetic peptide
  XENP020614 vhCDR3
LANWDWYFDV

SEQ ID NO: 24466 - protein, 218 aa, Artificial Sequence
  Description of Artificial Sequence: Synthetic polypeptide
  XENP020614 7G8_H0_L0.10_IgG1_PVA_/S267K Light Chain
DTVLTQSPASLAVSLGQRATISCKASQSVDFDGDSYMNWYQQKPGQPPKLLIYAASNLESGIPARLSGSGSGTDFTLNIHPVEEEDAATYYCQQSNEDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 24467 - protein, 111 aa, Artificial Sequence
  Description of Artificial Sequence: Synthetic polypeptide
  VL of XENP020614
DTVLTQSPASLAVSLGQRATISCKASQSVDFDGDSYMNWYQQKPGQPPKLLIYAASNLESGIPARLSGSGSGTDFTLNIHPVEEEDAATYYCQQSNEDPFTFGSGTKLEVK

SEQ ID NO: 24468 - protein, 15 aa, Artificial Sequence
  Description of Artificial Sequence: Synthetic peptide
  XENP020614 vlCDR1
KASQSVDFDGDSYMN

SEQ ID NO: 24469 - protein, 7 aa, Artificial Sequence
  Description of Artificial Sequence: Synthetic peptide
  XENP020614 vlCDR2
AASNLES

SEQ ID NO: 24470 - protein, 9 aa, Artificial Sequence
  Description of Artificial Sequence: Synthetic peptide
  XENP020614 vlCDR3
QQSNEDPFT

SEQ ID NO: 24471 - protein, 450 aa, Artificial Sequence; identical to SEQ ID NO: 22261
  Description of Artificial Sequence: Synthetic polypeptide
  XENP020615 7G8_H0_L0.11_IgG1_PVA_/S267K Heavy Chain

SEQ ID NO: 24472 - protein, 121 aa, Artificial Sequence; identical to SEQ ID NO: 22262
  Description of Artificial Sequence: Synthetic polypeptide
  VH of XENP020615

SEQ ID NO: 24473 - protein, 5 aa, Artificial Sequence
  Description of Artificial Sequence: Synthetic peptide
  XENP020615 vhCDR1
DAWMD

SEQ ID NO: 24474 - protein, 19 aa, Artificial Sequence
  Description of Artificial Sequence: Synthetic peptide
  XENP020615 vhCDR2
EIRTKANNHATYYAESVKG

SEQ ID NO: 24475 - protein, 10 aa, Artificial Sequence
  Description of Artificial Sequence: Synthetic peptide
  XENP020615 vhCDR3
LANWDWYFDV

SEQ ID NO: 24476 - protein, 218 aa, Artificial Sequence
  Description of Artificial Sequence: Synthetic polypeptide
  XENP020615 7G8_H0_L0.11_IgG1_PVA_/S267K Light Chain
DTVLTQSPASLAVSLGQRATISCKASQSVDHDGDSYMNWYQQKPGQPPKLLIYAASNLESGIPARLSGSGSGTDFTLNIHPVEEEDAATYYCQQSNEDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 24477 - protein, 111 aa, Artificial Sequence
  Description of Artificial Sequence: Synthetic polypeptide
  VL of XENP020615
DTVLTQSPASLAVSLGQRATISCKASQSVDHDGDSYMNWYQQKPGQPPKLLIYAASNLESGIPARLSGSGSGTDFTLNIHPVEEEDAATYYCQQSNEDPFTFGSGTKLEVK

SEQ ID NO: 24478 - protein, 15 aa, Artificial Sequence
  Description of Artificial Sequence: Synthetic peptide
  XENP020615 vlCDR1
KASQSVDHDGDSYMN

SEQ ID NO: 24479 - protein, 7 aa, Artificial Sequence
  Description of Artificial Sequence: Synthetic peptide
  XENP020615 vlCDR2
AASNLES

SEQ ID NO: 24480 - protein, 9 aa, Artificial Sequence
  Description of Artificial Sequence: Synthetic peptide
  XENP020615 vlCDR3
QQSNEDPFT

SEQ ID NO: 24481 - protein, 450 aa, Artificial Sequence; identical to SEQ ID NO: 22261
  Description of Artificial Sequence: Synthetic polypeptide
  XENP020616 7G8_H0_L0.12_IgG1_PVA_/S267K Heavy Chain

SEQ ID NO: 24482 - protein, 121 aa, Artificial Sequence; identical to SEQ ID NO: 22262
  Description of Artificial Sequence: Synthetic polypeptide
  VH of XENP020616

SEQ ID NO: 24483 - protein, 5 aa, Artificial Sequence
  Description of Artificial Sequence: Synthetic peptide
  XENP020616 vhCDR1
DAWMD

SEQ ID NO: 24484 - protein, 19 aa, Artificial Sequence
  Description of Artificial Sequence: Synthetic peptide
  XENP020616 vhCDR2
EIRTKANNHATYYAESVKG

SEQ ID NO: 24485 - protein, 10 aa, Artificial Sequence
  Description of Artificial Sequence: Synthetic peptide
  XENP020616 vhCDR3
LANWDWYFDV

SEQ ID NO: 24486 - protein, 218 aa, Artificial Sequence
  Description of Artificial Sequence: Synthetic polypeptide
  XENP020616 7G8_H0_L0.12_IgG1_PVA_/S267K Light Chain
DTVLTQSPASLAVSLGQRATISCKASQSVDLDGDSYMNWYQQKPGQPPKLLIYAASNLESGIPARLSGSGSGTDFTLNIHPVEEEDAATYYCQQSNEDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 24487 - protein, 111 aa, Artificial Sequence
  Description of Artificial Sequence: Synthetic polypeptide
  VL of XENP020616
DTVLTQSPASLAVSLGQRATISCKASQSVDLDGDSYMNWYQQKPGQPPKLLIYAASNLESGIPARLSGSGSGTDFTLNIHPVEEEDAATYYCQQSNEDPFTFGSGTKLEVK

SEQ ID NO: 24488 - protein, 15 aa, Artificial Sequence
  Description of Artificial Sequence: Synthetic peptide
  XENP020616 vlCDR1
KASQSVDLDGDSYMN

SEQ ID NO: 24489 - protein, 7 aa, Artificial Sequence
  Description of Artificial Sequence: Synthetic peptide
  XENP020616 vlCDR2
AASNLES

SEQ ID NO: 24490 - protein, 9 aa, Artificial Sequence
  Description of Artificial Sequence: Synthetic peptide
  XENP020616 vlCDR3
QQSNEDPFT

SEQ ID NO: 24491 - protein, 450 aa, Artificial Sequence; identical to SEQ ID NO: 22261
  Description of Artificial Sequence: Synthetic polypeptide
  XENP020617 7G8_H0_L0.13_IgG1_PVA_/S267K Heavy Chain

SEQ ID NO: 24492 - protein, 121 aa, Artificial Sequence; identical to SEQ ID NO: 22262
  Description of Artificial Sequence: Synthetic polypeptide
  VH of XENP020617

SEQ ID NO: 24493 - protein, 5 aa, Artificial Sequence
  Description of Artificial Sequence: Synthetic peptide
  XENP020617 vhCDR1
DAWMD

SEQ ID NO: 24494 - protein, 19 aa, Artificial Sequence
  Description of Artificial Sequence: Synthetic peptide
  XENP020617 vhCDR2
EIRTKANNHATYYAESVKG

SEQ ID NO: 24495 - protein, 10 aa, Artificial Sequence
  Description of Artificial Sequence: Synthetic peptide
  XENP020617 vhCDR3
LANWDWYFDV

SEQ ID NO: 24496 - protein, 218 aa, Artificial Sequence
  Description of Artificial Sequence: Synthetic polypeptide
  XENP020617 7G8_H0_L0.13_IgG1_PVA_/S267K Light Chain
DTVLTQSPASLAVSLGQRATISCKASQSVDWDGDSYMNWYQQKPGQPPKLLIYAASNLESGIPARLSGSGSGTDFTLNIHPVEEEDAATYYCQQSNEDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 24497 - protein, 111 aa, Artificial Sequence
  Description of Artificial Sequence: Synthetic polypeptide
  VL of XENP020617
DTVLTQSPASLAVSLGQRATISCKASQSVDWDGDSYMNWYQQKPGQPPKLLIYAASNLESGIPARLSGSGSGTDFTLNIHPVEEEDAATYYCQQSNEDPFTFGSGTKLEVK

SEQ ID NO: 24498 - protein, 15 aa, Artificial Sequence
  Description of Artificial Sequence: Synthetic peptide
  XENP020617 vlCDR1
KASQSVDWDGDSYMN

SEQ ID NO: 24499 - protein, 7 aa, Artificial Sequence
  Description of Artificial Sequence: Synthetic peptide
  XENP020617 vlCDR2
AASNLES

SEQ ID NO: 24500 - protein, 9 aa, Artificial Sequence
  Description of Artificial Sequence: Synthetic peptide
  XENP020617 vlCDR3
QQSNEDPFT

SEQ ID NO: 24501 - protein, 450 aa, Artificial Sequence; identical to SEQ ID NO: 22261
  Description of Artificial Sequence: Synthetic polypeptide
  XENP020618 7G8_H0_L0.14_IgG1_PVA_/S267K Heavy Chain

SEQ ID NO: 24502 - protein, 121 aa, Artificial Sequence; identical to SEQ ID NO: 22262
  Description of Artificial Sequence: Synthetic polypeptide
  VH of XENP020618

SEQ ID NO: 24503 - protein, 5 aa, Artificial Sequence
  Description of Artificial Sequence: Synthetic peptide
  XENP020618 vhCDR1
DAWMD

SEQ ID NO: 24504 - protein, 19 aa, Artificial Sequence
  Description of Artificial Sequence: Synthetic peptide
  XENP020618 vhCDR2
EIRTKANNHATYYAESVKG

SEQ ID NO: 24505 - protein, 10 aa, Artificial Sequence
  Description of Artificial Sequence: Synthetic peptide
  XENP020618 vhCDR3
LANWDWYFDV

SEQ ID NO: 24506 - protein, 218 aa, Artificial Sequence
  Description of Artificial Sequence: Synthetic polypeptide
  XENP020618 7G8_H0_L0.14_IgG1_PVA_/S267K Light Chain
DTVLTQSPASLAVSLGQRATISCKASQSVDVDGDSYMNWYQQKPGQPPKLLIYAASNLESGIPARLSGSGSGTDFTLNIHPVEEEDAATYYCQQSNEDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 24507 - protein, 111 aa, Artificial Sequence
  Description of Artificial Sequence: Synthetic polypeptide
  VL of XENP020618
DTVLTQSPASLAVSLGQRATISCKASQSVDVDGDSYMNWYQQKPGQPPKLLIYAASNLESGIPARLSGSGSGTDFTLNIHPVEEEDAATYYCQQSNEDPFTFGSGTKLEVK

SEQ ID NO: 24508 - protein, 15 aa, Artificial Sequence
  Description of Artificial Sequence: Synthetic peptide
  XENP020618 vlCDR1
KASQSVDVDGDSYMN

SEQ ID NO: 24509 - protein, 7 aa, Artificial Sequence
  Description of Artificial Sequence: Synthetic peptide
  XENP020618 vlCDR2
AASNLES

SEQ ID NO: 24510 - protein, 9 aa, Artificial Sequence
  Description of Artificial Sequence: Synthetic peptide
  XENP020618 vlCDR3
QQSNEDPFT

SEQ ID NO: 24511 - protein, 450 aa, Artificial Sequence; identical to SEQ ID NO: 22261
  Description of Artificial Sequence: Synthetic polypeptide
  XENP020619 7G8_H0_L0.15_IgG1_PVA_/S267K Heavy Chain

SEQ ID NO: 24512 - protein, 121 aa, Artificial Sequence; identical to SEQ ID NO: 22262
  Description of Artificial Sequence: Synthetic polypeptide
  VH of XENP020619

SEQ ID NO: 24513 - protein, 5 aa, Artificial Sequence
  Description of Artificial Sequence: Synthetic peptide
  XENP020619 vhCDR1
DAWMD

SEQ ID NO: 24514 - protein, 19 aa, Artificial Sequence
  Description of Artificial Sequence: Synthetic peptide
  XENP020619 vhCDR2
EIRTKANNHATYYAESVKG

SEQ ID NO: 24515 - protein, 10 aa, Artificial Sequence
  Description of Artificial Sequence: Synthetic peptide
  XENP020619 vhCDR3
LANWDWYFDV

SEQ ID NO: 24516 - protein, 218 aa, Artificial Sequence
  Description of Artificial Sequence: Synthetic polypeptide
  XENP020619 7G8_H0_L0.15_IgG1_PVA_/S267K Light Chain
DTVLTQSPASLAVSLGQRATISCKASQSVDADGDSYMNWYQQKPGQPPKLLIYAASNLESGIPARLSGSGSGTDFTLNIHPVEEEDAATYYCQQSNEDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 24517 - protein, 111 aa, Artificial Sequence
  Description of Artificial Sequence: Synthetic polypeptide
  VL of XENP020619
DTVLTQSPASLAVSLGQRATISCKASQSVDADGDSYMNWYQQKPGQPPKLLIYAASNLESGIPARLSGSGSGTDFTLNIHPVEEEDAATYYCQQSNEDPFTFGSGTKLEVK

SEQ ID NO: 24518 - protein, 15 aa, Artificial Sequence
  Description of Artificial Sequence: Synthetic peptide
  XENP020619 vlCDR1
KASQSVDADGDSYMN

SEQ ID NO: 24519 - protein, 7 aa, Artificial Sequence
  Description of Artificial Sequence: Synthetic peptide
  XENP020619 vlCDR2
AASNLES

SEQ ID NO: 24520 - protein, 9 aa, Artificial Sequence
  Description of Artificial Sequence: Synthetic peptide
  XENP020619 vlCDR3
QQSNEDPFT

SEQ ID NO: 24521 - protein, 450 aa, Artificial Sequence; identical to SEQ ID NO: 22261
  Description of Artificial Sequence: Synthetic polypeptide
  XENP020620 7G8_H0_L0.16_IgG1_PVA_/S267K Heavy Chain

SEQ ID NO: 24522 - protein, 121 aa, Artificial Sequence; identical to SEQ ID NO: 22262
  Description of Artificial Sequence: Synthetic polypeptide
  VH of XENP020620

SEQ ID NO: 24523 - protein, 5 aa, Artificial Sequence
  Description of Artificial Sequence: Synthetic peptide
  XENP020620 vhCDR1
DAWMD

SEQ ID NO: 24524 - protein, 19 aa, Artificial Sequence
  Description of Artificial Sequence: Synthetic peptide
  XENP020620 vhCDR2
EIRTKANNHATYYAESVKG

SEQ ID NO: 24525 - protein, 10 aa, Artificial Sequence
  Description of Artificial Sequence: Synthetic peptide
  XENP020620 vhCDR3
LANWDWYFDV

SEQ ID NO: 24526 - protein, 218 aa, Artificial Sequence
  Description of Artificial Sequence: Synthetic polypeptide
  XENP020620 7G8_H0_L0.16_IgG1_PVA_/S267K Light Chain
DTVLTQSPASLAVSLGQRATISCKASQSVDQDGDSYMNWYQQKPGQPPKLLIYAASNLESGIPARLSGSGSGTDFTLNIHPVEEEDAATYYCQQSNEDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 24527 - protein, 111 aa, Artificial Sequence
  Description of Artificial Sequence: Synthetic polypeptide
  VL of XENP020620
DTVLTQSPASLAVSLGQRATISCKASQSVDQDGDSYMNWYQQKPGQPPKLLIYAASNLESGIPARLSGSGSGTDFTLNIHPVEEEDAATYYCQQSNEDPFTFGSGTKLEVK

SEQ ID NO: 24528 - protein, 15 aa, Artificial Sequence
  Description of Artificial Sequence: Synthetic peptide
  XENP020620 vlCDR1
KASQSVDQDGDSYMN

SEQ ID NO: 24529 - protein, 7 aa, Artificial Sequence
  Description of Artificial Sequence: Synthetic peptide
  XENP020620 vlCDR2
AASNLES

SEQ ID NO: 24530 - protein, 9 aa, Artificial Sequence
  Description of Artificial Sequence: Synthetic peptide
  XENP020620 vlCDR3
QQSNEDPFT

SEQ ID NO: 24531 - protein, 450 aa, Artificial Sequence; identical to SEQ ID NO: 22261
  Description of Artificial Sequence: Synthetic polypeptide
  XENP020621 7G8_H0_L0.17_IgG1_PVA_/S267K Heavy Chain

SEQ ID NO: 24532 - protein, 121 aa, Artificial Sequence; identical to SEQ ID NO: 22262
  Description of Artificial Sequence: Synthetic polypeptide
  VH of XENP020621

SEQ ID NO: 24533 - protein, 5 aa, Artificial Sequence
  Description of Artificial Sequence: Synthetic peptide
  XENP020621 vhCDR1
DAWMD

SEQ ID NO: 24534 - protein, 19 aa, Artificial Sequence
  Description of Artificial Sequence: Synthetic peptide
  XENP020621 vhCDR2
EIRTKANNHATYYAESVKG

SEQ ID NO: 24535 - protein, 10 aa, Artificial Sequence
  Description of Artificial Sequence: Synthetic peptide
  XENP020621 vhCDR3
LANWDWYFDV

SEQ ID NO: 24536 - protein, 218 aa, Artificial Sequence
  Description of Artificial Sequence: Synthetic polypeptide
  XENP020621 7G8_H0_L0.17_IgG1_PVA_/S267K Light Chain
DTVLTQSPASLAVSLGQRATISCKASQSVDDDGDSYMNWYQQKPGQPPKLLIYAASNLESGIPARLSGSGSGTDFTLNIHPVEEEDAATYYCQQSNEDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 24537 - protein, 111 aa, Artificial Sequence
  Description of Artificial Sequence: Synthetic polypeptide
  VL of XENP020621
DTVLTQSPASLAVSLGQRATISCKASQSVDDDGDSYMNWYQQKPGQPPKLLIYAASNLESGIPARLSGSGSGTDFTLNIHPVEEEDAATYYCQQSNEDPFTFGSGTKLEVK

SEQ ID NO: 24538 - protein, 15 aa, Artificial Sequence
  Description of Artificial Sequence: Synthetic peptide
  XENP020621 vlCDR1
KASQSVDDDGDSYMN

SEQ ID NO: 24539 - protein, 7 aa, Artificial Sequence
  Description of Artificial Sequence: Synthetic peptide
  XENP020621 vlCDR2
AASNLES

SEQ ID NO: 24540 - protein, 9 aa, Artificial Sequence
  Description of Artificial Sequence: Synthetic peptide
  XENP020621 vlCDR3
QQSNEDPFT

SEQ ID NO: 24541 - protein, 450 aa, Artificial Sequence; identical to SEQ ID NO: 22261
  Description of Artificial Sequence: Synthetic polypeptide
  XENP020622 7G8_H0_L0.18_IgG1_PVA_/S267K Heavy Chain

SEQ ID NO: 24542 - protein, 121 aa, Artificial Sequence; identical to SEQ ID NO: 22262
  Description of Artificial Sequence: Synthetic polypeptide
  VH of XENP020622

SEQ ID NO: 24543 - protein, 5 aa, Artificial Sequence
  Description of Artificial Sequence: Synthetic peptide
  XENP020622 vhCDR1
DAWMD

SEQ ID NO: 24544 - protein, 19 aa, Artificial Sequence
  Description of Artificial Sequence: Synthetic peptide
  XENP020622 vhCDR2
EIRTKANNHATYYAESVKG

SEQ ID NO: 24545 - protein, 10 aa, Artificial Sequence
  Description of Artificial Sequence: Synthetic peptide
  XENP020622 vhCDR3
LANWDWYFDV

SEQ ID NO: 24546 - protein, 218 aa, Artificial Sequence
  Description of Artificial Sequence: Synthetic polypeptide
  XENP020622 7G8_H0_L0.18_IgG1_PVA_/S267K Light Chain
DTVLTQSPASLAVSLGQRATISCKASQSVDKDGDSYMNWYQQKPGQPPKLLIYAASNLESGIPARLSGSGSGTDFTLNIHPVEEEDAATYYCQQSNEDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 24547 - protein, 111 aa, Artificial Sequence
  Description of Artificial Sequence: Synthetic polypeptide
  VL of XENP020622
DTVLTQSPASLAVSLGQRATISCKASQSVDKDGDSYMNWYQQKPGQPPKLLIYAASNLESGIPARLSGSGSGTDFTLNIHPVEEEDAATYYCQQSNEDPFTFGSGTKLEVK

SEQ ID NO: 24548 - protein, 15 aa, Artificial Sequence
  Description of Artificial Sequence: Synthetic peptide
  XENP020622 vlCDR1
KASQSVDKDGDSYMN

SEQ ID NO: 24549 - protein, 7 aa, Artificial Sequence
  Description of Artificial Sequence: Synthetic peptide
  XENP020622 vlCDR2
AASNLES

SEQ ID NO: 24550 - protein, 9 aa, Artificial Sequence
  Description of Artificial Sequence: Synthetic peptide
  XENP020622 vlCDR3
QQSNEDPFT

SEQ ID NO: 24551 - protein, 450 aa, Artificial Sequence; identical to SEQ ID NO: 22261
  Description of Artificial Sequence: Synthetic polypeptide
  XENP020623 7G8_H0_L0.19_IgG1_PVA_/S267K Heavy Chain

SEQ ID NO: 24552 - protein, 121 aa, Artificial Sequence; identical to SEQ ID NO: 22262
  Description of Artificial Sequence: Synthetic polypeptide
  VH of XENP020623

SEQ ID NO: 24553 - protein, 5 aa, Artificial Sequence
  Description of Artificial Sequence: Synthetic peptide
  XENP020623 vhCDR1
DAWMD

SEQ ID NO: 24554 - protein, 19 aa, Artificial Sequence
  Description of Artificial Sequence: Synthetic peptide
  XENP020623 vhCDR2
EIRTKANNHATYYAESVKG

SEQ ID NO: 24555 - protein, 10 aa, Artificial Sequence
  Description of Artificial Sequence: Synthetic peptide
  XENP020623 vhCDR3
LANWDWYFDV

SEQ ID NO: 24556 - protein, 218 aa, Artificial Sequence
  Description of Artificial Sequence: Synthetic polypeptide
  XENP020623 7G8_H0_L0.19_IgG1_PVA_/S267K Light Chain
DTVLTQSPASLAVSLGQRATISCKASQSVDNDGDSYMNWYQQKPGQPPKLLIYAASNLESGIPARLSGSGSGTDFTLNIHPVEEEDAATYYCQQSNEDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 24557 - protein, 111 aa, Artificial Sequence
  Description of Artificial Sequence: Synthetic polypeptide
  VL of XENP020623
DTVLTQSPASLAVSLGQRATISCKASQSVDNDGDSYMNWYQQKPGQPPKLLIYAASNLESGIPARLSGSGSGTDFTLNIHPVEEEDAATYYCQQSNEDPFTFGSGTKLEVK

SEQ ID NO: 24558 - protein, 15 aa, Artificial Sequence
  Description of Artificial Sequence: Synthetic peptide
  XENP020623 vlCDR1
KASQSVDNDGDSYMN

SEQ ID NO: 24559 - protein, 7 aa, Artificial Sequence
  Description of Artificial Sequence: Synthetic peptide
  XENP020623 vlCDR2
AASNLES

SEQ ID NO: 24560 - protein, 9 aa, Artificial Sequence
  Description of Artificial Sequence: Synthetic peptide
  XENP020623 vlCDR3
QQSNEDPFT

SEQ ID NO: 24561 - protein, 450 aa, Artificial Sequence; identical to SEQ ID NO: 22261
  Description of Artificial Sequence: Synthetic polypeptide
  XENP020624 7G8_H0_L0.20_IgG1_PVA_/S267K Heavy Chain

SEQ ID NO: 24562 - protein, 121 aa, Artificial Sequence; identical to SEQ ID NO: 22262
  Description of Artificial Sequence: Synthetic polypeptide
  VH of XENP020624

SEQ ID NO: 24563 - protein, 5 aa, Artificial Sequence
  Description of Artificial Sequence: Synthetic peptide
  XENP020624 vhCDR1
DAWMD

SEQ ID NO: 24564 - protein, 19 aa, Artificial Sequence
  Description of Artificial Sequence: Synthetic peptide
  XENP020624 vhCDR2
EIRTKANNHATYYAESVKG

SEQ ID NO: 24565 - protein, 10 aa, Artificial Sequence
  Description of Artificial Sequence: Synthetic peptide
  XENP020624 vhCDR3
LANWDWYFDV

SEQ ID NO: 24566 - protein, 218 aa, Artificial Sequence
  Description of Artificial Sequence: Synthetic polypeptide
  XENP020624 7G8_H0_L0.20_IgG1_PVA_/S267K Light Chain
DTVLTQSPASLAVSLGQRATISCKASQSVDYNGDSYMNWYQQKPGQPPKLLIYAASNLESGIPARLSGSGSGTDFTLNIHPVEEEDAATYYCQQSNEDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 24567 - protein, 111 aa, Artificial Sequence
  Description of Artificial Sequence: Synthetic polypeptide
  VL of XENP020624
DTVLTQSPASLAVSLGQRATISCKASQSVDYNGDSYMNWYQQKPGQPPKLLIYAASNLESGIPARLSGSGSGTDFTLNIHPVEEEDAATYYCQQSNEDPFTFGSGTKLEVK

SEQ ID NO: 24568 - protein, 15 aa, Artificial Sequence
  Description of Artificial Sequence: Synthetic peptide
  XENP020624 vlCDR1
KASQSVDYNGDSYMN

SEQ ID NO: 24569 - protein, 7 aa, Artificial Sequence
  Description of Artificial Sequence: Synthetic peptide
  XENP020624 vlCDR2
AASNLES

SEQ ID NO: 24570 - protein, 9 aa, Artificial Sequence
  Description of Artificial Sequence: Synthetic peptide
  XENP020624 vlCDR3
QQSNEDPFT

SEQ ID NO: 24571 - protein, 450 aa, Artificial Sequence; identical to SEQ ID NO: 22261
  Description of Artificial Sequence: Synthetic polypeptide
  XENP020625 7G8_H0_L0.21_IgG1_PVA_/S267K Heavy Chain

SEQ ID NO: 24572 - protein, 121 aa, Artificial Sequence; identical to SEQ ID NO: 22262
  Description of Artificial Sequence: Synthetic polypeptide
  VH of XENP020625

SEQ ID NO: 24573 - protein, 5 aa, Artificial Sequence
  Description of Artificial Sequence: Synthetic peptide
  XENP020625 vhCDR1
DAWMD

SEQ ID NO: 24574 - protein, 19 aa, Artificial Sequence
  Description of Artificial Sequence: Synthetic peptide
  XENP020625 vhCDR2
EIRTKANNHATYYAESVKG

SEQ ID NO: 24575 - protein, 10 aa, Artificial Sequence
  Description of Artificial Sequence: Synthetic peptide
  XENP020625 vhCDR3
LANWDWYFDV

SEQ ID NO: 24576 - protein, 218 aa, Artificial Sequence
  Description of Artificial Sequence: Synthetic polypeptide
  XENP020625 7G8_H0_L0.21_IgG1_PVA_/S267K Light Chain
DTVLTQSPASLAVSLGQRATISCKASQSVDYEGDSYMNWYQQKPGQPPKLLIYAASNLESGIPARLSGSGSGTDFTLNIHPVEEEDAATYYCQQSNEDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 24577 - protein, 111 aa, Artificial Sequence
  Description of Artificial Sequence: Synthetic polypeptide
  VL of XENP020625
DTVLTQSPASLAVSLGQRATISCKASQSVDYEGDSYMNWYQQKPGQPPKLLIYAASNLESGIPARLSGSGSGTDFTLNIHPVEEEDAATYYCQQSNEDPFTFGSGTKLEVK

SEQ ID NO: 24578 - protein, 15 aa, Artificial Sequence
  Description of Artificial Sequence: Synthetic peptide
  XENP020625 vlCDR1
KASQSVDYEGDSYMN

SEQ ID NO: 24579 - protein, 7 aa, Artificial Sequence
  Description of Artificial Sequence: Synthetic peptide
  XENP020625 vlCDR2
AASNLES

SEQ ID NO: 24580 - protein, 9 aa, Artificial Sequence
  Description of Artificial Sequence: Synthetic peptide
  XENP020625 vlCDR3
QQSNEDPFT

SEQ ID NO: 24581 - protein, 450 aa, Artificial Sequence; identical to SEQ ID NO: 22261
  Description of Artificial Sequence: Synthetic polypeptide
  XENP020626 7G8_H0_L0.22_IgG1_PVA_/S267K Heavy Chain

SEQ ID NO: 24582 - protein, 121 aa, Artificial Sequence; identical to SEQ ID NO: 22262
  Description of Artificial Sequence: Synthetic polypeptide
  VH of XENP020626

SEQ ID NO: 24583 - protein, 5 aa, Artificial Sequence
  Description of Artificial Sequence: Synthetic peptide
  XENP020626 vhCDR1
DAWMD

SEQ ID NO: 24584 - protein, 19 aa, Artificial Sequence
  Description of Artificial Sequence: Synthetic peptide
  XENP020626 vhCDR2
EIRTKANNHATYYAESVKG

SEQ ID NO: 24585 - protein, 10 aa, Artificial Sequence
  Description of Artificial Sequence: Synthetic peptide
  XENP020626 vhCDR3
LANWDWYFDV

SEQ ID NO: 24586 - protein, 218 aa, Artificial Sequence
  Description of Artificial Sequence: Synthetic polypeptide
  XENP020626 7G8_H0_L0.22_IgG1_PVA_/S267K Light Chain
DTVLTQSPASLAVSLGQRATISCKASQSVDYHGDSYMNWYQQKPGQPPKLLIYAASNLESGIPARLSGSGSGTDFTLNIHPVEEEDAATYYCQQSNEDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 24587 - protein, 111 aa, Artificial Sequence
  Description of Artificial Sequence: Synthetic polypeptide
  VL of XENP020626
DTVLTQSPASLAVSLGQRATISCKASQSVDYHGDSYMNWYQQKPGQPPKLLIYAASNLESGIPARLSGSGSGTDFTLNIHPVEEEDAATYYCQQSNEDPFTFGSGTKLEVK

SEQ ID NO: 24588 - protein, 15 aa, Artificial Sequence
  Description of Artificial Sequence: Synthetic peptide
  XENP020626 vlCDR1
KASQSVDYHGDSYMN

SEQ ID NO: 24589 - protein, 7 aa, Artificial Sequence
  Description of Artificial Sequence: Synthetic peptide
  XENP020626 vlCDR2
AASNLES

SEQ ID NO: 24590 - protein, 9 aa, Artificial Sequence
  Description of Artificial Sequence: Synthetic peptide
  XENP020626 vlCDR3
QQSNEDPFT

SEQ ID NO: 24591 - protein, 450 aa, Artificial Sequence; identical to SEQ ID NO: 22261
  Description of Artificial Sequence: Synthetic polypeptide
  XENP020627 7G8_H0_L0.23_IgG1_PVA_/S267K Heavy Chain

SEQ ID NO: 24592 - protein, 121 aa, Artificial Sequence; identical to SEQ ID NO: 22262
  Description of Artificial Sequence: Synthetic polypeptide
  VH of XENP020627

SEQ ID NO: 24593 - protein, 5 aa, Artificial Sequence
  Description of Artificial Sequence: Synthetic peptide
  XENP020627 vhCDR1
DAWMD

SEQ ID NO: 24594 - protein, 19 aa, Artificial Sequence
  Description of Artificial Sequence: Synthetic peptide
  XENP020627 vhCDR2
EIRTKANNHATYYAESVKG

SEQ ID NO: 24595 - protein, 10 aa, Artificial Sequence
  Description of Artificial Sequence: Synthetic peptide
  XENP020627 vhCDR3
LANWDWYFDV

SEQ ID NO: 24596 - protein, 218 aa, Artificial Sequence
  Description of Artificial Sequence: Synthetic polypeptide
  XENP020627 7G8_H0_L0.23_IgG1_PVA_/S267K Light Chain
DTVLTQSPASLAVSLGQRATISCKASQSVDYSGDSYMNWYQQKPGQPPKLLIYAASNLESGIPARLSGSGSGTDFTLNIHPVEEEDAATYYCQQSNEDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 24597 - protein, 111 aa, Artificial Sequence
  Description of Artificial Sequence: Synthetic polypeptide
  VL of XENP020627
DTVLTQSPASLAVSLGQRATISCKASQSVDYSGDSYMNWYQQKPGQPPKLLIYAASNLESGIPARLSGSGSGTDFTLNIHPVEEEDAATYYCQQSNEDPFTFGSGTKLEVK

SEQ ID NO: 24598 - protein, 15 aa, Artificial Sequence
  Description of Artificial Sequence: Synthetic peptide
  XENP020627 vlCDR1
KASQSVDYSGDSYMN

SEQ ID NO: 24599 - protein, 7 aa, Artificial Sequence
  Description of Artificial Sequence: Synthetic peptide
  XENP020627 vlCDR2
AASNLES

SEQ ID NO: 24600 - protein, 9 aa, Artificial Sequence
  Description of Artificial Sequence: Synthetic peptide
  XENP020627 vlCDR3
QQSNEDPFT

SEQ ID NO: 24601 - protein, 450 aa, Artificial Sequence; identical to SEQ ID NO: 22261
  Description of Artificial Sequence: Synthetic polypeptide
  XENP020628 7G8_H0_L0.24_IgG1_PVA_/S267K Heavy Chain

SEQ ID NO: 24602 - protein, 121 aa, Artificial Sequence; identical to SEQ ID NO: 22262
  Description of Artificial Sequence: Synthetic polypeptide
  VH of XENP020628

SEQ ID NO: 24603 - protein, 5 aa, Artificial Sequence
  Description of Artificial Sequence: Synthetic peptide
  XENP020628 vhCDR1
DAWMD

SEQ ID NO: 24604 - protein, 19 aa, Artificial Sequence
  Description of Artificial Sequence: Synthetic peptide
  XENP020628 vhCDR2
EIRTKANNHATYYAESVKG

SEQ ID NO: 24605 - protein, 10 aa, Artificial Sequence
  Description of Artificial Sequence: Synthetic peptide
  XENP020628 vhCDR3
LANWDWYFDV

SEQ ID NO: 24606 - protein, 218 aa, Artificial Sequence
  Description of Artificial Sequence: Synthetic polypeptide
  XENP020628 7G8_H0_L0.24_IgG1_PVA_/S267K Light Chain
DTVLTQSPASLAVSLGQRATISCKASQSVDYRGDSYMNWYQQKPGQPPKLLIYAASNLESGIPARLSGSGSGTDFTLNIHPVEEEDAATYYCQQSNEDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 24607 - protein, 111 aa, Artificial Sequence
  Description of Artificial Sequence: Synthetic polypeptide
  VL of XENP020628
DTVLTQSPASLAVSLGQRATISCKASQSVDYRGDSYMNWYQQKPGQPPKLLIYAASNLESGIPARLSGSGSGTDFTLNIHPVEEEDAATYYCQQSNEDPFTFGSGTKLEVK

SEQ ID NO: 24608 - protein, 15 aa, Artificial Sequence
  Description of Artificial Sequence: Synthetic peptide
  XENP020628 vlCDR1
KASQSVDYRGDSYMN

SEQ ID NO: 24609 - protein, 7 aa, Artificial Sequence
  Description of Artificial Sequence: Synthetic peptide
  XENP020628 vlCDR2
AASNLES

SEQ ID NO: 24610 - protein, 9 aa, Artificial Sequence
  Description of Artificial Sequence: Synthetic peptide
  XENP020628 vlCDR3
QQSNEDPFT

SEQ ID NO: 24611 - protein, 450 aa, Artificial Sequence; identical to SEQ ID NO: 22261
  Description of Artificial Sequence: Synthetic polypeptide
  XENP020629 7G8_H0_L0.25_IgG1_PVA_/S267K Heavy Chain

SEQ ID NO: 24612 - protein, 121 aa, Artificial Sequence; identical to SEQ ID NO: 22262
  Description of Artificial Sequence: Synthetic polypeptide
  VH of XENP020629

SEQ ID NO: 24613 - protein, 5 aa, Artificial Sequence
  Description of Artificial Sequence: Synthetic peptide
  XENP020629 vhCDR1
DAWMD

SEQ ID NO: 24614 - protein, 19 aa, Artificial Sequence
  Description of Artificial Sequence: Synthetic peptide
  XENP020629 vhCDR2
EIRTKANNHATYYAESVKG

SEQ ID NO: 24615 - protein, 10 aa, Artificial Sequence
  Description of Artificial Sequence: Synthetic peptide
  XENP020629 vhCDR3
LANWDWYFDV

SEQ ID NO: 24616 - protein, 218 aa, Artificial Sequence
  Description of Artificial Sequence: Synthetic polypeptide
  XENP020629 7G8_H0_L0.25_IgG1_PVA_/S267K Light Chain
DTVLTQSPASLAVSLGQRATISCKASQSVDYLGDSYMNWYQQKPGQPPKLLIYAASNLESGIPARLSGSGSGTDFTLNIHPVEEEDAATYYCQQSNEDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 24617 - protein, 111 aa, Artificial Sequence
  Description of Artificial Sequence: Synthetic polypeptide
  VL of XENP020629
DTVLTQSPASLAVSLGQRATISCKASQSVDYLGDSYMNWYQQKPGQPPKLLIYAASNLESGIPARLSGSGSGTDFTLNIHPVEEEDAATYYCQQSNEDPFTFGSGTKLEVK

SEQ ID NO: 24618 - protein, 15 aa, Artificial Sequence
  Description of Artificial Sequence: Synthetic peptide
  XENP020629 vlCDR1
KASQSVDYLGDSYMN

SEQ ID NO: 24619 - protein, 7 aa, Artificial Sequence
  Description of Artificial Sequence: Synthetic peptide
  XENP020629 vlCDR2
AASNLES

SEQ ID NO: 24620 - protein, 9 aa, Artificial Sequence
  Description of Artificial Sequence: Synthetic peptide
  XENP020629 vlCDR3
QQSNEDPFT

SEQ ID NO: 24621 - protein, 450 aa, Artificial Sequence; identical to SEQ ID NO: 22261
  Description of Artificial Sequence: Synthetic polypeptide
  XENP020630 7G8_H0_L0.26_IgG1_PVA_/S267K Heavy Chain

SEQ ID NO: 24622 - protein, 121 aa, Artificial Sequence; identical to SEQ ID NO: 22262
  Description of Artificial Sequence: Synthetic polypeptide
  VH of XENP020630

SEQ ID NO: 24623 - protein, 5 aa, Artificial Sequence
  Description of Artificial Sequence: Synthetic peptide
  XENP020630 vhCDR1
DAWMD

SEQ ID NO: 24624 - protein, 19 aa, Artificial Sequence
  Description of Artificial Sequence: Synthetic peptide
  XENP020630 vhCDR2
EIRTKANNHATYYAESVKG

SEQ ID NO: 24625 - protein, 10 aa, Artificial Sequence
  Description of Artificial Sequence: Synthetic peptide
  XENP020630 vhCDR3
LANWDWYFDV

SEQ ID NO: 24626 - protein, 218 aa, Artificial Sequence
  Description of Artificial Sequence: Synthetic polypeptide
  XENP020630 7G8_H0_L0.26_IgG1_PVA_/S267K Light Chain
DTVLTQSPASLAVSLGQRATISCKASQSVDYTGDSYMNWYQQKPGQPPKLLIYAASNLESGIPARLSGSGSGTDFTLNIHPVEEEDAATYYCQQSNEDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 24627 - protein, 111 aa, Artificial Sequence
  Description of Artificial Sequence: Synthetic polypeptide
  VL of XENP020630
DTVLTQSPASLAVSLGQRATISCKASQSVDYTGDSYMNWYQQKPGQPPKLLIYAASNLESGIPARLSGSGSGTDFTLNIHPVEEEDAATYYCQQSNEDPFTFGSGTKLEVK

SEQ ID NO: 24628 - protein, 15 aa, Artificial Sequence
  Description of Artificial Sequence: Synthetic peptide
  XENP020630 vlCDR1
KASQSVDYTGDSYMN

SEQ ID NO: 24629 - protein, 7 aa, Artificial Sequence
  Description of Artificial Sequence: Synthetic peptide
  XENP020630 vlCDR2
AASNLES

SEQ ID NO: 24630 - protein, 9 aa, Artificial Sequence
  Description of Artificial Sequence: Synthetic peptide
  XENP020630 vlCDR3
QQSNEDPFT

SEQ ID NO: 24631 - protein, 450 aa, Artificial Sequence; identical to SEQ ID NO: 22261
  Description of Artificial Sequence: Synthetic polypeptide
  XENP020631 7G8_H0_L0.27_IgG1_PVA_/S267K Heavy Chain

SEQ ID NO: 24632 - protein, 121 aa, Artificial Sequence; identical to SEQ ID NO: 22262
  Description of Artificial Sequence: Synthetic polypeptide
  VH of XENP020631

SEQ ID NO: 24633 - protein, 5 aa, Artificial Sequence
  Description of Artificial Sequence: Synthetic peptide
  XENP020631 vhCDR1
DAWMD

SEQ ID NO: 24634 - protein, 19 aa, Artificial Sequence
  Description of Artificial Sequence: Synthetic peptide
  XENP020631 vhCDR2
EIRTKANNHATYYAESVKG

SEQ ID NO: 24635 - protein, 10 aa, Artificial Sequence
  Description of Artificial Sequence: Synthetic peptide
  XENP020631 vhCDR3
LANWDWYFDV

SEQ ID NO: 24636 - protein, 218 aa, Artificial Sequence
  Description of Artificial Sequence: Synthetic polypeptide
  XENP020631 7G8_H0_L0.27_IgG1_PVA_/S267K Light Chain
DTVLTQSPASLAVSLGQRATISCKASQSVDYGGDSYMNWYQQKPGQPPKLLIYAASNLESGIPARLSGSGSGTDFTLNIHPVEEEDAATYYCQQSNEDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 24637 - protein, 111 aa, Artificial Sequence
  Description of Artificial Sequence: Synthetic polypeptide
  VL of XENP020631
DTVLTQSPASLAVSLGQRATISCKASQSVDYGGDSYMNWYQQKPGQPPKLLIYAASNLESGIPARLSGSGSGTDFTLNIHPVEEEDAATYYCQQSNEDPFTFGSGTKLEVK

SEQ ID NO: 24638 - protein, 15 aa, Artificial Sequence
  Description of Artificial Sequence: Synthetic peptide
  XENP020631 vlCDR1
KASQSVDYGGDSYMN

SEQ ID NO: 24639 - protein, 7 aa, Artificial Sequence
  Description of Artificial Sequence: Synthetic peptide
  XENP020631 vlCDR2
AASNLES

SEQ ID NO: 24640 - protein, 9 aa, Artificial Sequence
  Description of Artificial Sequence: Synthetic peptide
  XENP020631 vlCDR3
QQSNEDPFT

SEQ ID NO: 24641 - protein, 450 aa, Artificial Sequence; identical to SEQ ID NO: 22261
  Description of Artificial Sequence: Synthetic polypeptide
  XENP020632 7G8_H0_L0.28_IgG1_PVA_/S267K Heavy Chain

SEQ ID NO: 24642 - protein, 121 aa, Artificial Sequence; identical to SEQ ID NO: 22262
  Description of Artificial Sequence: Synthetic polypeptide
  VH of XENP020632

SEQ ID NO: 24643 - protein, 5 aa, Artificial Sequence
  Description of Artificial Sequence: Synthetic peptide
  XENP020632 vhCDR1
DAWMD

SEQ ID NO: 24644 - protein, 19 aa, Artificial Sequence
  Description of Artificial Sequence: Synthetic peptide
  XENP020632 vhCDR2
EIRTKANNHATYYAESVKG

SEQ ID NO: 24645 - protein, 10 aa, Artificial Sequence
  Description of Artificial Sequence: Synthetic peptide
  XENP020632 vhCDR3
LANWDWYFDV

SEQ ID NO: 24646 - protein, 218 aa, Artificial Sequence
  Description of Artificial Sequence: Synthetic polypeptide
  XENP020632 7G8_H0_L0.28_IgG1_PVA_/S267K Light Chain
DTVLTQSPASLAVSLGQRATISCKASQSVDYYGDSYMNWYQQKPGQPPKLLIYAASNLESGIPARLSGSGSGTDFTLNIHPVEEEDAATYYCQQSNEDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 24647 - protein, 111 aa, Artificial Sequence
  Description of Artificial Sequence: Synthetic polypeptide
  VL of XENP020632
DTVLTQSPASLAVSLGQRATISCKASQSVDYYGDSYMNWYQQKPGQPPKLLIYAASNLESGIPARLSGSGSGTDFTLNIHPVEEEDAATYYCQQSNEDPFTFGSGTKLEVK

SEQ ID NO: 24648 - protein, 15 aa, Artificial Sequence
  Description of Artificial Sequence: Synthetic peptide
  XENP020632 vlCDR1
KASQSVDYYGDSYMN

SEQ ID NO: 24649 - protein, 7 aa, Artificial Sequence
  Description of Artificial Sequence: Synthetic peptide
  XENP020632 vlCDR2
AASNLES

SEQ ID NO: 24650 - protein, 9 aa, Artificial Sequence
  Description of Artificial Sequence: Synthetic peptide
  XENP020632 vlCDR3
QQSNEDPFT

SEQ ID NO: 24651 - protein, 450 aa, Artificial Sequence; identical to SEQ ID NO: 22261
  Description of Artificial Sequence: Synthetic polypeptide
  XENP020633 7G8_H0_L0.29_IgG1_PVA_/S267K Heavy Chain

SEQ ID NO: 24652 - protein, 121 aa, Artificial Sequence; identical to SEQ ID NO: 22262
  Description of Artificial Sequence: Synthetic polypeptide
  VH of XENP020633

SEQ ID NO: 24653 - protein, 5 aa, Artificial Sequence
  Description of Artificial Sequence: Synthetic peptide
  XENP020633 vhCDR1
DAWMD

SEQ ID NO: 24654 - protein, 19 aa, Artificial Sequence
  Description of Artificial Sequence: Synthetic peptide
  XENP020633 vhCDR2
EIRTKANNHATYYAESVKG

SEQ ID NO: 24655 - protein, 10 aa, Artificial Sequence
  Description of Artificial Sequence: Synthetic peptide
  XENP020633 vhCDR3
LANWDWYFDV

SEQ ID NO: 24656 - protein, 218 aa, Artificial Sequence
  Description of Artificial Sequence: Synthetic polypeptide
  XENP020633 7G8_H0_L0.29_IgG1_PVA_/S267K Light Chain
DTVLTQSPASLAVSLGQRATISCKASQSVDYDADSYMNWYQQKPGQPPKLLIYAASNLESGIPARLSGSGSGTDFTLNIHPVEEEDAATYYCQQSNEDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 24657 - protein, 111 aa, Artificial Sequence
  Description of Artificial Sequence: Synthetic polypeptide
  VL of XENP020633
DTVLTQSPASLAVSLGQRATISCKASQSVDYDADSYMNWYQQKPGQPPKLLIYAASNLESGIPARLSGSGSGTDFTLNIHPVEEEDAATYYCQQSNEDPFTFGSGTKLEVK

SEQ ID NO: 24658 - protein, 15 aa, Artificial Sequence
  Description of Artificial Sequence: Synthetic peptide
  XENP020633 vlCDR1
KASQSVDYDADSYMN

SEQ ID NO: 24659 - protein, 7 aa, Artificial Sequence
  Description of Artificial Sequence: Synthetic peptide
  XENP020633 vlCDR2
AASNLES

SEQ ID NO: 24660 - protein, 9 aa, Artificial Sequence
  Description of Artificial Sequence: Synthetic peptide
  XENP020633 vlCDR3
QQSNEDPFT

SEQ ID NO: 24661 - protein, 450 aa, Artificial Sequence; identical to SEQ ID NO: 22261
  Description of Artificial Sequence: Synthetic polypeptide
  XENP020634 7G8_H0_L0.30_IgG1_PVA_/S267K Heavy Chain

SEQ ID NO: 24662 - protein, 121 aa, Artificial Sequence; identical to SEQ ID NO: 22262
  Description of Artificial Sequence: Synthetic polypeptide
  VH of XENP020634

SEQ ID NO: 24663 - protein, 5 aa, Artificial Sequence
  Description of Artificial Sequence: Synthetic peptide
  XENP020634 vhCDR1
DAWMD

SEQ ID NO: 24664 - protein, 19 aa, Artificial Sequence
  Description of Artificial Sequence: Synthetic peptide
  XENP020634 vhCDR2
EIRTKANNHATYYAESVKG

SEQ ID NO: 24665 - protein, 10 aa, Artificial Sequence
  Description of Artificial Sequence: Synthetic peptide
  XENP020634 vhCDR3
LANWDWYFDV

SEQ ID NO: 24666 - protein, 218 aa, Artificial Sequence
  Description of Artificial Sequence: Synthetic polypeptide
  XENP020634 7G8_H0_L0.30_IgG1_PVA_/S267K Light Chain
DTVLTQSPASLAVSLGQRATISCKASQSVDYDSDSYMNWYQQKPGQPPKLLIYAASNLESGIPARLSGSGSGTDFTLNIHPVEEEDAATYYCQQSNEDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 24667 - protein, 111 aa, Artificial Sequence
  Description of Artificial Sequence: Synthetic polypeptide
  VL of XENP020634
DTVLTQSPASLAVSLGQRATISCKASQSVDYDSDSYMNWYQQKPGQPPKLLIYAASNLESGIPARLSGSGSGTDFTLNIHPVEEEDAATYYCQQSNEDPFTFGSGTKLEVK

SEQ ID NO: 24668 - protein, 15 aa, Artificial Sequence
  Description of Artificial Sequence: Synthetic peptide
  XENP020634 vlCDR1
KASQSVDYDSDSYMN

SEQ ID NO: 24669 - protein, 7 aa, Artificial Sequence
  Description of Artificial Sequence: Synthetic peptide
  XENP020634 vlCDR2
AASNLES

SEQ ID NO: 24670 - protein, 9 aa, Artificial Sequence
  Description of Artificial Sequence: Synthetic peptide
  XENP020634 vlCDR3
QQSNEDPFT

SEQ ID NO: 24671 - protein, 450 aa, Artificial Sequence; identical to SEQ ID NO: 22261
  Description of Artificial Sequence: Synthetic polypeptide
  XENP020635 7G8_H0_L0.31_IgG1_PVA_/S267K Heavy Chain

SEQ ID NO: 24672 - protein, 121 aa, Artificial Sequence; identical to SEQ ID NO: 22262
  Description of Artificial Sequence: Synthetic polypeptide
  VH of XENP020635

SEQ ID NO: 24673 - protein, 5 aa, Artificial Sequence
  Description of Artificial Sequence: Synthetic peptide
  XENP020635 vhCDR1
DAWMD

SEQ ID NO: 24674 - protein, 19 aa, Artificial Sequence
  Description of Artificial Sequence: Synthetic peptide
  XENP020635 vhCDR2
EIRTKANNHATYYAESVKG

SEQ ID NO: 24675 - protein, 10 aa, Artificial Sequence
  Description of Artificial Sequence: Synthetic peptide
  XENP020635 vhCDR3
LANWDWYFDV

SEQ ID NO: 24676 - protein, 218 aa, Artificial Sequence
  Description of Artificial Sequence: Synthetic polypeptide
  XENP020635 7G8_H0_L0.31_IgG1_PVA_/S267K Light Chain
DTVLTQSPASLAVSLGQRATISCKASQSVDYDTDSYMNWYQQKPGQPPKLLIYAASNLESGIPARLSGSGSGTDFTLNIHPVEEEDAATYYCQQSNEDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 24677 - protein, 111 aa, Artificial Sequence
  Description of Artificial Sequence: Synthetic polypeptide
  VL of XENP020635
DTVLTQSPASLAVSLGQRATISCKASQSVDYDTDSYMNWYQQKPGQPPKLLIYAASNLESGIPARLSGSGSGTDFTLNIHPVEEEDAATYYCQQSNEDPFTFGSGTKLEVK

SEQ ID NO: 24678 - protein, 15 aa, Artificial Sequence
  Description of Artificial Sequence: Synthetic peptide
  XENP020635 vlCDR1
KASQSVDYDTDSYMN

SEQ ID NO: 24679 - protein, 7 aa, Artificial Sequence
  Description of Artificial Sequence: Synthetic peptide
  XENP020635 vlCDR2
AASNLES

SEQ ID NO: 24680 - protein, 9 aa, Artificial Sequence
  Description of Artificial Sequence: Synthetic peptide
  XENP020635 vlCDR3
QQSNEDPFT

SEQ ID NO: 24681 - protein, 450 aa, Artificial Sequence; identical to SEQ ID NO: 22261
  Description of Artificial Sequence: Synthetic polypeptide
  XENP020636 7G8_H0_L0.32_IgG1_PVA_/S267K Heavy Chain

SEQ ID NO: 24682 - protein, 121 aa, Artificial Sequence; identical to SEQ ID NO: 22262
  Description of Artificial Sequence: Synthetic polypeptide
  VH of XENP020636

SEQ ID NO: 24683 - protein, 5 aa, Artificial Sequence
  Description of Artificial Sequence: Synthetic peptide
  XENP020636 vhCDR1
DAWMD

SEQ ID NO: 24684 - protein, 19 aa, Artificial Sequence
  Description of Artificial Sequence: Synthetic peptide
  XENP020636 vhCDR2
EIRTKANNHATYYAESVKG

SEQ ID NO: 24685 - protein, 10 aa, Artificial Sequence
  Description of Artificial Sequence: Synthetic peptide
  XENP020636 vhCDR3
LANWDWYFDV

SEQ ID NO: 24686 - protein, 218 aa, Artificial Sequence
  Description of Artificial Sequence: Synthetic polypeptide
  XENP020636 7G8_H0_L0.32_IgG1_PVA_/S267K Light Chain
DTVLTQSPASLAVSLGQRATISCKASQSVDYDQDSYMNWYQQKPGQPPKLLIYAASNLESGIPARLSGSGSGTDFTLNIHPVEEEDAATYYCQQSNEDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 24687 - protein, 111 aa, Artificial Sequence
  Description of Artificial Sequence: Synthetic polypeptide
  VL of XENP020636
DTVLTQSPASLAVSLGQRATISCKASQSVDYDQDSYMNWYQQKPGQPPKLLIYAASNLESGIPARLSGSGSGTDFTLNIHPVEEEDAATYYCQQSNEDPFTFGSGTKLEVK

SEQ ID NO: 24688 - protein, 15 aa, Artificial Sequence
  Description of Artificial Sequence: Synthetic peptide
  XENP020636 vlCDR1
KASQSVDYDQDSYMN

SEQ ID NO: 24689 - protein, 7 aa, Artificial Sequence
  Description of Artificial Sequence: Synthetic peptide
  XENP020636 vlCDR2
AASNLES

SEQ ID NO: 24690 - protein, 9 aa, Artificial Sequence
  Description of Artificial Sequence: Synthetic peptide
  XENP020636 vlCDR3
QQSNEDPFT

SEQ ID NO: 24691 - protein, 450 aa, Artificial Sequence; identical to SEQ ID NO: 22261
  Description of Artificial Sequence: Synthetic polypeptide
  XENP020637 7G8_H0_L0.33_IgG1_PVA_/S267K Heavy Chain

SEQ ID NO: 24692 - protein, 121 aa, Artificial Sequence; identical to SEQ ID NO: 22262
  Description of Artificial Sequence: Synthetic polypeptide
  VH of XENP020637

SEQ ID NO: 24693 - protein, 5 aa, Artificial Sequence
  Description of Artificial Sequence: Synthetic peptide
  XENP020637 vhCDR1
DAWMD

SEQ ID NO: 24694 - protein, 19 aa, Artificial Sequence
  Description of Artificial Sequence: Synthetic peptide
  XENP020637 vhCDR2
EIRTKANNHATYYAESVKG

SEQ ID NO: 24695 - protein, 10 aa, Artificial Sequence
  Description of Artificial Sequence: Synthetic peptide
  XENP020637 vhCDR3
LANWDWYFDV

SEQ ID NO: 24696 - protein, 218 aa, Artificial Sequence
  Description of Artificial Sequence: Synthetic polypeptide
  XENP020637 7G8_H0_L0.33_IgG1_PVA_/S267K Light Chain
DTVLTQSPASLAVSLGQRATISCKASQSVDYDHDSYMNWYQQKPGQPPKLLIYAASNLESGIPARLSGSGSGTDFTLNIHPVEEEDAATYYCQQSNEDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 24697 - protein, 111 aa, Artificial Sequence
  Description of Artificial Sequence: Synthetic polypeptide
  VL of XENP020637
DTVLTQSPASLAVSLGQRATISCKASQSVDYDHDSYMNWYQQKPGQPPKLLIYAASNLESGIPARLSGSGSGTDFTLNIHPVEEEDAATYYCQQSNEDPFTFGSGTKLEVK

SEQ ID NO: 24698 - protein, 15 aa, Artificial Sequence
  Description of Artificial Sequence: Synthetic peptide
  XENP020637 vlCDR1
KASQSVDYDHDSYMN

SEQ ID NO: 24699 - protein, 7 aa, Artificial Sequence
  Description of Artificial Sequence: Synthetic peptide
  XENP020637 vlCDR2
AASNLES

SEQ ID NO: 24700 - protein, 9 aa, Artificial Sequence
  Description of Artificial Sequence: Synthetic peptide
  XENP020637 vlCDR3
QQSNEDPFT

SEQ ID NO: 24701 - protein, 450 aa, Artificial Sequence; identical to SEQ ID NO: 22261
  Description of Artificial Sequence: Synthetic polypeptide
  XENP020638 7G8_H0_L0.34_IgG1_PVA_/S267K Heavy Chain

SEQ ID NO: 24702 - protein, 121 aa, Artificial Sequence; identical to SEQ ID NO: 22262
  Description of Artificial Sequence: Synthetic polypeptide
  VH of XENP020638

SEQ ID NO: 24703 - protein, 5 aa, Artificial Sequence
  Description of Artificial Sequence: Synthetic peptide
  XENP020638 vhCDR1
DAWMD

SEQ ID NO: 24704 - protein, 19 aa, Artificial Sequence
  Description of Artificial Sequence: Synthetic peptide
  XENP020638 vhCDR2
EIRTKANNHATYYAESVKG

SEQ ID NO: 24705 - protein, 10 aa, Artificial Sequence
  Description of Artificial Sequence: Synthetic peptide
  XENP020638 vhCDR3
LANWDWYFDV

SEQ ID NO: 24706 - protein, 218 aa, Artificial Sequence
  Description of Artificial Sequence: Synthetic polypeptide
  XENP020638 7G8_H0_L0.34_IgG1_PVA_/S267K Light Chain
DTVLTQSPASLAVSLGQRATISCKASQSVDYDDDSYMNWYQQKPGQPPKLLIYAASNLESGIPARLSGSGSGTDFTLNIHPVEEEDAATYYCQQSNEDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 24707 - protein, 111 aa, Artificial Sequence
  Description of Artificial Sequence: Synthetic polypeptide
  VL of XENP020638
DTVLTQSPASLAVSLGQRATISCKASQSVDYDDDSYMNWYQQKPGQPPKLLIYAASNLESGIPARLSGSGSGTDFTLNIHPVEEEDAATYYCQQSNEDPFTFGSGTKLEVK

SEQ ID NO: 24708 - protein, 15 aa, Artificial Sequence
  Description of Artificial Sequence: Synthetic peptide
  XENP020638 vlCDR1
KASQSVDYDDDSYMN

SEQ ID NO: 24709 - protein, 7 aa, Artificial Sequence
  Description of Artificial Sequence: Synthetic peptide
  XENP020638 vlCDR2
AASNLES

SEQ ID NO: 24710 - protein, 9 aa, Artificial Sequence
  Description of Artificial Sequence: Synthetic peptide
  XENP020638 vlCDR3
QQSNEDPFT

SEQ ID NO: 24711 - protein, 450 aa, Artificial Sequence; identical to SEQ ID NO: 22261
  Description of Artificial Sequence: Synthetic polypeptide
  XENP020639 7G8_H0_L0.35_IgG1_PVA_/S267K Heavy Chain

SEQ ID NO: 24712 - protein, 121 aa, Artificial Sequence; identical to SEQ ID NO: 22262
  Description of Artificial Sequence: Synthetic polypeptide
  VH of XENP020639

SEQ ID NO: 24713 - protein, 5 aa, Artificial Sequence
  Description of Artificial Sequence: Synthetic peptide
  XENP020639 vhCDR1
DAWMD

SEQ ID NO: 24714 - protein, 19 aa, Artificial Sequence
  Description of Artificial Sequence: Synthetic peptide
  XENP020639 vhCDR2
EIRTKANNHATYYAESVKG

SEQ ID NO: 24715 - protein, 10 aa, Artificial Sequence
  Description of Artificial Sequence: Synthetic peptide
  XENP020639 vhCDR3
LANWDWYFDV

SEQ ID NO: 24716 - protein, 218 aa, Artificial Sequence
  Description of Artificial Sequence: Synthetic polypeptide
  XENP020639 7G8_H0_L0.35_IgG1_PVA_/S267K Light Chain
DTVLTQSPASLAVSLGQRATISCKASQSVDYDKDSYMNWYQQKPGQPPKLLIYAASNLESGIPARLSGSGSGTDFTLNIHPVEEEDAATYYCQQSNEDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 24717 - protein, 111 aa, Artificial Sequence
  Description of Artificial Sequence: Synthetic polypeptide
  VL of XENP020639
DTVLTQSPASLAVSLGQRATISCKASQSVDYDKDSYMNWYQQKPGQPPKLLIYAASNLESGIPARLSGSGSGTDFTLNIHPVEEEDAATYYCQQSNEDPFTFGSGTKLEVK

SEQ ID NO: 24718 - protein, 15 aa, Artificial Sequence
  Description of Artificial Sequence: Synthetic peptide
  XENP020639 vlCDR1
KASQSVDYDKDSYMN

SEQ ID NO: 24719 - protein, 7 aa, Artificial Sequence
  Description of Artificial Sequence: Synthetic peptide
  XENP020639 vlCDR2
AASNLES

SEQ ID NO: 24720 - protein, 9 aa, Artificial Sequence
  Description of Artificial Sequence: Synthetic peptide
  XENP020639 vlCDR3
QQSNEDPFT

SEQ ID NO: 24721 - protein, 450 aa, Artificial Sequence; identical to SEQ ID NO: 22261
  Description of Artificial Sequence: Synthetic polypeptide
  XENP020640 7G8_H0_L0.36_IgG1_PVA_/S267K Heavy Chain

SEQ ID NO: 24722 - protein, 121 aa, Artificial Sequence; identical to SEQ ID NO: 22262
  Description of Artificial Sequence: Synthetic polypeptide
  VH of XENP020640

SEQ ID NO: 24723 - protein, 5 aa, Artificial Sequence
  Description of Artificial Sequence: Synthetic peptide
  XENP020640 vhCDR1
DAWMD

SEQ ID NO: 24724 - protein, 19 aa, Artificial Sequence
  Description of Artificial Sequence: Synthetic peptide
  XENP020640 vhCDR2
EIRTKANNHATYYAESVKG

SEQ ID NO: 24725 - protein, 10 aa, Artificial Sequence
  Description of Artificial Sequence: Synthetic peptide
  XENP020640 vhCDR3
LANWDWYFDV

SEQ ID NO: 24726 - protein, 218 aa, Artificial Sequence
  Description of Artificial Sequence: Synthetic polypeptide
  XENP020640 7G8_H0_L0.36_IgG1_PVA_/S267K Light Chain
DTVLTQSPASLAVSLGQRATISCKASQSVDYDLDSYMNWYQQKPGQPPKLLIYAASNLESGIPARLSGSGSGTDFTLNIHPVEEEDAATYYCQQSNEDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 24727 - protein, 111 aa, Artificial Sequence
  Description of Artificial Sequence: Synthetic polypeptide
  VL of XENP020640
DTVLTQSPASLAVSLGQRATISCKASQSVDYDLDSYMNWYQQKPGQPPKLLIYAASNLESGIPARLSGSGSGTDFTLNIHPVEEEDAATYYCQQSNEDPFTFGSGTKLEVK

SEQ ID NO: 24728 - protein, 15 aa, Artificial Sequence
  Description of Artificial Sequence: Synthetic peptide
  XENP020640 vlCDR1
KASQSVDYDLDSYMN

SEQ ID NO: 24729 - protein, 7 aa, Artificial Sequence
  Description of Artificial Sequence: Synthetic peptide
  XENP020640 vlCDR2
AASNLES

SEQ ID NO: 24730 - protein, 9 aa, Artificial Sequence
  Description of Artificial Sequence: Synthetic peptide
  XENP020640 vlCDR3
QQSNEDPFT

SEQ ID NO: 24731 - protein, 450 aa, Artificial Sequence; identical to SEQ ID NO: 22261
  Description of Artificial Sequence: Synthetic polypeptide
  XENP020641 7G8_H0_L0.37_IgG1_PVA_/S267K Heavy Chain

SEQ ID NO: 24732 - protein, 121 aa, Artificial Sequence; identical to SEQ ID NO: 22262
  Description of Artificial Sequence: Synthetic polypeptide
  VH of XENP020641

SEQ ID NO: 24733 - protein, 5 aa, Artificial Sequence
  Description of Artificial Sequence: Synthetic peptide
  XENP020641 vhCDR1
DAWMD

SEQ ID NO: 24734 - protein, 19 aa, Artificial Sequence
  Description of Artificial Sequence: Synthetic peptide
  XENP020641 vhCDR2
EIRTKANNHATYYAESVKG

SEQ ID NO: 24735 - protein, 10 aa, Artificial Sequence
  Description of Artificial Sequence: Synthetic peptide
  XENP020641 vhCDR3
LANWDWYFDV

SEQ ID NO: 24736 - protein, 218 aa, Artificial Sequence
  Description of Artificial Sequence: Synthetic polypeptide
  XENP020641 7G8_H0_L0.37_IgG1_PVA_/S267K Light Chain
DTVLTQSPASLAVSLGQRATISCKASQSVDYDYDSYMNWYQQKPGQPPKLLIYAASNLESGIPARLSGSGSGTDFTLNIHPVEEEDAATYYCQQSNEDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 24737 - protein, 111 aa, Artificial Sequence
  Description of Artificial Sequence: Synthetic polypeptide
  VL of XENP020641
DTVLTQSPASLAVSLGQRATISCKASQSVDYDYDSYMNWYQQKPGQPPKLLIYAASNLESGIPARLSGSGSGTDFTLNIHPVEEEDAATYYCQQSNEDPFTFGSGTKLEVK

SEQ ID NO: 24738 - protein, 15 aa, Artificial Sequence
  Description of Artificial Sequence: Synthetic peptide
  XENP020641 vlCDR1
KASQSVDYDYDSYMN

SEQ ID NO: 24739 - protein, 7 aa, Artificial Sequence
  Description of Artificial Sequence: Synthetic peptide
  XENP020641 vlCDR2
AASNLES

SEQ ID NO: 24740 - protein, 9 aa, Artificial Sequence
  Description of Artificial Sequence: Synthetic peptide
  XENP020641 vlCDR3
QQSNEDPFT

SEQ ID NO: 24741 - protein, 450 aa, Artificial Sequence; identical to SEQ ID NO: 22261
  Description of Artificial Sequence: Synthetic polypeptide
  XENP020642 7G8_H0_L0.38_IgG1_PVA_/S267K Heavy Chain

SEQ ID NO: 24742 - protein, 121 aa, Artificial Sequence; identical to SEQ ID NO: 22262
  Description of Artificial Sequence: Synthetic polypeptide
  VH of XENP020642

SEQ ID NO: 24743 - protein, 5 aa, Artificial Sequence
  Description of Artificial Sequence: Synthetic peptide
  XENP020642 vhCDR1
DAWMD

SEQ ID NO: 24744 - protein, 19 aa, Artificial Sequence
  Description of Artificial Sequence: Synthetic peptide
  XENP020642 vhCDR2
EIRTKANNHATYYAESVKG

SEQ ID NO: 24745 - protein, 10 aa, Artificial Sequence
  Description of Artificial Sequence: Synthetic peptide
  XENP020642 vhCDR3
LANWDWYFDV

SEQ ID NO: 24746 - protein, 218 aa, Artificial Sequence
  Description of Artificial Sequence: Synthetic polypeptide
  XENP020642 7G8_H0_L0.38_IgG1_PVA_/S267K Light Chain
DTVLTQSPASLAVSLGQRATISCKASQSVDYDGNSYMNWYQQKPGQPPKLLIYAASNLESGIPARLSGSGSGTDFTLNIHPVEEEDAATYYCQQSNEDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 24747 - protein, 111 aa, Artificial Sequence
  Description of Artificial Sequence: Synthetic polypeptide
  VL of XENP020642
DTVLTQSPASLAVSLGQRATISCKASQSVDYDGNSYMNWYQQKPGQPPKLLIYAASNLESGIPARLSGSGSGTDFTLNIHPVEEEDAATYYCQQSNEDPFTFGSGTKLEVK

SEQ ID NO: 24748 - protein, 15 aa, Artificial Sequence
  Description of Artificial Sequence: Synthetic peptide
  XENP020642 vlCDR1
KASQSVDYDGNSYMN

SEQ ID NO: 24749 - protein, 7 aa, Artificial Sequence
  Description of Artificial Sequence: Synthetic peptide
  XENP020642 vlCDR2
AASNLES

SEQ ID NO: 24750 - protein, 9 aa, Artificial Sequence
  Description of Artificial Sequence: Synthetic peptide
  XENP020642 vlCDR3
QQSNEDPFT

SEQ ID NO: 24751 - protein, 450 aa, Artificial Sequence; identical to SEQ ID NO: 22261
  Description of Artificial Sequence: Synthetic polypeptide
  XENP020643 7G8_H0_L0.39_IgG1_PVA_/S267K Heavy Chain

SEQ ID NO: 24752 - protein, 121 aa, Artificial Sequence; identical to SEQ ID NO: 22262
  Description of Artificial Sequence: Synthetic polypeptide
  VH of XENP020643

SEQ ID NO: 24753 - protein, 5 aa, Artificial Sequence
  Description of Artificial Sequence: Synthetic peptide
  XENP020643 vhCDR1
DAWMD

SEQ ID NO: 24754 - protein, 19 aa, Artificial Sequence
  Description of Artificial Sequence: Synthetic peptide
  XENP020643 vhCDR2
EIRTKANNHATYYAESVKG

SEQ ID NO: 24755 - protein, 10 aa, Artificial Sequence
  Description of Artificial Sequence: Synthetic peptide
  XENP020643 vhCDR3
LANWDWYFDV

SEQ ID NO: 24756 - protein, 218 aa, Artificial Sequence
  Description of Artificial Sequence: Synthetic polypeptide
  XENP020643 7G8_H0_L0.39_IgG1_PVA_/S267K Light Chain
DTVLTQSPASLAVSLGQRATISCKASQSVDYDGESYMNWYQQKPGQPPKLLIYAASNLESGIPARLSGSGSGTDFTLNIHPVEEEDAATYYCQQSNEDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 24757 - protein, 111 aa, Artificial Sequence
  Description of Artificial Sequence: Synthetic polypeptide
  VL of XENP020643
DTVLTQSPASLAVSLGQRATISCKASQSVDYDGESYMNWYQQKPGQPPKLLIYAASNLESGIPARLSGSGSGTDFTLNIHPVEEEDAATYYCQQSNEDPFTFGSGTKLEVK

SEQ ID NO: 24758 - protein, 15 aa, Artificial Sequence
  Description of Artificial Sequence: Synthetic peptide
  XENP020643 vlCDR1
KASQSVDYDGESYMN

SEQ ID NO: 24759 - protein, 7 aa, Artificial Sequence
  Description of Artificial Sequence: Synthetic peptide
  XENP020643 vlCDR2
AASNLES

SEQ ID NO: 24760 - protein, 9 aa, Artificial Sequence
  Description of Artificial Sequence: Synthetic peptide
  XENP020643 vlCDR3
QQSNEDPFT

SEQ ID NO: 24761 - protein, 450 aa, Artificial Sequence; identical to SEQ ID NO: 22261
  Description of Artificial Sequence: Synthetic polypeptide
  XENP020644 7G8_H0_L0.40_IgG1_PVA_/S267K Heavy Chain

SEQ ID NO: 24762 - protein, 121 aa, Artificial Sequence; identical to SEQ ID NO: 22262
  Description of Artificial Sequence: Synthetic polypeptide
  VH of XENP020644

SEQ ID NO: 24763 - protein, 5 aa, Artificial Sequence
  Description of Artificial Sequence: Synthetic peptide
  XENP020644 vhCDR1
DAWMD

SEQ ID NO: 24764 - protein, 19 aa, Artificial Sequence
  Description of Artificial Sequence: Synthetic peptide
  XENP020644 vhCDR2
EIRTKANNHATYYAESVKG

SEQ ID NO: 24765 - protein, 10 aa, Artificial Sequence
  Description of Artificial Sequence: Synthetic peptide
  XENP020644 vhCDR3
LANWDWYFDV

SEQ ID NO: 24766 - protein, 218 aa, Artificial Sequence
  Description of Artificial Sequence: Synthetic polypeptide
  XENP020644 7G8_H0_L0.40_IgG1_PVA_/S267K Light Chain
DTVLTQSPASLAVSLGQRATISCKASQSVDYDGHSYMNWYQQKPGQPPKLLIYAASNLESGIPARLSGSGSGTDFTLNIHPVEEEDAATYYCQQSNEDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 24767 - protein, 111 aa, Artificial Sequence
  Description of Artificial Sequence: Synthetic polypeptide
  VL of XENP020644
DTVLTQSPASLAVSLGQRATISCKASQSVDYDGHSYMNWYQQKPGQPPKLLIYAASNLESGIPARLSGSGSGTDFTLNIHPVEEEDAATYYCQQSNEDPFTFGSGTKLEVK

SEQ ID NO: 24768 - protein, 15 aa, Artificial Sequence
  Description of Artificial Sequence: Synthetic peptide
  XENP020644 vlCDR1
KASQSVDYDGHSYMN

SEQ ID NO: 24769 - protein, 7 aa, Artificial Sequence
  Description of Artificial Sequence: Synthetic peptide
  XENP020644 vlCDR2
AASNLES

SEQ ID NO: 24770 - protein, 9 aa, Artificial Sequence
  Description of Artificial Sequence: Synthetic peptide
  XENP020644 vlCDR3
QQSNEDPFT

SEQ ID NO: 24771 - protein, 450 aa, Artificial Sequence; identical to SEQ ID NO: 22261
  Description of Artificial Sequence: Synthetic polypeptide
  XENP020645 7G8_H0_L0.41_IgG1_PVA_/S267K Heavy Chain

SEQ ID NO: 24772 - protein, 121 aa, Artificial Sequence; identical to SEQ ID NO: 22262
  Description of Artificial Sequence: Synthetic polypeptide
  VH of XENP020645

SEQ ID NO: 24773 - protein, 5 aa, Artificial Sequence
  Description of Artificial Sequence: Synthetic peptide
  XENP020645 vhCDR1
DAWMD

SEQ ID NO: 24774 - protein, 19 aa, Artificial Sequence
  Description of Artificial Sequence: Synthetic peptide
  XENP020645 vhCDR2
EIRTKANNHATYYAESVKG

SEQ ID NO: 24775 - protein, 10 aa, Artificial Sequence
  Description of Artificial Sequence: Synthetic peptide
  XENP020645 vhCDR3
LANWDWYFDV

SEQ ID NO: 24776 - protein, 218 aa, Artificial Sequence
  Description of Artificial Sequence: Synthetic polypeptide
  XENP020645 7G8_H0_L0.41_IgG1_PVA_/S267K Light Chain
DTVLTQSPASLAVSLGQRATISCKASQSVDYDGSSYMNWYQQKPGQPPKLLIYAASNLESGIPARLSGSGSGTDFTLNIHPVEEEDAATYYCQQSNEDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 24777 - protein, 111 aa, Artificial Sequence
  Description of Artificial Sequence: Synthetic polypeptide
  VL of XENP020645
DTVLTQSPASLAVSLGQRATISCKASQSVDYDGSSYMNWYQQKPGQPPKLLIYAASNLESGIPARLSGSGSGTDFTLNIHPVEEEDAATYYCQQSNEDPFTFGSGTKLEVK

SEQ ID NO: 24778 - protein, 15 aa, Artificial Sequence
  Description of Artificial Sequence: Synthetic peptide
  XENP020645 vlCDR1
KASQSVDYDGSSYMN

SEQ ID NO: 24779 - protein, 7 aa, Artificial Sequence
  Description of Artificial Sequence: Synthetic peptide
  XENP020645 vlCDR2
AASNLES

SEQ ID NO: 24780 - protein, 9 aa, Artificial Sequence
  Description of Artificial Sequence: Synthetic peptide
  XENP020645 vlCDR3
QQSNEDPFT

SEQ ID NO: 24781 - protein, 450 aa, Artificial Sequence; identical to SEQ ID NO: 22261
  Description of Artificial Sequence: Synthetic polypeptide
  XENP020646 7G8_H0_L0.42_IgG1_PVA_/S267K Heavy Chain

SEQ ID NO: 24782 - protein, 121 aa, Artificial Sequence; identical to SEQ ID NO: 22262
  Description of Artificial Sequence: Synthetic polypeptide
  VH of XENP020646

SEQ ID NO: 24783 - protein, 5 aa, Artificial Sequence
  Description of Artificial Sequence: Synthetic peptide
  XENP020646 vhCDR1
DAWMD

SEQ ID NO: 24784 - protein, 19 aa, Artificial Sequence
  Description of Artificial Sequence: Synthetic peptide
  XENP020646 vhCDR2
EIRTKANNHATYYAESVKG

SEQ ID NO: 24785 - protein, 10 aa, Artificial Sequence
  Description of Artificial Sequence: Synthetic peptide
  XENP020646 vhCDR3
LANWDWYFDV

SEQ ID NO: 24786 - protein, 218 aa, Artificial Sequence
  Description of Artificial Sequence: Synthetic polypeptide
  XENP020646 7G8_H0_L0.42_IgG1_PVA_/S267K Light Chain
DTVLTQSPASLAVSLGQRATISCKASQSVDYDGRSYMNWYQQKPGQPPKLLIYAASNLESGIPARLSGSGSGTDFTLNIHPVEEEDAATYYCQQSNEDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 24787 - protein, 111 aa, Artificial Sequence
  Description of Artificial Sequence: Synthetic polypeptide
  VL of XENP020646
DTVLTQSPASLAVSLGQRATISCKASQSVDYDGRSYMNWYQQKPGQPPKLLIYAASNLESGIPARLSGSGSGTDFTLNIHPVEEEDAATYYCQQSNEDPFTFGSGTKLEVK

SEQ ID NO: 24788 - protein, 15 aa, Artificial Sequence
  Description of Artificial Sequence: Synthetic peptide
  XENP020646 vlCDR1
KASQSVDYDGRSYMN

SEQ ID NO: 24789 - protein, 7 aa, Artificial Sequence
  Description of Artificial Sequence: Synthetic peptide
  XENP020646 vlCDR2
AASNLES

SEQ ID NO: 24790 - protein, 9 aa, Artificial Sequence
  Description of Artificial Sequence: Synthetic peptide
  XENP020646 vlCDR3
QQSNEDPFT

SEQ ID NO: 24791 - protein, 450 aa, Artificial Sequence; identical to SEQ ID NO: 22261
  Description of Artificial Sequence: Synthetic polypeptide
  XENP020647 7G8_H0_L0.43_IgG1_PVA_/S267K Heavy Chain

SEQ ID NO: 24792 - protein, 121 aa, Artificial Sequence; identical to SEQ ID NO: 22262
  Description of Artificial Sequence: Synthetic polypeptide
  VH of XENP020647

SEQ ID NO: 24793 - protein, 5 aa, Artificial Sequence
  Description of Artificial Sequence: Synthetic peptide
  XENP020647 vhCDR1
DAWMD

SEQ ID NO: 24794 - protein, 19 aa, Artificial Sequence
  Description of Artificial Sequence: Synthetic peptide
  XENP020647 vhCDR2
EIRTKANNHATYYAESVKG

SEQ ID NO: 24795 - protein, 10 aa, Artificial Sequence
  Description of Artificial Sequence: Synthetic peptide
  XENP020647 vhCDR3
LANWDWYFDV

SEQ ID NO: 24796 - protein, 218 aa, Artificial Sequence
  Description of Artificial Sequence: Synthetic polypeptide
  XENP020647 7G8_H0_L0.43_IgG1_PVA_/S267K Light Chain
DTVLTQSPASLAVSLGQRATISCKASQSVDYDGLSYMNWYQQKPGQPPKLLIYAASNLESGIPARLSGSGSGTDFTLNIHPVEEEDAATYYCQQSNEDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 24797 - protein, 111 aa, Artificial Sequence
  Description of Artificial Sequence: Synthetic polypeptide
  VL of XENP020647
DTVLTQSPASLAVSLGQRATISCKASQSVDYDGLSYMNWYQQKPGQPPKLLIYAASNLESGIPARLSGSGSGTDFTLNIHPVEEEDAATYYCQQSNEDPFTFGSGTKLEVK

SEQ ID NO: 24798 - protein, 15 aa, Artificial Sequence
  Description of Artificial Sequence: Synthetic peptide
  XENP020647 vlCDR1
KASQSVDYDGLSYMN

SEQ ID NO: 24799 - protein, 7 aa, Artificial Sequence
  Description of Artificial Sequence: Synthetic peptide
  XENP020647 vlCDR2
AASNLES

SEQ ID NO: 24800 - protein, 9 aa, Artificial Sequence
  Description of Artificial Sequence: Synthetic peptide
  XENP020647 vlCDR3
QQSNEDPFT

SEQ ID NO: 24801 - protein, 450 aa, Artificial Sequence; identical to SEQ ID NO: 22261
  Description of Artificial Sequence: Synthetic polypeptide
  XENP020648 7G8_H0_L0.44_IgG1_PVA_/S267K Heavy Chain

SEQ ID NO: 24802 - protein, 121 aa, Artificial Sequence; identical to SEQ ID NO: 22262
  Description of Artificial Sequence: Synthetic polypeptide
  VH of XENP020648

SEQ ID NO: 24803 - protein, 5 aa, Artificial Sequence
  Description of Artificial Sequence: Synthetic peptide
  XENP020648 vhCDR1
DAWMD

SEQ ID NO: 24804 - protein, 19 aa, Artificial Sequence
  Description of Artificial Sequence: Synthetic peptide
  XENP020648 vhCDR2
EIRTKANNHATYYAESVKG

SEQ ID NO: 24805 - protein, 10 aa, Artificial Sequence
  Description of Artificial Sequence: Synthetic peptide
  XENP020648 vhCDR3
LANWDWYFDV

SEQ ID NO: 24806 - protein, 218 aa, Artificial Sequence
  Description of Artificial Sequence: Synthetic polypeptide
  XENP020648 7G8_H0_L0.44_IgG1_PVA_/S267K Light Chain
DTVLTQSPASLAVSLGQRATISCKASQSVDYDGTSYMNWYQQKPGQPPKLLIYAASNLESGIPARLSGSGSGTDFTLNIHPVEEEDAATYYCQQSNEDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 24807 - protein, 111 aa, Artificial Sequence
  Description of Artificial Sequence: Synthetic polypeptide
  VL of XENP020648
DTVLTQSPASLAVSLGQRATISCKASQSVDYDGTSYMNWYQQKPGQPPKLLIYAASNLESGIPARLSGSGSGTDFTLNIHPVEEEDAATYYCQQSNEDPFTFGSGTKLEVK

SEQ ID NO: 24808 - protein, 15 aa, Artificial Sequence
  Description of Artificial Sequence: Synthetic peptide
  XENP020648 vlCDR1
KASQSVDYDGTSYMN

SEQ ID NO: 24809 - protein, 7 aa, Artificial Sequence
  Description of Artificial Sequence: Synthetic peptide
  XENP020648 vlCDR2
AASNLES

SEQ ID NO: 24810 - protein, 9 aa, Artificial Sequence
  Description of Artificial Sequence: Synthetic peptide
  XENP020648 vlCDR3
QQSNEDPFT

SEQ ID NO: 24811 - protein, 450 aa, Artificial Sequence; identical to SEQ ID NO: 22261
  Description of Artificial Sequence: Synthetic polypeptide
  XENP020649 7G8_H0_L0.45_IgG1_PVA_/S267K Heavy Chain

SEQ ID NO: 24812 - protein, 121 aa, Artificial Sequence; identical to SEQ ID NO: 22262
  Description of Artificial Sequence: Synthetic polypeptide
  VH of XENP020649

SEQ ID NO: 24813 - protein, 5 aa, Artificial Sequence
  Description of Artificial Sequence: Synthetic peptide
  XENP020649 vhCDR1
DAWMD

SEQ ID NO: 24814 - protein, 19 aa, Artificial Sequence
  Description of Artificial Sequence: Synthetic peptide
  XENP020649 vhCDR2
EIRTKANNHATYYAESVKG

SEQ ID NO: 24815 - protein, 10 aa, Artificial Sequence
  Description of Artificial Sequence: Synthetic peptide
  XENP020649 vhCDR3
LANWDWYFDV

SEQ ID NO: 24816 - protein, 218 aa, Artificial Sequence
  Description of Artificial Sequence: Synthetic polypeptide
  XENP020649 7G8_H0_L0.45_IgG1_PVA_/S267K Light Chain
DTVLTQSPASLAVSLGQRATISCKASQSVDYDGGSYMNWYQQKPGQPPKLLIYAASNLESGIPARLSGSGSGTDFTLNIHPVEEEDAATYYCQQSNEDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 24817 - protein, 111 aa, Artificial Sequence
  Description of Artificial Sequence: Synthetic polypeptide
  VL of XENP020649
DTVLTQSPASLAVSLGQRATISCKASQSVDYDGGSYMNWYQQKPGQPPKLLIYAASNLESGIPARLSGSGSGTDFTLNIHPVEEEDAATYYCQQSNEDPFTFGSGTKLEVK

SEQ ID NO: 24818 - protein, 15 aa, Artificial Sequence
  Description of Artificial Sequence: Synthetic peptide
  XENP020649 vlCDR1
KASQSVDYDGGSYMN

SEQ ID NO: 24819 - protein, 7 aa, Artificial Sequence
  Description of Artificial Sequence: Synthetic peptide
  XENP020649 vlCDR2
AASNLES

SEQ ID NO: 24820 - protein, 9 aa, Artificial Sequence
  Description of Artificial Sequence: Synthetic peptide
  XENP020649 vlCDR3
QQSNEDPFT

SEQ ID NO: 24821 - protein, 450 aa, Artificial Sequence; identical to SEQ ID NO: 22261
  Description of Artificial Sequence: Synthetic polypeptide
  XENP020650 7G8_H0_L0.46_IgG1_PVA_/S267K Heavy Chain

SEQ ID NO: 24822 - protein, 121 aa, Artificial Sequence; identical to SEQ ID NO: 22262
  Description of Artificial Sequence: Synthetic polypeptide
  VH of XENP020650

SEQ ID NO: 24823 - protein, 5 aa, Artificial Sequence
  Description of Artificial Sequence: Synthetic peptide
  XENP020650 vhCDR1
DAWMD

SEQ ID NO: 24824 - protein, 19 aa, Artificial Sequence
  Description of Artificial Sequence: Synthetic peptide
  XENP020650 vhCDR2
EIRTKANNHATYYAESVKG

SEQ ID NO: 24825 - protein, 10 aa, Artificial Sequence
  Description of Artificial Sequence: Synthetic peptide
  XENP020650 vhCDR3
LANWDWYFDV

SEQ ID NO: 24826 - protein, 218 aa, Artificial Sequence
  Description of Artificial Sequence: Synthetic polypeptide
  XENP020650 7G8_H0_L0.46_IgG1_PVA_/S267K Light Chain
DTVLTQSPASLAVSLGQRATISCKASQSVDYDGYSYMNWYQQKPGQPPKLLIYAASNLESGIPARLSGSGSGTDFTLNIHPVEEEDAATYYCQQSNEDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 24827 - protein, 111 aa, Artificial Sequence
  Description of Artificial Sequence: Synthetic polypeptide
  VL of XENP020650
DTVLTQSPASLAVSLGQRATISCKASQSVDYDGYSYMNWYQQKPGQPPKLLIYAASNLESGIPARLSGSGSGTDFTLNIHPVEEEDAATYYCQQSNEDPFTFGSGTKLEVK

SEQ ID NO: 24828 - protein, 15 aa, Artificial Sequence
  Description of Artificial Sequence: Synthetic peptide
  XENP020650 vlCDR1
KASQSVDYDGYSYMN

SEQ ID NO: 24829 - protein, 7 aa, Artificial Sequence
  Description of Artificial Sequence: Synthetic peptide
  XENP020650 vlCDR2
AASNLES

SEQ ID NO: 24830 - protein, 9 aa, Artificial Sequence
  Description of Artificial Sequence: Synthetic peptide
  XENP020650 vlCDR3
QQSNEDPFT

SEQ ID NO: 24831 - protein, 450 aa, Artificial Sequence; identical to SEQ ID NO: 22261
  Description of Artificial Sequence: Synthetic polypeptide
  XENP020651 7G8_H0_L0.47_IgG1_PVA_/S267K Heavy Chain

SEQ ID NO: 24832 - protein, 121 aa, Artificial Sequence; identical to SEQ ID NO: 22262
  Description of Artificial Sequence: Synthetic polypeptide
  VH of XENP020651

SEQ ID NO: 24833 - protein, 5 aa, Artificial Sequence
  Description of Artificial Sequence: Synthetic peptide
  XENP020651 vhCDR1
DAWMD

SEQ ID NO: 24834 - protein, 19 aa, Artificial Sequence
  Description of Artificial Sequence: Synthetic peptide
  XENP020651 vhCDR2
EIRTKANNHATYYAESVKG

SEQ ID NO: 24835 - protein, 10 aa, Artificial Sequence
  Description of Artificial Sequence: Synthetic peptide
  XENP020651 vhCDR3
LANWDWYFDV

SEQ ID NO: 24836 - protein, 218 aa, Artificial Sequence
  Description of Artificial Sequence: Synthetic polypeptide
  XENP020651 7G8_H0_L0.47_IgG1_PVA_/S267K Light Chain
DTVLTQSPASLAVSLGQRATISCKASQSVDYDGDSYMNWYQQKPGQPPKLLIKAASNLESGIPARLSGSGSGTDFTLNIHPVEEEDAATYYCQQSNEDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 24837 - protein, 111 aa, Artificial Sequence
  Description of Artificial Sequence: Synthetic polypeptide
  VL of XENP020651
DTVLTQSPASLAVSLGQRATISCKASQSVDYDGDSYMNWYQQKPGQPPKLLIKAASNLESGIPARLSGSGSGTDFTLNIHPVEEEDAATYYCQQSNEDPFTFGSGTKLEVK

SEQ ID NO: 24838 - protein, 15 aa, Artificial Sequence
  Description of Artificial Sequence: Synthetic peptide
  XENP020651 vlCDR1
KASQSVDYDGDSYMN

SEQ ID NO: 24839 - protein, 7 aa, Artificial Sequence
  Description of Artificial Sequence: Synthetic peptide
  XENP020651 vlCDR2
AASNLES

SEQ ID NO: 24840 - protein, 9 aa, Artificial Sequence
  Description of Artificial Sequence: Synthetic peptide
  XENP020651 vlCDR3
QQSNEDPFT

SEQ ID NO: 24841 - protein, 450 aa, Artificial Sequence; identical to SEQ ID NO: 22261
  Description of Artificial Sequence: Synthetic polypeptide
  XENP020652 7G8_H0_L0.48_IgG1_PVA_/S267K Heavy Chain

SEQ ID NO: 24842 - protein, 121 aa, Artificial Sequence; identical to SEQ ID NO: 22262
  Description of Artificial Sequence: Synthetic polypeptide
  VH of XENP020652

SEQ ID NO: 24843 - protein, 5 aa, Artificial Sequence
  Description of Artificial Sequence: Synthetic peptide
  XENP020652 vhCDR1
DAWMD

SEQ ID NO: 24844 - protein, 19 aa, Artificial Sequence
  Description of Artificial Sequence: Synthetic peptide
  XENP020652 vhCDR2
EIRTKANNHATYYAESVKG

SEQ ID NO: 24845 - protein, 10 aa, Artificial Sequence
  Description of Artificial Sequence: Synthetic peptide
  XENP020652 vhCDR3
LANWDWYFDV

SEQ ID NO: 24846 - protein, 218 aa, Artificial Sequence
  Description of Artificial Sequence: Synthetic polypeptide
  XENP020652 7G8_H0_L0.48_IgG1_PVA_/S267K Light Chain
DTVLTQSPASLAVSLGQRATISCKASQSVDYDGDSYMNWYQQKPGQPPKLLIYSASNLESGIPARLSGSGSGTDFTLNIHPVEEEDAATYYCQQSNEDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 24847 - protein, 111 aa, Artificial Sequence
  Description of Artificial Sequence: Synthetic polypeptide
  VL of XENP020652
DTVLTQSPASLAVSLGQRATISCKASQSVDYDGDSYMNWYQQKPGQPPKLLIYSASNLESGIPARLSGSGSGTDFTLNIHPVEEEDAATYYCQQSNEDPFTFGSGTKLEVK

SEQ ID NO: 24848 - protein, 15 aa, Artificial Sequence
  Description of Artificial Sequence: Synthetic peptide
  XENP020652 vlCDR1
KASQSVDYDGDSYMN

SEQ ID NO: 24849 - protein, 7 aa, Artificial Sequence
  Description of Artificial Sequence: Synthetic peptide
  XENP020652 vlCDR2
SASNLES

SEQ ID NO: 24850 - protein, 9 aa, Artificial Sequence
  Description of Artificial Sequence: Synthetic peptide
  XENP020652 vlCDR3
QQSNEDPFT

SEQ ID NO: 24851 - protein, 450 aa, Artificial Sequence; identical to SEQ ID NO: 22261
  Description of Artificial Sequence: Synthetic polypeptide
  XENP020653 7G8_H0_L0.49_IgG1_PVA_/S267K Heavy Chain

SEQ ID NO: 24852 - protein, 121 aa, Artificial Sequence; identical to SEQ ID NO: 22262
  Description of Artificial Sequence: Synthetic polypeptide
  VH of XENP020653

SEQ ID NO: 24853 - protein, 5 aa, Artificial Sequence
  Description of Artificial Sequence: Synthetic peptide
  XENP020653 vhCDR1
DAWMD

SEQ ID NO: 24854 - protein, 19 aa, Artificial Sequence
  Description of Artificial Sequence: Synthetic peptide
  XENP020653 vhCDR2
EIRTKANNHATYYAESVKG

SEQ ID NO: 24855 - protein, 10 aa, Artificial Sequence
  Description of Artificial Sequence: Synthetic peptide
  XENP020653 vhCDR3
LANWDWYFDV

SEQ ID NO: 24856 - protein, 218 aa, Artificial Sequence
  Description of Artificial Sequence: Synthetic polypeptide
  XENP020653 7G8_H0_L0.49_IgG1_PVA_/S267K Light Chain
DTVLTQSPASLAVSLGQRATISCKASQSVDYDGDSYMNWYQQKPGQPPKLLIYTASNLESGIPARLSGSGSGTDFTLNIHPVEEEDAATYYCQQSNEDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 24857 - protein, 111 aa, Artificial Sequence
  Description of Artificial Sequence: Synthetic polypeptide
  VL of XENP020653
DTVLTQSPASLAVSLGQRATISCKASQSVDYDGDSYMNWYQQKPGQPPKLLIYTASNLESGIPARLSGSGSGTDFTLNIHPVEEEDAATYYCQQSNEDPFTFGSGTKLEVK

SEQ ID NO: 24858 - protein, 15 aa, Artificial Sequence
  Description of Artificial Sequence: Synthetic peptide
  XENP020653 vlCDR1
KASQSVDYDGDSYMN

SEQ ID NO: 24859 - protein, 7 aa, Artificial Sequence
  Description of Artificial Sequence: Synthetic peptide
  XENP020653 vlCDR2
TASNLES

SEQ ID NO: 24860 - protein, 9 aa, Artificial Sequence
  Description of Artificial Sequence: Synthetic peptide
  XENP020653 vlCDR3
QQSNEDPFT

SEQ ID NO: 24861 - protein, 450 aa, Artificial Sequence; identical to SEQ ID NO: 22261
  Description of Artificial Sequence: Synthetic polypeptide
  XENP020654 7G8_H0_L0.50_IgG1_PVA_/S267K Heavy Chain

SEQ ID NO: 24862 - protein, 121 aa, Artificial Sequence; identical to SEQ ID NO: 22262
  Description of Artificial Sequence: Synthetic polypeptide
  VH of XENP020654

SEQ ID NO: 24863 - protein, 5 aa, Artificial Sequence
  Description of Artificial Sequence: Synthetic peptide
  XENP020654 vhCDR1
DAWMD

SEQ ID NO: 24864 - protein, 19 aa, Artificial Sequence
  Description of Artificial Sequence: Synthetic peptide
  XENP020654 vhCDR2
EIRTKANNHATYYAESVKG

SEQ ID NO: 24865 - protein, 10 aa, Artificial Sequence
  Description of Artificial Sequence: Synthetic peptide
  XENP020654 vhCDR3
LANWDWYFDV

SEQ ID NO: 24866 - protein, 218 aa, Artificial Sequence
  Description of Artificial Sequence: Synthetic polypeptide
  XENP020654 7G8_H0_L0.50_IgG1_PVA_/S267K Light Chain
DTVLTQSPASLAVSLGQRATISCKASQSVDYDGDSYMNWYQQKPGQPPKLLIYGASNLESGIPARLSGSGSGTDFTLNIHPVEEEDAATYYCQQSNEDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 24867 - protein, 111 aa, Artificial Sequence
  Description of Artificial Sequence: Synthetic polypeptide
  VL of XENP020654
DTVLTQSPASLAVSLGQRATISCKASQSVDYDGDSYMNWYQQKPGQPPKLLIYGASNLESGIPARLSGSGSGTDFTLNIHPVEEEDAATYYCQQSNEDPFTFGSGTKLEVK

SEQ ID NO: 24868 - protein, 15 aa, Artificial Sequence
  Description of Artificial Sequence: Synthetic peptide
  XENP020654 vlCDR1
KASQSVDYDGDSYMN

SEQ ID NO: 24869 - protein, 7 aa, Artificial Sequence
  Description of Artificial Sequence: Synthetic peptide
  XENP020654 vlCDR2
GASNLES

SEQ ID NO: 24870 - protein, 9 aa, Artificial Sequence
  Description of Artificial Sequence: Synthetic peptide
  XENP020654 vlCDR3
QQSNEDPFT

SEQ ID NO: 24871 - protein, 450 aa, Artificial Sequence; identical to SEQ ID NO: 22261
  Description of Artificial Sequence: Synthetic polypeptide
  XENP020655 7G8_H0_L0.51_IgG1_PVA_/S267K Heavy Chain

SEQ ID NO: 24872 - protein, 121 aa, Artificial Sequence; identical to SEQ ID NO: 22262
  Description of Artificial Sequence: Synthetic polypeptide
  VH of XENP020655

SEQ ID NO: 24873 - protein, 5 aa, Artificial Sequence
  Description of Artificial Sequence: Synthetic peptide
  XENP020655 vhCDR1
DAWMD

SEQ ID NO: 24874 - protein, 19 aa, Artificial Sequence
  Description of Artificial Sequence: Synthetic peptide
  XENP020655 vhCDR2
EIRTKANNHATYYAESVKG

SEQ ID NO: 24875 - protein, 10 aa, Artificial Sequence
  Description of Artificial Sequence: Synthetic peptide
  XENP020655 vhCDR3
LANWDWYFDV

SEQ ID NO: 24876 - protein, 218 aa, Artificial Sequence
  Description of Artificial Sequence: Synthetic polypeptide
  XENP020655 7G8_H0_L0.51_IgG1_PVA_/S267K Light Chain
DTVLTQSPASLAVSLGQRATISCKASQSVDYDGDSYMNWYQQKPGQPPKLLIYHASNLESGIPARLSGSGSGTDFTLNIHPVEEEDAATYYCQQSNEDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 24877 - protein, 111 aa, Artificial Sequence
  Description of Artificial Sequence: Synthetic polypeptide
  VL of XENP020655
DTVLTQSPASLAVSLGQRATISCKASQSVDYDGDSYMNWYQQKPGQPPKLLIYHASNLESGIPARLSGSGSGTDFTLNIHPVEEEDAATYYCQQSNEDPFTFGSGTKLEVK

SEQ ID NO: 24878 - protein, 15 aa, Artificial Sequence
  Description of Artificial Sequence: Synthetic peptide
  XENP020655 vlCDR1
KASQSVDYDGDSYMN

SEQ ID NO: 24879 - protein, 7 aa, Artificial Sequence
  Description of Artificial Sequence: Synthetic peptide
  XENP020655 vlCDR2
HASNLES

SEQ ID NO: 24880 - protein, 9 aa, Artificial Sequence
  Description of Artificial Sequence: Synthetic peptide
  XENP020655 vlCDR3
QQSNEDPFT

SEQ ID NO: 24881 - protein, 450 aa, Artificial Sequence; identical to SEQ ID NO: 22261
  Description of Artificial Sequence: Synthetic polypeptide
  XENP020656 7G8_H0_L0.52_IgG1_PVA_/S267K Heavy Chain

SEQ ID NO: 24882 - protein, 121 aa, Artificial Sequence; identical to SEQ ID NO: 22262
  Description of Artificial Sequence: Synthetic polypeptide
  VH of XENP020656

SEQ ID NO: 24883 - protein, 5 aa, Artificial Sequence
  Description of Artificial Sequence: Synthetic peptide
  XENP020656 vhCDR1
DAWMD

SEQ ID NO: 24884 - protein, 19 aa, Artificial Sequence
  Description of Artificial Sequence: Synthetic peptide
  XENP020656 vhCDR2
EIRTKANNHATYYAESVKG

SEQ ID NO: 24885 - protein, 10 aa, Artificial Sequence
  Description of Artificial Sequence: Synthetic peptide
  XENP020656 vhCDR3
LANWDWYFDV

SEQ ID NO: 24886 - protein, 218 aa, Artificial Sequence
  Description of Artificial Sequence: Synthetic polypeptide
  XENP020656 7G8_H0_L0.52_IgG1_PVA_/S267K Light Chain
DTVLTQSPASLAVSLGQRATISCKASQSVDYDGDSYMNWYQQKPGQPPKLLIYQASNLESGIPARLSGSGSGTDFTLNIHPVEEEDAATYYCQQSNEDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 24887 - protein, 111 aa, Artificial Sequence
  Description of Artificial Sequence: Synthetic polypeptide
  VL of XENP020656
DTVLTQSPASLAVSLGQRATISCKASQSVDYDGDSYMNWYQQKPGQPPKLLIYQASNLESGIPARLSGSGSGTDFTLNIHPVEEEDAATYYCQQSNEDPFTFGSGTKLEVK

SEQ ID NO: 24888 - protein, 15 aa, Artificial Sequence
  Description of Artificial Sequence: Synthetic peptide
  XENP020656 vlCDR1
KASQSVDYDGDSYMN

SEQ ID NO: 24889 - protein, 7 aa, Artificial Sequence
  Description of Artificial Sequence: Synthetic peptide
  XENP020656 vlCDR2
QASNLES

SEQ ID NO: 24890 - protein, 9 aa, Artificial Sequence
  Description of Artificial Sequence: Synthetic peptide
  XENP020656 vlCDR3
QQSNEDPFT

SEQ ID NO: 24891 - protein, 450 aa, Artificial Sequence; identical to SEQ ID NO: 22261
  Description of Artificial Sequence: Synthetic polypeptide
  XENP020657 7G8_H0_L0.53_IgG1_PVA_/S267K Heavy Chain

SEQ ID NO: 24892 - protein, 121 aa, Artificial Sequence; identical to SEQ ID NO: 22262
  Description of Artificial Sequence: Synthetic polypeptide
  VH of XENP020657

SEQ ID NO: 24893 - protein, 5 aa, Artificial Sequence
  Description of Artificial Sequence: Synthetic peptide
  XENP020657 vhCDR1
DAWMD

SEQ ID NO: 24894 - protein, 19 aa, Artificial Sequence
  Description of Artificial Sequence: Synthetic peptide
  XENP020657 vhCDR2
EIRTKANNHATYYAESVKG

SEQ ID NO: 24895 - protein, 10 aa, Artificial Sequence
  Description of Artificial Sequence: Synthetic peptide
  XENP020657 vhCDR3
LANWDWYFDV

SEQ ID NO: 24896 - protein, 218 aa, Artificial Sequence
  Description of Artificial Sequence: Synthetic polypeptide
  XENP020657 7G8_H0_L0.53_IgG1_PVA_/S267K Light Chain
DTVLTQSPASLAVSLGQRATISCKASQSVDYDGDSYMNWYQQKPGQPPKLLIYDASNLESGIPARLSGSGSGTDFTLNIHPVEEEDAATYYCQQSNEDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 24897 - protein, 111 aa, Artificial Sequence
  Description of Artificial Sequence: Synthetic polypeptide
  VL of XENP020657
DTVLTQSPASLAVSLGQRATISCKASQSVDYDGDSYMNWYQQKPGQPPKLLIYDASNLESGIPARLSGSGSGTDFTLNIHPVEEEDAATYYCQQSNEDPFTFGSGTKLEVK

SEQ ID NO: 24898 - protein, 15 aa, Artificial Sequence
  Description of Artificial Sequence: Synthetic peptide
  XENP020657 vlCDR1
KASQSVDYDGDSYMN

SEQ ID NO: 24899 - protein, 7 aa, Artificial Sequence
  Description of Artificial Sequence: Synthetic peptide
  XENP020657 vlCDR2
DASNLES

SEQ ID NO: 24900 - protein, 9 aa, Artificial Sequence
  Description of Artificial Sequence: Synthetic peptide
  XENP020657 vlCDR3
QQSNEDPFT

SEQ ID NO: 24901 - protein, 450 aa, Artificial Sequence; identical to SEQ ID NO: 22261
  Description of Artificial Sequence: Synthetic polypeptide
  XENP020658 7G8_H0_L0.54_IgG1_PVA_/S267K Heavy Chain

SEQ ID NO: 24902 - protein, 121 aa, Artificial Sequence; identical to SEQ ID NO: 22262
  Description of Artificial Sequence: Synthetic polypeptide
  VH of XENP020658

SEQ ID NO: 24903 - protein, 5 aa, Artificial Sequence
  Description of Artificial Sequence: Synthetic peptide
  XENP020658 vhCDR1
DAWMD

SEQ ID NO: 24904 - protein, 19 aa, Artificial Sequence
  Description of Artificial Sequence: Synthetic peptide
  XENP020658 vhCDR2
EIRTKANNHATYYAESVKG

SEQ ID NO: 24905 - protein, 10 aa, Artificial Sequence
  Description of Artificial Sequence: Synthetic peptide
  XENP020658 vhCDR3
LANWDWYFDV

SEQ ID NO: 24906 - protein, 218 aa, Artificial Sequence
  Description of Artificial Sequence: Synthetic polypeptide
  XENP020658 7G8_H0_L0.54_IgG1_PVA_/S267K Light Chain
DTVLTQSPASLAVSLGQRATISCKASQSVDYDGDSYMNWYQQKPGQPPKLLIYLASNLESGIPARLSGSGSGTDFTLNIHPVEEEDAATYYCQQSNEDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 24907 - protein, 111 aa, Artificial Sequence
  Description of Artificial Sequence: Synthetic polypeptide
  VL of XENP020658
DTVLTQSPASLAVSLGQRATISCKASQSVDYDGDSYMNWYQQKPGQPPKLLIYLASNLESGIPARLSGSGSGTDFTLNIHPVEEEDAATYYCQQSNEDPFTFGSGTKLEVK

SEQ ID NO: 24908 - protein, 15 aa, Artificial Sequence
  Description of Artificial Sequence: Synthetic peptide
  XENP020658 vlCDR1
KASQSVDYDGDSYMN

SEQ ID NO: 24909 - protein, 7 aa, Artificial Sequence
  Description of Artificial Sequence: Synthetic peptide
  XENP020658 vlCDR2
LASNLES

SEQ ID NO: 24910 - protein, 9 aa, Artificial Sequence
  Description of Artificial Sequence: Synthetic peptide
  XENP020658 vlCDR3
QQSNEDPFT

SEQ ID NO: 24911 - protein, 450 aa, Artificial Sequence; identical to SEQ ID NO: 22261
  Description of Artificial Sequence: Synthetic polypeptide
  XENP020659 7G8_H0_L0.55_IgG1_PVA_/S267K Heavy Chain

SEQ ID NO: 24912 - protein, 121 aa, Artificial Sequence; identical to SEQ ID NO: 22262
  Description of Artificial Sequence: Synthetic polypeptide
  VH of XENP020659

SEQ ID NO: 24913 - protein, 5 aa, Artificial Sequence
  Description of Artificial Sequence: Synthetic peptide
  XENP020659 vhCDR1
DAWMD

SEQ ID NO: 24914 - protein, 19 aa, Artificial Sequence
  Description of Artificial Sequence: Synthetic peptide
  XENP020659 vhCDR2
EIRTKANNHATYYAESVKG

SEQ ID NO: 24915 - protein, 10 aa, Artificial Sequence
  Description of Artificial Sequence: Synthetic peptide
  XENP020659 vhCDR3
LANWDWYFDV

SEQ ID NO: 24916 - protein, 218 aa, Artificial Sequence
  Description of Artificial Sequence: Synthetic polypeptide
  XENP020659 7G8_H0_L0.55_IgG1_PVA_/S267K Light Chain
DTVLTQSPASLAVSLGQRATISCKASQSVDYDGDSYMNWYQQKPGQPPKLLIYKASNLESGIPARLSGSGSGTDFTLNIHPVEEEDAATYYCQQSNEDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 24917 - protein, 111 aa, Artificial Sequence
  Description of Artificial Sequence: Synthetic polypeptide
  VL of XENP020659
DTVLTQSPASLAVSLGQRATISCKASQSVDYDGDSYMNWYQQKPGQPPKLLIYKASNLESGIPARLSGSGSGTDFTLNIHPVEEEDAATYYCQQSNEDPFTFGSGTKLEVK

SEQ ID NO: 24918 - protein, 15 aa, Artificial Sequence
  Description of Artificial Sequence: Synthetic peptide
  XENP020659 vlCDR1
KASQSVDYDGDSYMN

SEQ ID NO: 24919 - protein, 7 aa, Artificial Sequence
  Description of Artificial Sequence: Synthetic peptide
  XENP020659 vlCDR2
KASNLES

SEQ ID NO: 24920 - protein, 9 aa, Artificial Sequence
  Description of Artificial Sequence: Synthetic peptide
  XENP020659 vlCDR3
QQSNEDPFT

SEQ ID NO: 24921 - protein, 450 aa, Artificial Sequence; identical to SEQ ID NO: 22261
  Description of Artificial Sequence: Synthetic polypeptide
  XENP020660 7G8_H0_L0.56_IgG1_PVA_/S267K Heavy Chain

SEQ ID NO: 24922 - protein, 121 aa, Artificial Sequence; identical to SEQ ID NO: 22262
  Description of Artificial Sequence: Synthetic polypeptide
  VH of XENP020660

SEQ ID NO: 24923 - protein, 5 aa, Artificial Sequence
  Description of Artificial Sequence: Synthetic peptide
  XENP020660 vhCDR1
DAWMD

SEQ ID NO: 24924 - protein, 19 aa, Artificial Sequence
  Description of Artificial Sequence: Synthetic peptide
  XENP020660 vhCDR2
EIRTKANNHATYYAESVKG

SEQ ID NO: 24925 - protein, 10 aa, Artificial Sequence
  Description of Artificial Sequence: Synthetic peptide
  XENP020660 vhCDR3
LANWDWYFDV

SEQ ID NO: 24926 - protein, 218 aa, Artificial Sequence
  Description of Artificial Sequence: Synthetic polypeptide
  XENP020660 7G8_H0_L0.56_IgG1_PVA_/S267K Light Chain
DTVLTQSPASLAVSLGQRATISCKASQSVDYDGDSYMNWYQQKPGQPPKLLIYYASNLESGIPARLSGSGSGTDFTLNIHPVEEEDAATYYCQQSNEDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 24927 - protein, 111 aa, Artificial Sequence
  Description of Artificial Sequence: Synthetic polypeptide
  VL of XENP020660
DTVLTQSPASLAVSLGQRATISCKASQSVDYDGDSYMNWYQQKPGQPPKLLIYYASNLESGIPARLSGSGSGTDFTLNIHPVEEEDAATYYCQQSNEDPFTFGSGTKLEVK

SEQ ID NO: 24928 - protein, 15 aa, Artificial Sequence
  Description of Artificial Sequence: Synthetic peptide
  XENP020660 vlCDR1
KASQSVDYDGDSYMN

SEQ ID NO: 24929 - protein, 7 aa, Artificial Sequence
  Description of Artificial Sequence: Synthetic peptide
  XENP020660 vlCDR2
YASNLES

SEQ ID NO: 24930 - protein, 9 aa, Artificial Sequence
  Description of Artificial Sequence: Synthetic peptide
  XENP020660 vlCDR3
QQSNEDPFT

SEQ ID NO: 24931 - protein, 450 aa, Artificial Sequence; identical to SEQ ID NO: 22261
  Description of Artificial Sequence: Synthetic polypeptide
  XENP020661 7G8_H0_L0.57_IgG1_PVA_/S267K Heavy Chain

SEQ ID NO: 24932 - protein, 121 aa, Artificial Sequence; identical to SEQ ID NO: 22262
  Description of Artificial Sequence: Synthetic polypeptide
  VH of XENP020661

SEQ ID NO: 24933 - protein, 5 aa, Artificial Sequence
  Description of Artificial Sequence: Synthetic peptide
  XENP020661 vhCDR1
DAWMD

SEQ ID NO: 24934 - protein, 19 aa, Artificial Sequence
  Description of Artificial Sequence: Synthetic peptide
  XENP020661 vhCDR2
EIRTKANNHATYYAESVKG

SEQ ID NO: 24935 - protein, 10 aa, Artificial Sequence
  Description of Artificial Sequence: Synthetic peptide
  XENP020661 vhCDR3
LANWDWYFDV

SEQ ID NO: 24936 - protein, 218 aa, Artificial Sequence
  Description of Artificial Sequence: Synthetic polypeptide
  XENP020661 7G8_H0_L0.57_IgG1_PVA_/S267K Light Chain
DTVLTQSPASLAVSLGQRATISCKASQSVDYDGDSYMNWYQQKPGQPPKLLIYAASDLESGIPARLSGSGSGTDFTLNIHPVEEEDAATYYCQQSNEDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 24937 - protein, 111 aa, Artificial Sequence
  Description of Artificial Sequence: Synthetic polypeptide
  VL of XENP020661
DTVLTQSPASLAVSLGQRATISCKASQSVDYDGDSYMNWYQQKPGQPPKLLIYAASDLESGIPARLSGSGSGTDFTLNIHPVEEEDAATYYCQQSNEDPFTFGSGTKLEVK

SEQ ID NO: 24938 - protein, 15 aa, Artificial Sequence
  Description of Artificial Sequence: Synthetic peptide
  XENP020661 vlCDR1
KASQSVDYDGDSYMN

SEQ ID NO: 24939 - protein, 7 aa, Artificial Sequence
  Description of Artificial Sequence: Synthetic peptide
  XENP020661 vlCDR2
AASDLES

SEQ ID NO: 24940 - protein, 9 aa, Artificial Sequence
  Description of Artificial Sequence: Synthetic peptide
  XENP020661 vlCDR3
QQSNEDPFT

SEQ ID NO: 24941 - protein, 450 aa, Artificial Sequence; identical to SEQ ID NO: 22261
  Description of Artificial Sequence: Synthetic polypeptide
  XENP020662 7G8_H0_L0.58_IgG1_PVA_/S267K Heavy Chain

SEQ ID NO: 24942 - protein, 121 aa, Artificial Sequence; identical to SEQ ID NO: 22262
  Description of Artificial Sequence: Synthetic polypeptide
  VH of XENP020662

SEQ ID NO: 24943 - protein, 5 aa, Artificial Sequence
  Description of Artificial Sequence: Synthetic peptide
  XENP020662 vhCDR1
DAWMD

SEQ ID NO: 24944 - protein, 19 aa, Artificial Sequence
  Description of Artificial Sequence: Synthetic peptide
  XENP020662 vhCDR2
EIRTKANNHATYYAESVKG

SEQ ID NO: 24945 - protein, 10 aa, Artificial Sequence
  Description of Artificial Sequence: Synthetic peptide
  XENP020662 vhCDR3
LANWDWYFDV

SEQ ID NO: 24946 - protein, 218 aa, Artificial Sequence
  Description of Artificial Sequence: Synthetic polypeptide
  XENP020662 7G8_H0_L0.58_IgG1_PVA_/S267K Light Chain
DTVLTQSPASLAVSLGQRATISCKASQSVDYDGDSYMNWYQQKPGQPPKLLIYAASHLESGIPARLSGSGSGTDFTLNIHPVEEEDAATYYCQQSNEDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 24947 - protein, 111 aa, Artificial Sequence
  Description of Artificial Sequence: Synthetic polypeptide
  VL of XENP020662
DTVLTQSPASLAVSLGQRATISCKASQSVDYDGDSYMNWYQQKPGQPPKLLIYAASHLESGIPARLSGSGSGTDFTLNIHPVEEEDAATYYCQQSNEDPFTFGSGTKLEVK

SEQ ID NO: 24948 - protein, 15 aa, Artificial Sequence
  Description of Artificial Sequence: Synthetic peptide
  XENP020662 vlCDR1
KASQSVDYDGDSYMN

SEQ ID NO: 24949 - protein, 7 aa, Artificial Sequence
  Description of Artificial Sequence: Synthetic peptide
  XENP020662 vlCDR2
AASHLES

SEQ ID NO: 24950 - protein, 9 aa, Artificial Sequence
  Description of Artificial Sequence: Synthetic peptide
  XENP020662 vlCDR3
QQSNEDPFT

SEQ ID NO: 24951 - protein, 450 aa, Artificial Sequence; identical to SEQ ID NO: 22261
  Description of Artificial Sequence: Synthetic polypeptide
  XENP020663 7G8_H0_L0.59_IgG1_PVA_/S267K Heavy Chain

SEQ ID NO: 24952 - protein, 121 aa, Artificial Sequence; identical to SEQ ID NO: 22262
  Description of Artificial Sequence: Synthetic polypeptide
  VH of XENP020663

SEQ ID NO: 24953 - protein, 5 aa, Artificial Sequence
  Description of Artificial Sequence: Synthetic peptide
  XENP020663 vhCDR1
DAWMD

SEQ ID NO: 24954 - protein, 19 aa, Artificial Sequence
  Description of Artificial Sequence: Synthetic peptide
  XENP020663 vhCDR2
EIRTKANNHATYYAESVKG

SEQ ID NO: 24955 - protein, 10 aa, Artificial Sequence
  Description of Artificial Sequence: Synthetic peptide
  XENP020663 vhCDR3
LANWDWYFDV

SEQ ID NO: 24956 - protein, 218 aa, Artificial Sequence
  Description of Artificial Sequence: Synthetic polypeptide
  XENP020663 7G8_H0_L0.59_IgG1_PVA_/S267K Light Chain
DTVLTQSPASLAVSLGQRATISCKASQSVDYDGDSYMNWYQQKPGQPPKLLIYAASELESGIPARLSGSGSGTDFTLNIHPVEEEDAATYYCQQSNEDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 24957 - protein, 111 aa, Artificial Sequence
  Description of Artificial Sequence: Synthetic polypeptide
  VL of XENP020663
DTVLTQSPASLAVSLGQRATISCKASQSVDYDGDSYMNWYQQKPGQPPKLLIYAASELESGIPARLSGSGSGTDFTLNIHPVEEEDAATYYCQQSNEDPFTFGSGTKLEVK

SEQ ID NO: 24958 - protein, 15 aa, Artificial Sequence
  Description of Artificial Sequence: Synthetic peptide
  XENP020663 vlCDR1
KASQSVDYDGDSYMN

SEQ ID NO: 24959 - protein, 7 aa, Artificial Sequence
  Description of Artificial Sequence: Synthetic peptide
  XENP020663 vlCDR2
AASELES

SEQ ID NO: 24960 - protein, 9 aa, Artificial Sequence
  Description of Artificial Sequence: Synthetic peptide
  XENP020663 vlCDR3
QQSNEDPFT

SEQ ID NO: 24961 - protein, 450 aa, Artificial Sequence; identical to SEQ ID NO: 22261
  Description of Artificial Sequence: Synthetic polypeptide
  XENP020664 7G8_H0_L0.60_IgG1_PVA_/S267K Heavy Chain

SEQ ID NO: 24962 - protein, 121 aa, Artificial Sequence; identical to SEQ ID NO: 22262
  Description of Artificial Sequence: Synthetic polypeptide
  VH of XENP020664

SEQ ID NO: 24963 - protein, 5 aa, Artificial Sequence
  Description of Artificial Sequence: Synthetic peptide
  XENP020664 vhCDR1
DAWMD

SEQ ID NO: 24964 - protein, 19 aa, Artificial Sequence
  Description of Artificial Sequence: Synthetic peptide
  XENP020664 vhCDR2
EIRTKANNHATYYAESVKG

SEQ ID NO: 24965 - protein, 10 aa, Artificial Sequence
  Description of Artificial Sequence: Synthetic peptide
  XENP020664 vhCDR3
LANWDWYFDV

SEQ ID NO: 24966 - protein, 218 aa, Artificial Sequence
  Description of Artificial Sequence: Synthetic polypeptide
  XENP020664 7G8_H0_L0.60_IgG1_PVA_/S267K Light Chain
DTVLTQSPASLAVSLGQRATISCKASQSVDYDGDSYMNWYQQKPGQPPKLLIYAASSLESGIPARLSGSGSGTDFTLNIHPVEEEDAATYYCQQSNEDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 24967 - protein, 111 aa, Artificial Sequence
  Description of Artificial Sequence: Synthetic polypeptide
  VL of XENP020664
DTVLTQSPASLAVSLGQRATISCKASQSVDYDGDSYMNWYQQKPGQPPKLLIYAASSLESGIPARLSGSGSGTDFTLNIHPVEEEDAATYYCQQSNEDPFTFGSGTKLEVK

SEQ ID NO: 24968 - protein, 15 aa, Artificial Sequence
  Description of Artificial Sequence: Synthetic peptide
  XENP020664 vlCDR1
KASQSVDYDGDSYMN

SEQ ID NO: 24969 - protein, 7 aa, Artificial Sequence
  Description of Artificial Sequence: Synthetic peptide
  XENP020664 vlCDR2
AASSLES

SEQ ID NO: 24970 - protein, 9 aa, Artificial Sequence
  Description of Artificial Sequence: Synthetic peptide
  XENP020664 vlCDR3
QQSNEDPFT

SEQ ID NO: 24971 - protein, 450 aa, Artificial Sequence; identical to SEQ ID NO: 22261
  Description of Artificial Sequence: Synthetic polypeptide
  XENP020665 7G8_H0_L0.61_IgG1_PVA_/S267K Heavy Chain

SEQ ID NO: 24972 - protein, 121 aa, Artificial Sequence; identical to SEQ ID NO: 22262
  Description of Artificial Sequence: Synthetic polypeptide
  VH of XENP020665

SEQ ID NO: 24973 - protein, 5 aa, Artificial Sequence
  Description of Artificial Sequence: Synthetic peptide
  XENP020665 vhCDR1
DAWMD

SEQ ID NO: 24974 - protein, 19 aa, Artificial Sequence
  Description of Artificial Sequence: Synthetic peptide
  XENP020665 vhCDR2
EIRTKANNHATYYAESVKG

SEQ ID NO: 24975 - protein, 10 aa, Artificial Sequence
  Description of Artificial Sequence: Synthetic peptide
  XENP020665 vhCDR3
LANWDWYFDV

SEQ ID NO: 24976 - protein, 218 aa, Artificial Sequence
  Description of Artificial Sequence: Synthetic polypeptide
  XENP020665 7G8_H0_L0.61_IgG1_PVA_/S267K Light Chain
DTVLTQSPASLAVSLGQRATISCKASQSVDYDGDSYMNWYQQKPGQPPKLLIYAASRLESGIPARLSGSGSGTDFTLNIHPVEEEDAATYYCQQSNEDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 24977 - protein, 111 aa, Artificial Sequence
  Description of Artificial Sequence: Synthetic polypeptide
  VL of XENP020665
DTVLTQSPASLAVSLGQRATISCKASQSVDYDGDSYMNWYQQKPGQPPKLLIYAASRLESGIPARLSGSGSGTDFTLNIHPVEEEDAATYYCQQSNEDPFTFGSGTKLEVK

SEQ ID NO: 24978 - protein, 15 aa, Artificial Sequence
  Description of Artificial Sequence: Synthetic peptide
  XENP020665 vlCDR1
KASQSVDYDGDSYMN

SEQ ID NO: 24979 - protein, 7 aa, Artificial Sequence
  Description of Artificial Sequence: Synthetic peptide
  XENP020665 vlCDR2
AASRLES

SEQ ID NO: 24980 - protein, 9 aa, Artificial Sequence
  Description of Artificial Sequence: Synthetic peptide
  XENP020665 vlCDR3
QQSNEDPFT

SEQ ID NO: 24981 - protein, 450 aa, Artificial Sequence; identical to SEQ ID NO: 22261
  Description of Artificial Sequence: Synthetic polypeptide
  XENP020666 7G8_H0_L0.62_IgG1_PVA_/S267K Heavy Chain

SEQ ID NO: 24982 - protein, 121 aa, Artificial Sequence; identical to SEQ ID NO: 22262
  Description of Artificial Sequence: Synthetic polypeptide
  VH of XENP020666

SEQ ID NO: 24983 - protein, 5 aa, Artificial Sequence
  Description of Artificial Sequence: Synthetic peptide
  XENP020666 vhCDR1
DAWMD

SEQ ID NO: 24984 - protein, 19 aa, Artificial Sequence
  Description of Artificial Sequence: Synthetic peptide
  XENP020666 vhCDR2
EIRTKANNHATYYAESVKG

SEQ ID NO: 24985 - protein, 10 aa, Artificial Sequence
  Description of Artificial Sequence: Synthetic peptide
  XENP020666 vhCDR3
LANWDWYFDV

SEQ ID NO: 24986 - protein, 218 aa, Artificial Sequence
  Description of Artificial Sequence: Synthetic polypeptide
  XENP020666 7G8_H0_L0.62_IgG1_PVA_/S267K Light Chain
DTVLTQSPASLAVSLGQRATISCKASQSVDYDGDSYMNWYQQKPGQPPKLLIYAASLLESGIPARLSGSGSGTDFTLNIHPVEEEDAATYYCQQSNEDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 24987 - protein, 111 aa, Artificial Sequence
  Description of Artificial Sequence: Synthetic polypeptide
  VL of XENP020666
DTVLTQSPASLAVSLGQRATISCKASQSVDYDGDSYMNWYQQKPGQPPKLLIYAASLLESGIPARLSGSGSGTDFTLNIHPVEEEDAATYYCQQSNEDPFTFGSGTKLEVK

SEQ ID NO: 24988 - protein, 15 aa, Artificial Sequence
  Description of Artificial Sequence: Synthetic peptide
  XENP020666 vlCDR1
KASQSVDYDGDSYMN

SEQ ID NO: 24989 - protein, 7 aa, Artificial Sequence
  Description of Artificial Sequence: Synthetic peptide
  XENP020666 vlCDR2
AASLLES

SEQ ID NO: 24990 - protein, 9 aa, Artificial Sequence
  Description of Artificial Sequence: Synthetic peptide
  XENP020666 vlCDR3
QQSNEDPFT

SEQ ID NO: 24991 - protein, 450 aa, Artificial Sequence; identical to SEQ ID NO: 22261
  Description of Artificial Sequence: Synthetic polypeptide
  XENP020667 7G8_H0_L0.63_IgG1_PVA_/S267K Heavy Chain

SEQ ID NO: 24992 - protein, 121 aa, Artificial Sequence; identical to SEQ ID NO: 22262
  Description of Artificial Sequence: Synthetic polypeptide
  VH of XENP020667

SEQ ID NO: 24993 - protein, 5 aa, Artificial Sequence
  Description of Artificial Sequence: Synthetic peptide
  XENP020667 vhCDR1
DAWMD

SEQ ID NO: 24994 - protein, 19 aa, Artificial Sequence
  Description of Artificial Sequence: Synthetic peptide
  XENP020667 vhCDR2
EIRTKANNHATYYAESVKG

SEQ ID NO: 24995 - protein, 10 aa, Artificial Sequence
  Description of Artificial Sequence: Synthetic peptide
  XENP020667 vhCDR3
LANWDWYFDV

SEQ ID NO: 24996 - protein, 218 aa, Artificial Sequence
  Description of Artificial Sequence: Synthetic polypeptide
  XENP020667 7G8_H0_L0.63_IgG1_PVA_/S267K Light Chain
DTVLTQSPASLAVSLGQRATISCKASQSVDYDGDSYMNWYQQKPGQPPKLLIYAASTLESGIPARLSGSGSGTDFTLNIHPVEEEDAATYYCQQSNEDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 24997 - protein, 111 aa, Artificial Sequence
  Description of Artificial Sequence: Synthetic polypeptide
  VL of XENP020667
DTVLTQSPASLAVSLGQRATISCKASQSVDYDGDSYMNWYQQKPGQPPKLLIYAASTLESGIPARLSGSGSGTDFTLNIHPVEEEDAATYYCQQSNEDPFTFGSGTKLEVK

SEQ ID NO: 24998 - protein, 15 aa, Artificial Sequence
  Description of Artificial Sequence: Synthetic peptide
  XENP020667 vlCDR1
KASQSVDYDGDSYMN

SEQ ID NO: 24999 - protein, 7 aa, Artificial Sequence
  Description of Artificial Sequence: Synthetic peptide
  XENP020667 vlCDR2
AASTLES

SEQ ID NO: 25000 - protein, 9 aa, Artificial Sequence
  Description of Artificial Sequence: Synthetic peptide
  XENP020667 vlCDR3
QQSNEDPFT

SEQ ID NO: 25001 - protein, 450 aa, Artificial Sequence; identical to SEQ ID NO: 22261
  Description of Artificial Sequence: Synthetic polypeptide
  XENP020668 7G8_H0_L0.64_IgG1_PVA_/S267K Heavy Chain

SEQ ID NO: 25002 - protein, 121 aa, Artificial Sequence; identical to SEQ ID NO: 22262
  Description of Artificial Sequence: Synthetic polypeptide
  VH of XENP020668

SEQ ID NO: 25003 - protein, 5 aa, Artificial Sequence
  Description of Artificial Sequence: Synthetic peptide
  XENP020668 vhCDR1
DAWMD

SEQ ID NO: 25004 - protein, 19 aa, Artificial Sequence
  Description of Artificial Sequence: Synthetic peptide
  XENP020668 vhCDR2
EIRTKANNHATYYAESVKG

SEQ ID NO: 25005 - protein, 10 aa, Artificial Sequence
  Description of Artificial Sequence: Synthetic peptide
  XENP020668 vhCDR3
LANWDWYFDV

SEQ ID NO: 25006 - protein, 218 aa, Artificial Sequence
  Description of Artificial Sequence: Synthetic polypeptide
  XENP020668 7G8_H0_L0.64_IgG1_PVA_/S267K Light Chain
DTVLTQSPASLAVSLGQRATISCKASQSVDYDGDSYMNWYQQKPGQPPKLLIYAASGLESGIPARLSGSGSGTDFTLNIHPVEEEDAATYYCQQSNEDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 25007 - protein, 111 aa, Artificial Sequence
  Description of Artificial Sequence: Synthetic polypeptide
  VL of XENP020668
DTVLTQSPASLAVSLGQRATISCKASQSVDYDGDSYMNWYQQKPGQPPKLLIYAASGLESGIPARLSGSGSGTDFTLNIHPVEEEDAATYYCQQSNEDPFTFGSGTKLEVK

SEQ ID NO: 25008 - protein, 15 aa, Artificial Sequence
  Description of Artificial Sequence: Synthetic peptide
  XENP020668 vlCDR1
KASQSVDYDGDSYMN

SEQ ID NO: 25009 - protein, 7 aa, Artificial Sequence
  Description of Artificial Sequence: Synthetic peptide
  XENP020668 vlCDR2
AASGLES

SEQ ID NO: 25010 - protein, 9 aa, Artificial Sequence
  Description of Artificial Sequence: Synthetic peptide
  XENP020668 vlCDR3
QQSNEDPFT

SEQ ID NO: 25011 - protein, 450 aa, Artificial Sequence; identical to SEQ ID NO: 22261
  Description of Artificial Sequence: Synthetic polypeptide
  XENP020669 7G8_H0_L0.65_IgG1_PVA_/S267K Heavy Chain

SEQ ID NO: 25012 - protein, 121 aa, Artificial Sequence; identical to SEQ ID NO: 22262
  Description of Artificial Sequence: Synthetic polypeptide
  VH of XENP020669

SEQ ID NO: 25013 - protein, 5 aa, Artificial Sequence
  Description of Artificial Sequence: Synthetic peptide
  XENP020669 vhCDR1
DAWMD

SEQ ID NO: 25014 - protein, 19 aa, Artificial Sequence
  Description of Artificial Sequence: Synthetic peptide
  XENP020669 vhCDR2
EIRTKANNHATYYAESVKG

SEQ ID NO: 25015 - protein, 10 aa, Artificial Sequence
  Description of Artificial Sequence: Synthetic peptide
  XENP020669 vhCDR3
LANWDWYFDV

SEQ ID NO: 25016 - protein, 218 aa, Artificial Sequence
  Description of Artificial Sequence: Synthetic polypeptide
  XENP020669 7G8_H0_L0.65_IgG1_PVA_/S267K Light Chain
DTVLTQSPASLAVSLGQRATISCKASQSVDYDGDSYMNWYQQKPGQPPKLLIYAASYLESGIPARLSGSGSGTDFTLNIHPVEEEDAATYYCQQSNEDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 25017 - protein, 111 aa, Artificial Sequence
  Description of Artificial Sequence: Synthetic polypeptide
  VL of XENP020669
DTVLTQSPASLAVSLGQRATISCKASQSVDYDGDSYMNWYQQKPGQPPKLLIYAASYLESGIPARLSGSGSGTDFTLNIHPVEEEDAATYYCQQSNEDPFTFGSGTKLEVK

SEQ ID NO: 25018 - protein, 15 aa, Artificial Sequence
  Description of Artificial Sequence: Synthetic peptide
  XENP020669 vlCDR1
KASQSVDYDGDSYMN

SEQ ID NO: 25019 - protein, 7 aa, Artificial Sequence
  Description of Artificial Sequence: Synthetic peptide
  XENP020669 vlCDR2
AASYLES

SEQ ID NO: 25020 - protein, 9 aa, Artificial Sequence
  Description of Artificial Sequence: Synthetic peptide
  XENP020669 vlCDR3
QQSNEDPFT

SEQ ID NO: 25021 - protein, 450 aa, Artificial Sequence; identical to SEQ ID NO: 22261
  Description of Artificial Sequence: Synthetic polypeptide
  XENP020670 7G8_H0_L0.66_IgG1_PVA_/S267K Heavy Chain

SEQ ID NO: 25022 - protein, 121 aa, Artificial Sequence; identical to SEQ ID NO: 22262
  Description of Artificial Sequence: Synthetic polypeptide
  VH of XENP020670

SEQ ID NO: 25023 - protein, 5 aa, Artificial Sequence
  Description of Artificial Sequence: Synthetic peptide
  XENP020670 vhCDR1
DAWMD

SEQ ID NO: 25024 - protein, 19 aa, Artificial Sequence
  Description of Artificial Sequence: Synthetic peptide
  XENP020670 vhCDR2
EIRTKANNHATYYAESVKG

SEQ ID NO: 25025 - protein, 10 aa, Artificial Sequence
  Description of Artificial Sequence: Synthetic peptide
  XENP020670 vhCDR3
LANWDWYFDV

SEQ ID NO: 25026 - protein, 218 aa, Artificial Sequence
  Description of Artificial Sequence: Synthetic polypeptide
  XENP020670 7G8_H0_L0.66_IgG1_PVA_/S267K Light Chain
DTVLTQSPASLAVSLGQRATISCKASQSVDYDGDSYMNWYQQKPGQPPKLLIYAASNLQSGIPARLSGSGSGTDFTLNIHPVEEEDAATYYCQQSNEDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 25027 - protein, 111 aa, Artificial Sequence
  Description of Artificial Sequence: Synthetic polypeptide
  VL of XENP020670
DTVLTQSPASLAVSLGQRATISCKASQSVDYDGDSYMNWYQQKPGQPPKLLIYAASNLQSGIPARLSGSGSGTDFTLNIHPVEEEDAATYYCQQSNEDPFTFGSGTKLEVK

SEQ ID NO: 25028 - protein, 15 aa, Artificial Sequence
  Description of Artificial Sequence: Synthetic peptide
  XENP020670 vlCDR1
KASQSVDYDGDSYMN

SEQ ID NO: 25029 - protein, 7 aa, Artificial Sequence
  Description of Artificial Sequence: Synthetic peptide
  XENP020670 vlCDR2
AASNLQS

SEQ ID NO: 25030 - protein, 9 aa, Artificial Sequence
  Description of Artificial Sequence: Synthetic peptide
  XENP020670 vlCDR3
QQSNEDPFT

SEQ ID NO: 25031 - protein, 450 aa, Artificial Sequence; identical to SEQ ID NO: 22261
  Description of Artificial Sequence: Synthetic polypeptide
  XENP020671 7G8_H0_L0.67_IgG1_PVA_/S267K Heavy Chain

SEQ ID NO: 25032 - protein, 121 aa, Artificial Sequence; identical to SEQ ID NO: 22262
  Description of Artificial Sequence: Synthetic polypeptide
  VH of XENP020671

SEQ ID NO: 25033 - protein, 5 aa, Artificial Sequence
  Description of Artificial Sequence: Synthetic peptide
  XENP020671 vhCDR1
DAWMD

SEQ ID NO: 25034 - protein, 19 aa, Artificial Sequence
  Description of Artificial Sequence: Synthetic peptide
  XENP020671 vhCDR2
EIRTKANNHATYYAESVKG

SEQ ID NO: 25035 - protein, 10 aa, Artificial Sequence
  Description of Artificial Sequence: Synthetic peptide
  XENP020671 vhCDR3
LANWDWYFDV

SEQ ID NO: 25036 - protein, 218 aa, Artificial Sequence
  Description of Artificial Sequence: Synthetic polypeptide
  XENP020671 7G8_H0_L0.67_IgG1_PVA_/S267K Light Chain
DTVLTQSPASLAVSLGQRATISCKASQSVDYDGDSYMNWYQQKPGQPPKLLIYAASNLDSGIPARLSGSGSGTDFTLNIHPVEEEDAATYYCQQSNEDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 25037 - protein, 111 aa, Artificial Sequence
  Description of Artificial Sequence: Synthetic polypeptide
  VL of XENP020671
DTVLTQSPASLAVSLGQRATISCKASQSVDYDGDSYMNWYQQKPGQPPKLLIYAASNLDSGIPARLSGSGSGTDFTLNIHPVEEEDAATYYCQQSNEDPFTFGSGTKLEVK

SEQ ID NO: 25038 - protein, 15 aa, Artificial Sequence
  Description of Artificial Sequence: Synthetic peptide
  XENP020671 vlCDR1
KASQSVDYDGDSYMN

SEQ ID NO: 25039 - protein, 7 aa, Artificial Sequence
  Description of Artificial Sequence: Synthetic peptide
  XENP020671 vlCDR2
AASNLDS

SEQ ID NO: 25040 - protein, 9 aa, Artificial Sequence
  Description of Artificial Sequence: Synthetic peptide
  XENP020671 vlCDR3
QQSNEDPFT

SEQ ID NO: 25041 - protein, 450 aa, Artificial Sequence; identical to SEQ ID NO: 22261
  Description of Artificial Sequence: Synthetic polypeptide
  XENP020672 7G8_H0_L0.68_IgG1_PVA_/S267K Heavy Chain

SEQ ID NO: 25042 - protein, 121 aa, Artificial Sequence; identical to SEQ ID NO: 22262
  Description of Artificial Sequence: Synthetic polypeptide
  VH of XENP020672

SEQ ID NO: 25043 - protein, 5 aa, Artificial Sequence
  Description of Artificial Sequence: Synthetic peptide
  XENP020672 vhCDR1
DAWMD

SEQ ID NO: 25044 - protein, 19 aa, Artificial Sequence
  Description of Artificial Sequence: Synthetic peptide
  XENP020672 vhCDR2
EIRTKANNHATYYAESVKG

SEQ ID NO: 25045 - protein, 10 aa, Artificial Sequence
  Description of Artificial Sequence: Synthetic peptide
  XENP020672 vhCDR3
LANWDWYFDV

SEQ ID NO: 25046 - protein, 218 aa, Artificial Sequence
  Description of Artificial Sequence: Synthetic polypeptide
  XENP020672 7G8_H0_L0.68_IgG1_PVA_/S267K Light Chain
DTVLTQSPASLAVSLGQRATISCKASQSVDYDGDSYMNWYQQKPGQPPKLLIYAASNLKSGIPARLSGSGSGTDFTLNIHPVEEEDAATYYCQQSNEDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 25047 - protein, 111 aa, Artificial Sequence
  Description of Artificial Sequence: Synthetic polypeptide
  VL of XENP020672
DTVLTQSPASLAVSLGQRATISCKASQSVDYDGDSYMNWYQQKPGQPPKLLIYAASNLKSGIPARLSGSGSGTDFTLNIHPVEEEDAATYYCQQSNEDPFTFGSGTKLEVK

SEQ ID NO: 25048 - protein, 15 aa, Artificial Sequence
  Description of Artificial Sequence: Synthetic peptide
  XENP020672 vlCDR1
KASQSVDYDGDSYMN

SEQ ID NO: 25049 - protein, 7 aa, Artificial Sequence
  Description of Artificial Sequence: Synthetic peptide
  XENP020672 vlCDR2
AASNLKS

SEQ ID NO: 25050 - protein, 9 aa, Artificial Sequence
  Description of Artificial Sequence: Synthetic peptide
  XENP020672 vlCDR3
QQSNEDPFT

SEQ ID NO: 25051 - protein, 450 aa, Artificial Sequence; identical to SEQ ID NO: 22261
  Description of Artificial Sequence: Synthetic polypeptide
  XENP020673 7G8_H0_L0.69_IgG1_PVA_/S267K Heavy Chain

SEQ ID NO: 25052 - protein, 121 aa, Artificial Sequence; identical to SEQ ID NO: 22262
  Description of Artificial Sequence: Synthetic polypeptide
  VH of XENP020673

SEQ ID NO: 25053 - protein, 5 aa, Artificial Sequence
  Description of Artificial Sequence: Synthetic peptide
  XENP020673 vhCDR1
DAWMD

SEQ ID NO: 25054 - protein, 19 aa, Artificial Sequence
  Description of Artificial Sequence: Synthetic peptide
  XENP020673 vhCDR2
EIRTKANNHATYYAESVKG

SEQ ID NO: 25055 - protein, 10 aa, Artificial Sequence
  Description of Artificial Sequence: Synthetic peptide
  XENP020673 vhCDR3
LANWDWYFDV

SEQ ID NO: 25056 - protein, 218 aa, Artificial Sequence
  Description of Artificial Sequence: Synthetic polypeptide
  XENP020673 7G8_H0_L0.69_IgG1_PVA_/S267K Light Chain
DTVLTQSPASLAVSLGQRATISCKASQSVDYDGDSYMNWYQQKPGQPPKLLIYAASNLHSGIPARLSGSGSGTDFTLNIHPVEEEDAATYYCQQSNEDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 25057 - protein, 111 aa, Artificial Sequence
  Description of Artificial Sequence: Synthetic polypeptide
  VL of XENP020673
DTVLTQSPASLAVSLGQRATISCKASQSVDYDGDSYMNWYQQKPGQPPKLLIYAASNLHSGIPARLSGSGSGTDFTLNIHPVEEEDAATYYCQQSNEDPFTFGSGTKLEVK

SEQ ID NO: 25058 - protein, 15 aa, Artificial Sequence
  Description of Artificial Sequence: Synthetic peptide
  XENP020673 vlCDR1
KASQSVDYDGDSYMN

SEQ ID NO: 25059 - protein, 7 aa, Artificial Sequence
  Description of Artificial Sequence: Synthetic peptide
  XENP020673 vlCDR2
AASNLHS

SEQ ID NO: 25060 - protein, 9 aa, Artificial Sequence
  Description of Artificial Sequence: Synthetic peptide
  XENP020673 vlCDR3
QQSNEDPFT

SEQ ID NO: 25061 - protein, 450 aa, Artificial Sequence; identical to SEQ ID NO: 22261
  Description of Artificial Sequence: Synthetic polypeptide
  XENP020674 7G8_H0_L0.70_IgG1_PVA_/S267K Heavy Chain

SEQ ID NO: 25062 - protein, 121 aa, Artificial Sequence; identical to SEQ ID NO: 22262
  Description of Artificial Sequence: Synthetic polypeptide
  VH of XENP020674

SEQ ID NO: 25063 - protein, 5 aa, Artificial Sequence
  Description of Artificial Sequence: Synthetic peptide
  XENP020674 vhCDR1
DAWMD

SEQ ID NO: 25064 - protein, 19 aa, Artificial Sequence
  Description of Artificial Sequence: Synthetic peptide
  XENP020674 vhCDR2
EIRTKANNHATYYAESVKG

SEQ ID NO: 25065 - protein, 10 aa, Artificial Sequence
  Description of Artificial Sequence: Synthetic peptide
  XENP020674 vhCDR3
LANWDWYFDV

SEQ ID NO: 25066 - protein, 218 aa, Artificial Sequence
  Description of Artificial Sequence: Synthetic polypeptide
  XENP020674 7G8_H0_L0.70_IgG1_PVA_/S267K Light Chain
DTVLTQSPASLAVSLGQRATISCKASQSVDYDGDSYMNWYQQKPGQPPKLLIYAASNLASGIPARLSGSGSGTDFTLNIHPVEEEDAATYYCQQSNEDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 25067 - protein, 111 aa, Artificial Sequence
  Description of Artificial Sequence: Synthetic polypeptide
  VL of XENP020674
DTVLTQSPASLAVSLGQRATISCKASQSVDYDGDSYMNWYQQKPGQPPKLLIYAASNLASGIPARLSGSGSGTDFTLNIHPVEEEDAATYYCQQSNEDPFTFGSGTKLEVK

SEQ ID NO: 25068 - protein, 15 aa, Artificial Sequence
  Description of Artificial Sequence: Synthetic peptide
  XENP020674 vlCDR1
KASQSVDYDGDSYMN

SEQ ID NO: 25069 - protein, 7 aa, Artificial Sequence
  Description of Artificial Sequence: Synthetic peptide
  XENP020674 vlCDR2
AASNLAS

SEQ ID NO: 25070 - protein, 9 aa, Artificial Sequence
  Description of Artificial Sequence: Synthetic peptide
  XENP020674 vlCDR3
QQSNEDPFT

SEQ ID NO: 25071 - protein, 450 aa, Artificial Sequence; identical to SEQ ID NO: 22261
  Description of Artificial Sequence: Synthetic polypeptide
  XENP020675 7G8_H0_L0.71_IgG1_PVA_/S267K Heavy Chain

SEQ ID NO: 25072 - protein, 121 aa, Artificial Sequence; identical to SEQ ID NO: 22262
  Description of Artificial Sequence: Synthetic polypeptide
  VH of XENP020675

SEQ ID NO: 25073 - protein, 5 aa, Artificial Sequence
  Description of Artificial Sequence: Synthetic peptide
  XENP020675 vhCDR1
DAWMD

SEQ ID NO: 25074 - protein, 19 aa, Artificial Sequence
  Description of Artificial Sequence: Synthetic peptide
  XENP020675 vhCDR2
EIRTKANNHATYYAESVKG

SEQ ID NO: 25075 - protein, 10 aa, Artificial Sequence
  Description of Artificial Sequence: Synthetic peptide
  XENP020675 vhCDR3
LANWDWYFDV

SEQ ID NO: 25076 - protein, 218 aa, Artificial Sequence
  Description of Artificial Sequence: Synthetic polypeptide
  XENP020675 7G8_H0_L0.71_IgG1_PVA_/S267K Light Chain
DTVLTQSPASLAVSLGQRATISCKASQSVDYDGDSYMNWYQQKPGQPPKLLIYAASNLGSGIPARLSGSGSGTDFTLNIHPVEEEDAATYYCQQSNEDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 25077 - protein, 111 aa, Artificial Sequence
  Description of Artificial Sequence: Synthetic polypeptide
  VL of XENP020675
DTVLTQSPASLAVSLGQRATISCKASQSVDYDGDSYMNWYQQKPGQPPKLLIYAASNLGSGIPARLSGSGSGTDFTLNIHPVEEEDAATYYCQQSNEDPFTFGSGTKLEVK

SEQ ID NO: 25078 - protein, 15 aa, Artificial Sequence
  Description of Artificial Sequence: Synthetic peptide
  XENP020675 vlCDR1
KASQSVDYDGDSYMN

SEQ ID NO: 25079 - protein, 7 aa, Artificial Sequence
  Description of Artificial Sequence: Synthetic peptide
  XENP020675 vlCDR2
AASNLGS

SEQ ID NO: 25080 - protein, 9 aa, Artificial Sequence
  Description of Artificial Sequence: Synthetic peptide
  XENP020675 vlCDR3
QQSNEDPFT

SEQ ID NO: 25081 - protein, 450 aa, Artificial Sequence; identical to SEQ ID NO: 22261
  Description of Artificial Sequence: Synthetic polypeptide
  XENP020676 7G8_H0_L0.72_IgG1_PVA_/S267K Heavy Chain

SEQ ID NO: 25082 - protein, 121 aa, Artificial Sequence; identical to SEQ ID NO: 22262
  Description of Artificial Sequence: Synthetic polypeptide
  VH of XENP020676

SEQ ID NO: 25083 - protein, 5 aa, Artificial Sequence
  Description of Artificial Sequence: Synthetic peptide
  XENP020676 vhCDR1
DAWMD

SEQ ID NO: 25084 - protein, 19 aa, Artificial Sequence
  Description of Artificial Sequence: Synthetic peptide
  XENP020676 vhCDR2
EIRTKANNHATYYAESVKG

SEQ ID NO: 25085 - protein, 10 aa, Artificial Sequence
  Description of Artificial Sequence: Synthetic peptide
  XENP020676 vhCDR3
LANWDWYFDV

SEQ ID NO: 25086 - protein, 218 aa, Artificial Sequence
  Description of Artificial Sequence: Synthetic polypeptide
  XENP020676 7G8_H0_L0.72_IgG1_PVA_/S267K Light Chain
DTVLTQSPASLAVSLGQRATISCKASQSVDYDGDSYMNWYQQKPGQPPKLLIYAASNLYSGIPARLSGSGSGTDFTLNIHPVEEEDAATYYCQQSNEDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 25087 - protein, 111 aa, Artificial Sequence
  Description of Artificial Sequence: Synthetic polypeptide
  VL of XENP020676
DTVLTQSPASLAVSLGQRATISCKASQSVDYDGDSYMNWYQQKPGQPPKLLIYAASNLYSGIPARLSGSGSGTDFTLNIHPVEEEDAATYYCQQSNEDPFTFGSGTKLEVK

SEQ ID NO: 25088 - protein, 15 aa, Artificial Sequence
  Description of Artificial Sequence: Synthetic peptide
  XENP020676 vlCDR1
KASQSVDYDGDSYMN

SEQ ID NO: 25089 - protein, 7 aa, Artificial Sequence
  Description of Artificial Sequence: Synthetic peptide
  XENP020676 vlCDR2
AASNLYS

SEQ ID NO: 25090 - protein, 9 aa, Artificial Sequence
  Description of Artificial Sequence: Synthetic peptide
  XENP020676 vlCDR3
QQSNEDPFT

SEQ ID NO: 25091 - protein, 450 aa, Artificial Sequence; identical to SEQ ID NO: 22261
  Description of Artificial Sequence: Synthetic polypeptide
  XENP020677 7G8_H0_L0.73_IgG1_PVA_/S267K Heavy Chain

SEQ ID NO: 25092 - protein, 121 aa, Artificial Sequence; identical to SEQ ID NO: 22262
  Description of Artificial Sequence: Synthetic polypeptide
  VH of XENP020677

SEQ ID NO: 25093 - protein, 5 aa, Artificial Sequence
  Description of Artificial Sequence: Synthetic peptide
  XENP020677 vhCDR1
DAWMD

SEQ ID NO: 25094 - protein, 19 aa, Artificial Sequence
  Description of Artificial Sequence: Synthetic peptide
  XENP020677 vhCDR2
EIRTKANNHATYYAESVKG

SEQ ID NO: 25095 - protein, 10 aa, Artificial Sequence
  Description of Artificial Sequence: Synthetic peptide
  XENP020677 vhCDR3
LANWDWYFDV

SEQ ID NO: 25096 - protein, 218 aa, Artificial Sequence
  Description of Artificial Sequence: Synthetic polypeptide
  XENP020677 7G8_H0_L0.73_IgG1_PVA_/S267K Light Chain
DTVLTQSPASLAVSLGQRATISCKASQSVDYDGDSYMNWYQQKPGQPPKLLIYAASNLISGIPARLSGSGSGTDFTLNIHPVEEEDAATYYCQQSNEDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 25097 - protein, 111 aa, Artificial Sequence
  Description of Artificial Sequence: Synthetic polypeptide
  VL of XENP020677
DTVLTQSPASLAVSLGQRATISCKASQSVDYDGDSYMNWYQQKPGQPPKLLIYAASNLISGIPARLSGSGSGTDFTLNIHPVEEEDAATYYCQQSNEDPFTFGSGTKLEVK

SEQ ID NO: 25098 - protein, 15 aa, Artificial Sequence
  Description of Artificial Sequence: Synthetic peptide
  XENP020677 vlCDR1
KASQSVDYDGDSYMN

SEQ ID NO: 25099 - protein, 7 aa, Artificial Sequence
  Description of Artificial Sequence: Synthetic peptide
  XENP020677 vlCDR2
AASNLIS

SEQ ID NO: 25100 - protein, 9 aa, Artificial Sequence
  Description of Artificial Sequence: Synthetic peptide
  XENP020677 vlCDR3
QQSNEDPFT

SEQ ID NO: 25101 - protein, 450 aa, Artificial Sequence; identical to SEQ ID NO: 22261
  Description of Artificial Sequence: Synthetic polypeptide
  XENP020678 7G8_H0_L0.74_IgG1_PVA_/S267K Heavy Chain

SEQ ID NO: 25102 - protein, 121 aa, Artificial Sequence; identical to SEQ ID NO: 22262
  Description of Artificial Sequence: Synthetic polypeptide
  VH of XENP020678

SEQ ID NO: 25103 - protein, 5 aa, Artificial Sequence
  Description of Artificial Sequence: Synthetic peptide
  XENP020678 vhCDR1
DAWMD

SEQ ID NO: 25104 - protein, 19 aa, Artificial Sequence
  Description of Artificial Sequence: Synthetic peptide
  XENP020678 vhCDR2
EIRTKANNHATYYAESVKG

SEQ ID NO: 25105 - protein, 10 aa, Artificial Sequence
  Description of Artificial Sequence: Synthetic peptide
  XENP020678 vhCDR3
LANWDWYFDV

SEQ ID NO: 25106 - protein, 218 aa, Artificial Sequence
  Description of Artificial Sequence: Synthetic polypeptide
  XENP020678 7G8_H0_L0.74_IgG1_PVA_/S267K Light Chain
DTVLTQSPASLAVSLGQRATISCKASQSVDYDGDSYMNWYQQKPGQPPKLLIYAASNLESGIPARLSGSGSGTDFTLNIHPVEEEDAATYYCQQTNEDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 25107 - protein, 111 aa, Artificial Sequence
  Description of Artificial Sequence: Synthetic polypeptide
  VL of XENP020678
DTVLTQSPASLAVSLGQRATISCKASQSVDYDGDSYMNWYQQKPGQPPKLLIYAASNLESGIPARLSGSGSGTDFTLNIHPVEEEDAATYYCQQTNEDPFTFGSGTKLEVK

SEQ ID NO: 25108 - protein, 15 aa, Artificial Sequence
  Description of Artificial Sequence: Synthetic peptide
  XENP020678 vlCDR1
KASQSVDYDGDSYMN

SEQ ID NO: 25109 - protein, 7 aa, Artificial Sequence
  Description of Artificial Sequence: Synthetic peptide
  XENP020678 vlCDR2
AASNLES

SEQ ID NO: 25110 - protein, 9 aa, Artificial Sequence
  Description of Artificial Sequence: Synthetic peptide
  XENP020678 vlCDR3
QQTNEDPFT

SEQ ID NO: 25111 - protein, 450 aa, Artificial Sequence; identical to SEQ ID NO: 22261
  Description of Artificial Sequence: Synthetic polypeptide
  XENP020679 7G8_H0_L0.75_IgG1_PVA_/S267K Heavy Chain

SEQ ID NO: 25112 - protein, 121 aa, Artificial Sequence; identical to SEQ ID NO: 22262
  Description of Artificial Sequence: Synthetic polypeptide
  VH of XENP020679

SEQ ID NO: 25113 - protein, 5 aa, Artificial Sequence
  Description of Artificial Sequence: Synthetic peptide
  XENP020679 vhCDR1
DAWMD

SEQ ID NO: 25114 - protein, 19 aa, Artificial Sequence
  Description of Artificial Sequence: Synthetic peptide
  XENP020679 vhCDR2
EIRTKANNHATYYAESVKG

SEQ ID NO: 25115 - protein, 10 aa, Artificial Sequence
  Description of Artificial Sequence: Synthetic peptide
  XENP020679 vhCDR3
LANWDWYFDV

SEQ ID NO: 25116 - protein, 218 aa, Artificial Sequence
  Description of Artificial Sequence: Synthetic polypeptide
  XENP020679 7G8_H0_L0.75_IgG1_PVA_/S267K Light Chain
DTVLTQSPASLAVSLGQRATISCKASQSVDYDGDSYMNWYQQKPGQPPKLLIYAASNLESGIPARLSGSGSGTDFTLNIHPVEEEDAATYYCQQANEDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 25117 - protein, 111 aa, Artificial Sequence
  Description of Artificial Sequence: Synthetic polypeptide
  VL of XENP020679
DTVLTQSPASLAVSLGQRATISCKASQSVDYDGDSYMNWYQQKPGQPPKLLIYAASNLESGIPARLSGSGSGTDFTLNIHPVEEEDAATYYCQQANEDPFTFGSGTKLEVK

SEQ ID NO: 25118 - protein, 15 aa, Artificial Sequence
  Description of Artificial Sequence: Synthetic peptide
  XENP020679 vlCDR1
KASQSVDYDGDSYMN

SEQ ID NO: 25119 - protein, 7 aa, Artificial Sequence
  Description of Artificial Sequence: Synthetic peptide
  XENP020679 vlCDR2
AASNLES

SEQ ID NO: 25120 - protein, 9 aa, Artificial Sequence
  Description of Artificial Sequence: Synthetic peptide
  XENP020679 vlCDR3
QQANEDPFT

SEQ ID NO: 25121 - protein, 450 aa, Artificial Sequence; identical to SEQ ID NO: 22261
  Description of Artificial Sequence: Synthetic polypeptide
  XENP020680 7G8_H0_L0.76_IgG1_PVA_/S267K Heavy Chain

SEQ ID NO: 25122 - protein, 121 aa, Artificial Sequence; identical to SEQ ID NO: 22262
  Description of Artificial Sequence: Synthetic polypeptide
  VH of XENP020680

SEQ ID NO: 25123 - protein, 5 aa, Artificial Sequence
  Description of Artificial Sequence: Synthetic peptide
  XENP020680 vhCDR1
DAWMD

SEQ ID NO: 25124 - protein, 19 aa, Artificial Sequence
  Description of Artificial Sequence: Synthetic peptide
  XENP020680 vhCDR2
EIRTKANNHATYYAESVKG

SEQ ID NO: 25125 - protein, 10 aa, Artificial Sequence
  Description of Artificial Sequence: Synthetic peptide
  XENP020680 vhCDR3
LANWDWYFDV

SEQ ID NO: 25126 - protein, 218 aa, Artificial Sequence
  Description of Artificial Sequence: Synthetic polypeptide
  XENP020680 7G8_H0_L0.76_IgG1_PVA_/S267K Light Chain
DTVLTQSPASLAVSLGQRATISCKASQSVDYDGDSYMNWYQQKPGQPPKLLIYAASNLESGIPARLSGSGSGTDFTLNIHPVEEEDAATYYCQQQNEDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 25127 - protein, 111 aa, Artificial Sequence
  Description of Artificial Sequence: Synthetic polypeptide
  VL of XENP020680
DTVLTQSPASLAVSLGQRATISCKASQSVDYDGDSYMNWYQQKPGQPPKLLIYAASNLESGIPARLSGSGSGTDFTLNIHPVEEEDAATYYCQQQNEDPFTFGSGTKLEVK

SEQ ID NO: 25128 - protein, 15 aa, Artificial Sequence
  Description of Artificial Sequence: Synthetic peptide
  XENP020680 vlCDR1
KASQSVDYDGDSYMN

SEQ ID NO: 25129 - protein, 7 aa, Artificial Sequence
  Description of Artificial Sequence: Synthetic peptide
  XENP020680 vlCDR2
AASNLES

SEQ ID NO: 25130 - protein, 9 aa, Artificial Sequence
  Description of Artificial Sequence: Synthetic peptide
  XENP020680 vlCDR3
QQQNEDPFT

SEQ ID NO: 25131 - protein, 450 aa, Artificial Sequence; identical to SEQ ID NO: 22261
  Description of Artificial Sequence: Synthetic polypeptide
  XENP020681 7G8_H0_L0.77_IgG1_PVA_/S267K Heavy Chain

SEQ ID NO: 25132 - protein, 121 aa, Artificial Sequence; identical to SEQ ID NO: 22262
  Description of Artificial Sequence: Synthetic polypeptide
  VH of XENP020681

SEQ ID NO: 25133 - protein, 5 aa, Artificial Sequence
  Description of Artificial Sequence: Synthetic peptide
  XENP020681 vhCDR1
DAWMD

SEQ ID NO: 25134 - protein, 19 aa, Artificial Sequence
  Description of Artificial Sequence: Synthetic peptide
  XENP020681 vhCDR2
EIRTKANNHATYYAESVKG

SEQ ID NO: 25135 - protein, 10 aa, Artificial Sequence
  Description of Artificial Sequence: Synthetic peptide
  XENP020681 vhCDR3
LANWDWYFDV

SEQ ID NO: 25136 - protein, 218 aa, Artificial Sequence
  Description of Artificial Sequence: Synthetic polypeptide
  XENP020681 7G8_H0_L0.77_IgG1_PVA_/S267K Light Chain
DTVLTQSPASLAVSLGQRATISCKASQSVDYDGDSYMNWYQQKPGQPPKLLIYAASNLESGIPARLSGSGSGTDFTLNIHPVEEEDAATYYCQQGNEDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 25137 - protein, 111 aa, Artificial Sequence
  Description of Artificial Sequence: Synthetic polypeptide
  VL of XENP020681
DTVLTQSPASLAVSLGQRATISCKASQSVDYDGDSYMNWYQQKPGQPPKLLIYAASNLESGIPARLSGSGSGTDFTLNIHPVEEEDAATYYCQQGNEDPFTFGSGTKLEVK

SEQ ID NO: 25138 - protein, 15 aa, Artificial Sequence
  Description of Artificial Sequence: Synthetic peptide
  XENP020681 vlCDR1
KASQSVDYDGDSYMN

SEQ ID NO: 25139 - protein, 7 aa, Artificial Sequence
  Description of Artificial Sequence: Synthetic peptide
  XENP020681 vlCDR2
AASNLES

SEQ ID NO: 25140 - protein, 9 aa, Artificial Sequence
  Description of Artificial Sequence: Synthetic peptide
  XENP020681 vlCDR3
QQGNEDPFT

SEQ ID NO: 25141 - protein, 450 aa, Artificial Sequence; identical to SEQ ID NO: 22261
  Description of Artificial Sequence: Synthetic polypeptide
  XENP020682 7G8_H0_L0.78_IgG1_PVA_/S267K Heavy Chain

SEQ ID NO: 25142 - protein, 121 aa, Artificial Sequence; identical to SEQ ID NO: 22262
  Description of Artificial Sequence: Synthetic polypeptide
  VH of XENP020682

SEQ ID NO: 25143 - protein, 5 aa, Artificial Sequence
  Description of Artificial Sequence: Synthetic peptide
  XENP020682 vhCDR1
DAWMD

SEQ ID NO: 25144 - protein, 19 aa, Artificial Sequence
  Description of Artificial Sequence: Synthetic peptide
  XENP020682 vhCDR2
EIRTKANNHATYYAESVKG

SEQ ID NO: 25145 - protein, 10 aa, Artificial Sequence
  Description of Artificial Sequence: Synthetic peptide
  XENP020682 vhCDR3
LANWDWYFDV

SEQ ID NO: 25146 - protein, 218 aa, Artificial Sequence
  Description of Artificial Sequence: Synthetic polypeptide
  XENP020682 7G8_H0_L0.78_IgG1_PVA_/S267K Light Chain
DTVLTQSPASLAVSLGQRATISCKASQSVDYDGDSYMNWYQQKPGQPPKLLIYAASNLESGIPARLSGSGSGTDFTLNIHPVEEEDAATYYCQQVNEDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 25147 - protein, 111 aa, Artificial Sequence
  Description of Artificial Sequence: Synthetic polypeptide
  VL of XENP020682
DTVLTQSPASLAVSLGQRATISCKASQSVDYDGDSYMNWYQQKPGQPPKLLIYAASNLESGIPARLSGSGSGTDFTLNIHPVEEEDAATYYCQQVNEDPFTFGSGTKLEVK

SEQ ID NO: 25148 - protein, 15 aa, Artificial Sequence
  Description of Artificial Sequence: Synthetic peptide
  XENP020682 vlCDR1
KASQSVDYDGDSYMN

SEQ ID NO: 25149 - protein, 7 aa, Artificial Sequence
  Description of Artificial Sequence: Synthetic peptide
  XENP020682 vlCDR2
AASNLES

SEQ ID NO: 25150 - protein, 9 aa, Artificial Sequence
  Description of Artificial Sequence: Synthetic peptide
  XENP020682 vlCDR3
QQVNEDPFT

SEQ ID NO: 25151 - protein, 450 aa, Artificial Sequence; identical to SEQ ID NO: 22261
  Description of Artificial Sequence: Synthetic polypeptide
  XENP020683 7G8_H0_L0.79_IgG1_PVA_/S267K Heavy Chain

SEQ ID NO: 25152 - protein, 121 aa, Artificial Sequence; identical to SEQ ID NO: 22262
  Description of Artificial Sequence: Synthetic polypeptide
  VH of XENP020683

SEQ ID NO: 25153 - protein, 5 aa, Artificial Sequence
  Description of Artificial Sequence: Synthetic peptide
  XENP020683 vhCDR1
DAWMD

SEQ ID NO: 25154 - protein, 19 aa, Artificial Sequence
  Description of Artificial Sequence: Synthetic peptide
  XENP020683 vhCDR2
EIRTKANNHATYYAESVKG

SEQ ID NO: 25155 - protein, 10 aa, Artificial Sequence
  Description of Artificial Sequence: Synthetic peptide
  XENP020683 vhCDR3
LANWDWYFDV

SEQ ID NO: 25156 - protein, 218 aa, Artificial Sequence
  Description of Artificial Sequence: Synthetic polypeptide
  XENP020683 7G8_H0_L0.79_IgG1_PVA_/S267K Light Chain
DTVLTQSPASLAVSLGQRATISCKASQSVDYDGDSYMNWYQQKPGQPPKLLIYAASNLESGIPARLSGSGSGTDFTLNIHPVEEEDAATYYCQQHNEDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 25157 - protein, 111 aa, Artificial Sequence
  Description of Artificial Sequence: Synthetic polypeptide
  VL of XENP020683
DTVLTQSPASLAVSLGQRATISCKASQSVDYDGDSYMNWYQQKPGQPPKLLIYAASNLESGIPARLSGSGSGTDFTLNIHPVEEEDAATYYCQQHNEDPFTFGSGTKLEVK

SEQ ID NO: 25158 - protein, 15 aa, Artificial Sequence
  Description of Artificial Sequence: Synthetic peptide
  XENP020683 vlCDR1
KASQSVDYDGDSYMN

SEQ ID NO: 25159 - protein, 7 aa, Artificial Sequence
  Description of Artificial Sequence: Synthetic peptide
  XENP020683 vlCDR2
AASNLES

SEQ ID NO: 25160 - protein, 9 aa, Artificial Sequence
  Description of Artificial Sequence: Synthetic peptide
  XENP020683 vlCDR3
QQHNEDPFT

SEQ ID NO: 25161 - protein, 450 aa, Artificial Sequence; identical to SEQ ID NO: 22261
  Description of Artificial Sequence: Synthetic polypeptide
  XENP020684 7G8_H0_L0.80_IgG1_PVA_/S267K Heavy Chain

SEQ ID NO: 25162 - protein, 121 aa, Artificial Sequence; identical to SEQ ID NO: 22262
  Description of Artificial Sequence: Synthetic polypeptide
  VH of XENP020684

SEQ ID NO: 25163 - protein, 5 aa, Artificial Sequence
  Description of Artificial Sequence: Synthetic peptide
  XENP020684 vhCDR1
DAWMD

SEQ ID NO: 25164 - protein, 19 aa, Artificial Sequence
  Description of Artificial Sequence: Synthetic peptide
  XENP020684 vhCDR2
EIRTKANNHATYYAESVKG

SEQ ID NO: 25165 - protein, 10 aa, Artificial Sequence
  Description of Artificial Sequence: Synthetic peptide
  XENP020684 vhCDR3
LANWDWYFDV

SEQ ID NO: 25166 - protein, 218 aa, Artificial Sequence
  Description of Artificial Sequence: Synthetic polypeptide
  XENP020684 7G8_H0_L0.80_IgG1_PVA_/S267K Light Chain
DTVLTQSPASLAVSLGQRATISCKASQSVDYDGDSYMNWYQQKPGQPPKLLIYAASNLESGIPARLSGSGSGTDFTLNIHPVEEEDAATYYCQQDNEDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 25167 - protein, 111 aa, Artificial Sequence
  Description of Artificial Sequence: Synthetic polypeptide
  VL of XENP020684
DTVLTQSPASLAVSLGQRATISCKASQSVDYDGDSYMNWYQQKPGQPPKLLIYAASNLESGIPARLSGSGSGTDFTLNIHPVEEEDAATYYCQQDNEDPFTFGSGTKLEVK

SEQ ID NO: 25168 - protein, 15 aa, Artificial Sequence
  Description of Artificial Sequence: Synthetic peptide
  XENP020684 vlCDR1
KASQSVDYDGDSYMN

SEQ ID NO: 25169 - protein, 7 aa, Artificial Sequence
  Description of Artificial Sequence: Synthetic peptide
  XENP020684 vlCDR2
AASNLES

SEQ ID NO: 25170 - protein, 9 aa, Artificial Sequence
  Description of Artificial Sequence: Synthetic peptide
  XENP020684 vlCDR3
QQDNEDPFT

SEQ ID NO: 25171 - protein, 450 aa, Artificial Sequence; identical to SEQ ID NO: 22261
  Description of Artificial Sequence: Synthetic polypeptide
  XENP020685 7G8_H0_L0.81_IgG1_PVA_/S267K Heavy Chain

SEQ ID NO: 25172 - protein, 121 aa, Artificial Sequence; identical to SEQ ID NO: 22262
  Description of Artificial Sequence: Synthetic polypeptide
  VH of XENP020685

SEQ ID NO: 25173 - protein, 5 aa, Artificial Sequence
  Description of Artificial Sequence: Synthetic peptide
  XENP020685 vhCDR1
DAWMD

SEQ ID NO: 25174 - protein, 19 aa, Artificial Sequence
  Description of Artificial Sequence: Synthetic peptide
  XENP020685 vhCDR2
EIRTKANNHATYYAESVKG

SEQ ID NO: 25175 - protein, 10 aa, Artificial Sequence
  Description of Artificial Sequence: Synthetic peptide
  XENP020685 vhCDR3
LANWDWYFDV

SEQ ID NO: 25176 - protein, 218 aa, Artificial Sequence
  Description of Artificial Sequence: Synthetic polypeptide
  XENP020685 7G8_H0_L0.81_IgG1_PVA_/S267K Light Chain
DTVLTQSPASLAVSLGQRATISCKASQSVDYDGDSYMNWYQQKPGQPPKLLIYAASNLESGIPARLSGSGSGTDFTLNIHPVEEEDAATYYCQQKNEDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 25177 - protein, 111 aa, Artificial Sequence
  Description of Artificial Sequence: Synthetic polypeptide
  VL of XENP020685
DTVLTQSPASLAVSLGQRATISCKASQSVDYDGDSYMNWYQQKPGQPPKLLIYAASNLESGIPARLSGSGSGTDFTLNIHPVEEEDAATYYCQQKNEDPFTFGSGTKLEVK

SEQ ID NO: 25178 - protein, 15 aa, Artificial Sequence
  Description of Artificial Sequence: Synthetic peptide
  XENP020685 vlCDR1
KASQSVDYDGDSYMN

SEQ ID NO: 25179 - protein, 7 aa, Artificial Sequence
  Description of Artificial Sequence: Synthetic peptide
  XENP020685 vlCDR2
AASNLES

SEQ ID NO: 25180 - protein, 9 aa, Artificial Sequence
  Description of Artificial Sequence: Synthetic peptide
  XENP020685 vlCDR3
QQKNEDPFT

SEQ ID NO: 25181 - protein, 450 aa, Artificial Sequence; identical to SEQ ID NO: 22261
  Description of Artificial Sequence: Synthetic polypeptide
  XENP020686 7G8_H0_L0.82_IgG1_PVA_/S267K Heavy Chain

SEQ ID NO: 25182 - protein, 121 aa, Artificial Sequence; identical to SEQ ID NO: 22262
  Description of Artificial Sequence: Synthetic polypeptide
  VH of XENP020686

SEQ ID NO: 25183 - protein, 5 aa, Artificial Sequence
  Description of Artificial Sequence: Synthetic peptide
  XENP020686 vhCDR1
DAWMD

SEQ ID NO: 25184 - protein, 19 aa, Artificial Sequence
  Description of Artificial Sequence: Synthetic peptide
  XENP020686 vhCDR2
EIRTKANNHATYYAESVKG

SEQ ID NO: 25185 - protein, 10 aa, Artificial Sequence
  Description of Artificial Sequence: Synthetic peptide
  XENP020686 vhCDR3
LANWDWYFDV

SEQ ID NO: 25186 - protein, 218 aa, Artificial Sequence
  Description of Artificial Sequence: Synthetic polypeptide
  XENP020686 7G8_H0_L0.82_IgG1_PVA_/S267K Light Chain
DTVLTQSPASLAVSLGQRATISCKASQSVDYDGDSYMNWYQQKPGQPPKLLIYAASNLESGIPARLSGSGSGTDFTLNIHPVEEEDAATYYCQQYNEDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 25187 - protein, 111 aa, Artificial Sequence
  Description of Artificial Sequence: Synthetic polypeptide
  VL of XENP020686
DTVLTQSPASLAVSLGQRATISCKASQSVDYDGDSYMNWYQQKPGQPPKLLIYAASNLESGIPARLSGSGSGTDFTLNIHPVEEEDAATYYCQQYNEDPFTFGSGTKLEVK

SEQ ID NO: 25188 - protein, 15 aa, Artificial Sequence
  Description of Artificial Sequence: Synthetic peptide
  XENP020686 vlCDR1
KASQSVDYDGDSYMN

SEQ ID NO: 25189 - protein, 7 aa, Artificial Sequence
  Description of Artificial Sequence: Synthetic peptide
  XENP020686 vlCDR2
AASNLES

SEQ ID NO: 25190 - protein, 9 aa, Artificial Sequence
  Description of Artificial Sequence: Synthetic peptide
  XENP020686 vlCDR3
QQYNEDPFT

SEQ ID NO: 25191 - protein, 450 aa, Artificial Sequence; identical to SEQ ID NO: 22261
  Description of Artificial Sequence: Synthetic polypeptide
  XENP020687 7G8_H0_L0.83_IgG1_PVA_/S267K Heavy Chain

SEQ ID NO: 25192 - protein, 121 aa, Artificial Sequence; identical to SEQ ID NO: 22262
  Description of Artificial Sequence: Synthetic polypeptide
  VH of XENP020687

SEQ ID NO: 25193 - protein, 5 aa, Artificial Sequence
  Description of Artificial Sequence: Synthetic peptide
  XENP020687 vhCDR1
DAWMD

SEQ ID NO: 25194 - protein, 19 aa, Artificial Sequence
  Description of Artificial Sequence: Synthetic peptide
  XENP020687 vhCDR2
EIRTKANNHATYYAESVKG

SEQ ID NO: 25195 - protein, 10 aa, Artificial Sequence
  Description of Artificial Sequence: Synthetic peptide
  XENP020687 vhCDR3
LANWDWYFDV

SEQ ID NO: 25196 - protein, 218 aa, Artificial Sequence
  Description of Artificial Sequence: Synthetic polypeptide
  XENP020687 7G8_H0_L0.83_IgG1_PVA_/S267K Light Chain
DTVLTQSPASLAVSLGQRATISCKASQSVDYDGDSYMNWYQQKPGQPPKLLIYAASNLESGIPARLSGSGSGTDFTLNIHPVEEEDAATYYCQQSDEDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 25197 - protein, 111 aa, Artificial Sequence
  Description of Artificial Sequence: Synthetic polypeptide
  VL of XENP020687
DTVLTQSPASLAVSLGQRATISCKASQSVDYDGDSYMNWYQQKPGQPPKLLIYAASNLESGIPARLSGSGSGTDFTLNIHPVEEEDAATYYCQQSDEDPFTFGSGTKLEVK

SEQ ID NO: 25198 - protein, 15 aa, Artificial Sequence
  Description of Artificial Sequence: Synthetic peptide
  XENP020687 vlCDR1
KASQSVDYDGDSYMN

SEQ ID NO: 25199 - protein, 7 aa, Artificial Sequence
  Description of Artificial Sequence: Synthetic peptide
  XENP020687 vlCDR2
AASNLES

SEQ ID NO: 25200 - protein, 9 aa, Artificial Sequence
  Description of Artificial Sequence: Synthetic peptide
  XENP020687 vlCDR3
QQSDEDPFT

SEQ ID NO: 25201 - protein, 450 aa, Artificial Sequence; identical to SEQ ID NO: 22261
  Description of Artificial Sequence: Synthetic polypeptide
  XENP020688 7G8_H0_L0.84_IgG1_PVA_/S267K Heavy Chain

SEQ ID NO: 25202 - protein, 121 aa, Artificial Sequence; identical to SEQ ID NO: 22262
  Description of Artificial Sequence: Synthetic polypeptide
  VH of XENP020688

SEQ ID NO: 25203 - protein, 5 aa, Artificial Sequence
  Description of Artificial Sequence: Synthetic peptide
  XENP020688 vhCDR1
DAWMD

SEQ ID NO: 25204 - protein, 19 aa, Artificial Sequence
  Description of Artificial Sequence: Synthetic peptide
  XENP020688 vhCDR2
EIRTKANNHATYYAESVKG

SEQ ID NO: 25205 - protein, 10 aa, Artificial Sequence
  Description of Artificial Sequence: Synthetic peptide
  XENP020688 vhCDR3
LANWDWYFDV

SEQ ID NO: 25206 - protein, 218 aa, Artificial Sequence
  Description of Artificial Sequence: Synthetic polypeptide
  XENP020688 7G8_H0_L0.84_IgG1_PVA_/S267K Light Chain
DTVLTQSPASLAVSLGQRATISCKASQSVDYDGDSYMNWYQQKPGQPPKLLIYAASNLESGIPARLSGSGSGTDFTLNIHPVEEEDAATYYCQQSHEDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 25207 - protein, 111 aa, Artificial Sequence
  Description of Artificial Sequence: Synthetic polypeptide
  VL of XENP020688
DTVLTQSPASLAVSLGQRATISCKASQSVDYDGDSYMNWYQQKPGQPPKLLIYAASNLESGIPARLSGSGSGTDFTLNIHPVEEEDAATYYCQQSHEDPFTFGSGTKLEVK

SEQ ID NO: 25208 - protein, 15 aa, Artificial Sequence
  Description of Artificial Sequence: Synthetic peptide
  XENP020688 vlCDR1
KASQSVDYDGDSYMN

SEQ ID NO: 25209 - protein, 7 aa, Artificial Sequence
  Description of Artificial Sequence: Synthetic peptide
  XENP020688 vlCDR2
AASNLES

SEQ ID NO: 25210 - protein, 9 aa, Artificial Sequence
  Description of Artificial Sequence: Synthetic peptide
  XENP020688 vlCDR3
QQSHEDPFT

SEQ ID NO: 25211 - protein, 450 aa, Artificial Sequence; identical to SEQ ID NO: 22261
  Description of Artificial Sequence: Synthetic polypeptide
  XENP020689 7G8_H0_L0.85_IgG1_PVA_/S267K Heavy Chain

SEQ ID NO: 25212 - protein, 121 aa, Artificial Sequence; identical to SEQ ID NO: 22262
  Description of Artificial Sequence: Synthetic polypeptide
  VH of XENP020689

SEQ ID NO: 25213 - protein, 5 aa, Artificial Sequence
  Description of Artificial Sequence: Synthetic peptide
  XENP020689 vhCDR1
DAWMD

SEQ ID NO: 25214 - protein, 19 aa, Artificial Sequence
  Description of Artificial Sequence: Synthetic peptide
  XENP020689 vhCDR2
EIRTKANNHATYYAESVKG

SEQ ID NO: 25215 - protein, 10 aa, Artificial Sequence
  Description of Artificial Sequence: Synthetic peptide
  XENP020689 vhCDR3
LANWDWYFDV

SEQ ID NO: 25216 - protein, 218 aa, Artificial Sequence
  Description of Artificial Sequence: Synthetic polypeptide
  XENP020689 7G8_H0_L0.85_IgG1_PVA_/S267K Light Chain
DTVLTQSPASLAVSLGQRATISCKASQSVDYDGDSYMNWYQQKPGQPPKLLIYAASNLESGIPARLSGSGSGTDFTLNIHPVEEEDAATYYCQQSEEDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 25217 - protein, 111 aa, Artificial Sequence
  Description of Artificial Sequence: Synthetic polypeptide
  VL of XENP020689
DTVLTQSPASLAVSLGQRATISCKASQSVDYDGDSYMNWYQQKPGQPPKLLIYAASNLESGIPARLSGSGSGTDFTLNIHPVEEEDAATYYCQQSEEDPFTFGSGTKLEVK

SEQ ID NO: 25218 - protein, 15 aa, Artificial Sequence
  Description of Artificial Sequence: Synthetic peptide
  XENP020689 vlCDR1
KASQSVDYDGDSYMN

SEQ ID NO: 25219 - protein, 7 aa, Artificial Sequence
  Description of Artificial Sequence: Synthetic peptide
  XENP020689 vlCDR2
AASNLES

SEQ ID NO: 25220 - protein, 9 aa, Artificial Sequence
  Description of Artificial Sequence: Synthetic peptide
  XENP020689 vlCDR3
QQSEEDPFT

SEQ ID NO: 25221 - protein, 450 aa, Artificial Sequence; identical to SEQ ID NO: 22261
  Description of Artificial Sequence: Synthetic polypeptide
  XENP020690 7G8_H0_L0.86_IgG1_PVA_/S267K Heavy Chain

SEQ ID NO: 25222 - protein, 121 aa, Artificial Sequence; identical to SEQ ID NO: 22262
  Description of Artificial Sequence: Synthetic polypeptide
  VH of XENP020690

SEQ ID NO: 25223 - protein, 5 aa, Artificial Sequence
  Description of Artificial Sequence: Synthetic peptide
  XENP020690 vhCDR1
DAWMD

SEQ ID NO: 25224 - protein, 19 aa, Artificial Sequence
  Description of Artificial Sequence: Synthetic peptide
  XENP020690 vhCDR2
EIRTKANNHATYYAESVKG

SEQ ID NO: 25225 - protein, 10 aa, Artificial Sequence
  Description of Artificial Sequence: Synthetic peptide
  XENP020690 vhCDR3
LANWDWYFDV

SEQ ID NO: 25226 - protein, 218 aa, Artificial Sequence
  Description of Artificial Sequence: Synthetic polypeptide
  XENP020690 7G8_H0_L0.86_IgG1_PVA_/S267K Light Chain
DTVLTQSPASLAVSLGQRATISCKASQSVDYDGDSYMNWYQQKPGQPPKLLIYAASNLESGIPARLSGSGSGTDFTLNIHPVEEEDAATYYCQQSSEDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 25227 - protein, 111 aa, Artificial Sequence
  Description of Artificial Sequence: Synthetic polypeptide
  VL of XENP020690
DTVLTQSPASLAVSLGQRATISCKASQSVDYDGDSYMNWYQQKPGQPPKLLIYAASNLESGIPARLSGSGSGTDFTLNIHPVEEEDAATYYCQQSSEDPFTFGSGTKLEVK

SEQ ID NO: 25228 - protein, 15 aa, Artificial Sequence
  Description of Artificial Sequence: Synthetic peptide
  XENP020690 vlCDR1
KASQSVDYDGDSYMN

SEQ ID NO: 25229 - protein, 7 aa, Artificial Sequence
  Description of Artificial Sequence: Synthetic peptide
  XENP020690 vlCDR2
AASNLES

SEQ ID NO: 25230 - protein, 9 aa, Artificial Sequence
  Description of Artificial Sequence: Synthetic peptide
  XENP020690 vlCDR3
QQSSEDPFT

SEQ ID NO: 25231 - protein, 450 aa, Artificial Sequence; identical to SEQ ID NO: 22261
  Description of Artificial Sequence: Synthetic polypeptide
  XENP020691 7G8_H0_L0.87_IgG1_PVA_/S267K Heavy Chain

SEQ ID NO: 25232 - protein, 121 aa, Artificial Sequence; identical to SEQ ID NO: 22262
  Description of Artificial Sequence: Synthetic polypeptide
  VH of XENP020691

SEQ ID NO: 25233 - protein, 5 aa, Artificial Sequence
  Description of Artificial Sequence: Synthetic peptide
  XENP020691 vhCDR1
DAWMD

SEQ ID NO: 25234 - protein, 19 aa, Artificial Sequence
  Description of Artificial Sequence: Synthetic peptide
  XENP020691 vhCDR2
EIRTKANNHATYYAESVKG

SEQ ID NO: 25235 - protein, 10 aa, Artificial Sequence
  Description of Artificial Sequence: Synthetic peptide
  XENP020691 vhCDR3
LANWDWYFDV

SEQ ID NO: 25236 - protein, 218 aa, Artificial Sequence
  Description of Artificial Sequence: Synthetic polypeptide
  XENP020691 7G8_H0_L0.87_IgG1_PVA_/S267K Light Chain
DTVLTQSPASLAVSLGQRATISCKASQSVDYDGDSYMNWYQQKPGQPPKLLIYAASNLESGIPARLSGSGSGTDFTLNIHPVEEEDAATYYCQQSREDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 25237 - protein, 111 aa, Artificial Sequence
  Description of Artificial Sequence: Synthetic polypeptide
  VL of XENP020691
DTVLTQSPASLAVSLGQRATISCKASQSVDYDGDSYMNWYQQKPGQPPKLLIYAASNLESGIPARLSGSGSGTDFTLNIHPVEEEDAATYYCQQSREDPFTFGSGTKLEVK

SEQ ID NO: 25238 - protein, 15 aa, Artificial Sequence
  Description of Artificial Sequence: Synthetic peptide
  XENP020691 vlCDR1
KASQSVDYDGDSYMN

SEQ ID NO: 25239 - protein, 7 aa, Artificial Sequence
  Description of Artificial Sequence: Synthetic peptide
  XENP020691 vlCDR2
AASNLES

SEQ ID NO: 25240 - protein, 9 aa, Artificial Sequence
  Description of Artificial Sequence: Synthetic peptide
  XENP020691 vlCDR3
QQSREDPFT

SEQ ID NO: 25241 - protein, 450 aa, Artificial Sequence; identical to SEQ ID NO: 22261
  Description of Artificial Sequence: Synthetic polypeptide
  XENP020692 7G8_H0_L0.88_IgG1_PVA_/S267K Heavy Chain

SEQ ID NO: 25242 - protein, 121 aa, Artificial Sequence; identical to SEQ ID NO: 22262
  Description of Artificial Sequence: Synthetic polypeptide
  VH of XENP020692

SEQ ID NO: 25243 - protein, 5 aa, Artificial Sequence
  Description of Artificial Sequence: Synthetic peptide
  XENP020692 vhCDR1
DAWMD

SEQ ID NO: 25244 - protein, 19 aa, Artificial Sequence
  Description of Artificial Sequence: Synthetic peptide
  XENP020692 vhCDR2
EIRTKANNHATYYAESVKG

SEQ ID NO: 25245 - protein, 10 aa, Artificial Sequence
  Description of Artificial Sequence: Synthetic peptide
  XENP020692 vhCDR3
LANWDWYFDV

SEQ ID NO: 25246 - protein, 218 aa, Artificial Sequence
  Description of Artificial Sequence: Synthetic polypeptide
  XENP020692 7G8_H0_L0.88_IgG1_PVA_/S267K Light Chain
DTVLTQSPASLAVSLGQRATISCKASQSVDYDGDSYMNWYQQKPGQPPKLLIYAASNLESGIPARLSGSGSGTDFTLNIHPVEEEDAATYYCQQSLEDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 25247 - protein, 111 aa, Artificial Sequence
  Description of Artificial Sequence: Synthetic polypeptide
  VL of XENP020692
DTVLTQSPASLAVSLGQRATISCKASQSVDYDGDSYMNWYQQKPGQPPKLLIYAASNLESGIPARLSGSGSGTDFTLNIHPVEEEDAATYYCQQSLEDPFTFGSGTKLEVK

SEQ ID NO: 25248 - protein, 15 aa, Artificial Sequence
  Description of Artificial Sequence: Synthetic peptide
  XENP020692 vlCDR1
KASQSVDYDGDSYMN

SEQ ID NO: 25249 - protein, 7 aa, Artificial Sequence
  Description of Artificial Sequence: Synthetic peptide
  XENP020692 vlCDR2
AASNLES

SEQ ID NO: 25250 - protein, 9 aa, Artificial Sequence
  Description of Artificial Sequence: Synthetic peptide
  XENP020692 vlCDR3
QQSLEDPFT

SEQ ID NO: 25251 - protein, 450 aa, Artificial Sequence; identical to SEQ ID NO: 22261
  Description of Artificial Sequence: Synthetic polypeptide
  XENP020693 7G8_H0_L0.89_IgG1_PVA_/S267K Heavy Chain

SEQ ID NO: 25252 - protein, 121 aa, Artificial Sequence; identical to SEQ ID NO: 22262
  Description of Artificial Sequence: Synthetic polypeptide
  VH of XENP020693

SEQ ID NO: 25253 - protein, 5 aa, Artificial Sequence
  Description of Artificial Sequence: Synthetic peptide
  XENP020693 vhCDR1
DAWMD

SEQ ID NO: 25254 - protein, 19 aa, Artificial Sequence
  Description of Artificial Sequence: Synthetic peptide
  XENP020693 vhCDR2
EIRTKANNHATYYAESVKG

SEQ ID NO: 25255 - protein, 10 aa, Artificial Sequence
  Description of Artificial Sequence: Synthetic peptide
  XENP020693 vhCDR3
LANWDWYFDV

SEQ ID NO: 25256 - protein, 218 aa, Artificial Sequence
  Description of Artificial Sequence: Synthetic polypeptide
  XENP020693 7G8_H0_L0.89_IgG1_PVA_/S267K Light Chain
DTVLTQSPASLAVSLGQRATISCKASQSVDYDGDSYMNWYQQKPGQPPKLLIYAASNLESGIPARLSGSGSGTDFTLNIHPVEEEDAATYYCQQSTEDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 25257 - protein, 111 aa, Artificial Sequence
  Description of Artificial Sequence: Synthetic polypeptide
  VL of XENP020693
DTVLTQSPASLAVSLGQRATISCKASQSVDYDGDSYMNWYQQKPGQPPKLLIYAASNLESGIPARLSGSGSGTDFTLNIHPVEEEDAATYYCQQSTEDPFTFGSGTKLEVK

SEQ ID NO: 25258 - protein, 15 aa, Artificial Sequence
  Description of Artificial Sequence: Synthetic peptide
  XENP020693 vlCDR1
KASQSVDYDGDSYMN

SEQ ID NO: 25259 - protein, 7 aa, Artificial Sequence
  Description of Artificial Sequence: Synthetic peptide
  XENP020693 vlCDR2
AASNLES

SEQ ID NO: 25260 - protein, 9 aa, Artificial Sequence
  Description of Artificial Sequence: Synthetic peptide
  XENP020693 vlCDR3
QQSTEDPFT

SEQ ID NO: 25261 - protein, 450 aa, Artificial Sequence; identical to SEQ ID NO: 22261
  Description of Artificial Sequence: Synthetic polypeptide
  XENP020694 7G8_H0_L0.90_IgG1_PVA_/S267K Heavy Chain

SEQ ID NO: 25262 - protein, 121 aa, Artificial Sequence; identical to SEQ ID NO: 22262
  Description of Artificial Sequence: Synthetic polypeptide
  VH of XENP020694

SEQ ID NO: 25263 - protein, 5 aa, Artificial Sequence
  Description of Artificial Sequence: Synthetic peptide
  XENP020694 vhCDR1
DAWMD

SEQ ID NO: 25264 - protein, 19 aa, Artificial Sequence
  Description of Artificial Sequence: Synthetic peptide
  XENP020694 vhCDR2
EIRTKANNHATYYAESVKG

SEQ ID NO: 25265 - protein, 10 aa, Artificial Sequence
  Description of Artificial Sequence: Synthetic peptide
  XENP020694 vhCDR3
LANWDWYFDV

SEQ ID NO: 25266 - protein, 218 aa, Artificial Sequence
  Description of Artificial Sequence: Synthetic polypeptide
  XENP020694 7G8_H0_L0.90_IgG1_PVA_/S267K Light Chain
DTVLTQSPASLAVSLGQRATISCKASQSVDYDGDSYMNWYQQKPGQPPKLLIYAASNLESGIPARLSGSGSGTDFTLNIHPVEEEDAATYYCQQSGEDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 25267 - protein, 111 aa, Artificial Sequence
  Description of Artificial Sequence: Synthetic polypeptide
  VL of XENP020694
DTVLTQSPASLAVSLGQRATISCKASQSVDYDGDSYMNWYQQKPGQPPKLLIYAASNLESGIPARLSGSGSGTDFTLNIHPVEEEDAATYYCQQSGEDPFTFGSGTKLEVK

SEQ ID NO: 25268 - protein, 15 aa, Artificial Sequence
  Description of Artificial Sequence: Synthetic peptide
  XENP020694 vlCDR1
KASQSVDYDGDSYMN

SEQ ID NO: 25269 - protein, 7 aa, Artificial Sequence
  Description of Artificial Sequence: Synthetic peptide
  XENP020694 vlCDR2
AASNLES

SEQ ID NO: 25270 - protein, 9 aa, Artificial Sequence
  Description of Artificial Sequence: Synthetic peptide
  XENP020694 vlCDR3
QQSGEDPFT

SEQ ID NO: 25271 - protein, 450 aa, Artificial Sequence; identical to SEQ ID NO: 22261
  Description of Artificial Sequence: Synthetic polypeptide
  XENP020695 7G8_H0_L0.91_IgG1_PVA_/S267K Heavy Chain

SEQ ID NO: 25272 - protein, 121 aa, Artificial Sequence; identical to SEQ ID NO: 22262
  Description of Artificial Sequence: Synthetic polypeptide
  VH of XENP020695

SEQ ID NO: 25273 - protein, 5 aa, Artificial Sequence
  Description of Artificial Sequence: Synthetic peptide
  XENP020695 vhCDR1
DAWMD

SEQ ID NO: 25274 - protein, 19 aa, Artificial Sequence
  Description of Artificial Sequence: Synthetic peptide
  XENP020695 vhCDR2
EIRTKANNHATYYAESVKG

SEQ ID NO: 25275 - protein, 10 aa, Artificial Sequence
  Description of Artificial Sequence: Synthetic peptide
  XENP020695 vhCDR3
LANWDWYFDV

SEQ ID NO: 25276 - protein, 218 aa, Artificial Sequence
  Description of Artificial Sequence: Synthetic polypeptide
  XENP020695 7G8_H0_L0.91_IgG1_PVA_/S267K Light Chain
DTVLTQSPASLAVSLGQRATISCKASQSVDYDGDSYMNWYQQKPGQPPKLLIYAASNLESGIPARLSGSGSGTDFTLNIHPVEEEDAATYYCQQSYEDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 25277 - protein, 111 aa, Artificial Sequence
  Description of Artificial Sequence: Synthetic polypeptide
  VL of XENP020695
DTVLTQSPASLAVSLGQRATISCKASQSVDYDGDSYMNWYQQKPGQPPKLLIYAASNLESGIPARLSGSGSGTDFTLNIHPVEEEDAATYYCQQSYEDPFTFGSGTKLEVK

SEQ ID NO: 25278 - protein, 15 aa, Artificial Sequence
  Description of Artificial Sequence: Synthetic peptide
  XENP020695 vlCDR1
KASQSVDYDGDSYMN

SEQ ID NO: 25279 - protein, 7 aa, Artificial Sequence
  Description of Artificial Sequence: Synthetic peptide
  XENP020695 vlCDR2
AASNLES

SEQ ID NO: 25280 - protein, 9 aa, Artificial Sequence
  Description of Artificial Sequence: Synthetic peptide
  XENP020695 vlCDR3
QQSYEDPFT

SEQ ID NO: 25281 - protein, 450 aa, Artificial Sequence; identical to SEQ ID NO: 22261
  Description of Artificial Sequence: Synthetic polypeptide
  XENP020696 7G8_H0_L0.92_IgG1_PVA_/S267K Heavy Chain

SEQ ID NO: 25282 - protein, 121 aa, Artificial Sequence; identical to SEQ ID NO: 22262
  Description of Artificial Sequence: Synthetic polypeptide
  VH of XENP020696

SEQ ID NO: 25283 - protein, 5 aa, Artificial Sequence
  Description of Artificial Sequence: Synthetic peptide
  XENP020696 vhCDR1
DAWMD

SEQ ID NO: 25284 - protein, 19 aa, Artificial Sequence
  Description of Artificial Sequence: Synthetic peptide
  XENP020696 vhCDR2
EIRTKANNHATYYAESVKG

SEQ ID NO: 25285 - protein, 10 aa, Artificial Sequence
  Description of Artificial Sequence: Synthetic peptide
  XENP020696 vhCDR3
LANWDWYFDV

SEQ ID NO: 25286 - protein, 218 aa, Artificial Sequence
  Description of Artificial Sequence: Synthetic polypeptide
  XENP020696 7G8_H0_L0.92_IgG1_PVA_/S267K Light Chain
DTVLTQSPASLAVSLGQRATISCKASQSVDYDGDSYMNWYQQKPGQPPKLLIYAASNLESGIPARLSGSGSGTDFTLNIHPVEEEDAATYYCQQSNQDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 25287 - protein, 111 aa, Artificial Sequence
  Description of Artificial Sequence: Synthetic polypeptide
  VL of XENP020696
DTVLTQSPASLAVSLGQRATISCKASQSVDYDGDSYMNWYQQKPGQPPKLLIYAASNLESGIPARLSGSGSGTDFTLNIHPVEEEDAATYYCQQSNQDPFTFGSGTKLEVK

SEQ ID NO: 25288 - protein, 15 aa, Artificial Sequence
  Description of Artificial Sequence: Synthetic peptide
  XENP020696 vlCDR1
KASQSVDYDGDSYMN

SEQ ID NO: 25289 - protein, 7 aa, Artificial Sequence
  Description of Artificial Sequence: Synthetic peptide
  XENP020696 vlCDR2
AASNLES

SEQ ID NO: 25290 - protein, 9 aa, Artificial Sequence
  Description of Artificial Sequence: Synthetic peptide
  XENP020696 vlCDR3
QQSNQDPFT

SEQ ID NO: 25291 - protein, 450 aa, Artificial Sequence; identical to SEQ ID NO: 22261
  Description of Artificial Sequence: Synthetic polypeptide
  XENP020701 7G8_H0_L0.93_IgG1_PVA_/S267K Heavy Chain

SEQ ID NO: 25292 - protein, 121 aa, Artificial Sequence; identical to SEQ ID NO: 22262
  Description of Artificial Sequence: Synthetic polypeptide
  VH of XENP020701

SEQ ID NO: 25293 - protein, 5 aa, Artificial Sequence
  Description of Artificial Sequence: Synthetic peptide
  XENP020701 vhCDR1
DAWMD

SEQ ID NO: 25294 - protein, 19 aa, Artificial Sequence
  Description of Artificial Sequence: Synthetic peptide
  XENP020701 vhCDR2
EIRTKANNHATYYAESVKG

SEQ ID NO: 25295 - protein, 10 aa, Artificial Sequence
  Description of Artificial Sequence: Synthetic peptide
  XENP020701 vhCDR3
LANWDWYFDV

SEQ ID NO: 25296 - protein, 218 aa, Artificial Sequence
  Description of Artificial Sequence: Synthetic polypeptide
  XENP020701 7G8_H0_L0.93_IgG1_PVA_/S267K Light Chain
DTVLTQSPASLAVSLGQRATISCKASQSVDYDGDSYMNWYQQKPGQPPKLLIYAASNLESGIPARLSGSGSGTDFTLNIHPVEEEDAATYYCQQSNDDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 25297 - protein, 111 aa, Artificial Sequence
  Description of Artificial Sequence: Synthetic polypeptide
  VL of XENP020701
DTVLTQSPASLAVSLGQRATISCKASQSVDYDGDSYMNWYQQKPGQPPKLLIYAASNLESGIPARLSGSGSGTDFTLNIHPVEEEDAATYYCQQSNDDPFTFGSGTKLEVK

SEQ ID NO: 25298 - protein, 15 aa, Artificial Sequence
  Description of Artificial Sequence: Synthetic peptide
  XENP020701 vlCDR1
KASQSVDYDGDSYMN

SEQ ID NO: 25299 - protein, 7 aa, Artificial Sequence
  Description of Artificial Sequence: Synthetic peptide
  XENP020701 vlCDR2
AASNLES

SEQ ID NO: 25300 - protein, 9 aa, Artificial Sequence
  Description of Artificial Sequence: Synthetic peptide
  XENP020701 vlCDR3
QQSNDDPFT

SEQ ID NO: 25301 - protein, 450 aa, Artificial Sequence; identical to SEQ ID NO: 22261
  Description of Artificial Sequence: Synthetic polypeptide
  XENP020702 7G8_H0_L0.94_IgG1_PVA_/S267K Heavy Chain

SEQ ID NO: 25302 - protein, 121 aa, Artificial Sequence; identical to SEQ ID NO: 22262
  Description of Artificial Sequence: Synthetic polypeptide
  VH of XENP020702

SEQ ID NO: 25303 - protein, 5 aa, Artificial Sequence
  Description of Artificial Sequence: Synthetic peptide
  XENP020702 vhCDR1
DAWMD

SEQ ID NO: 25304 - protein, 19 aa, Artificial Sequence
  Description of Artificial Sequence: Synthetic peptide
  XENP020702 vhCDR2
EIRTKANNHATYYAESVKG

SEQ ID NO: 25305 - protein, 10 aa, Artificial Sequence
  Description of Artificial Sequence: Synthetic peptide
  XENP020702 vhCDR3
LANWDWYFDV

SEQ ID NO: 25306 - protein, 218 aa, Artificial Sequence
  Description of Artificial Sequence: Synthetic polypeptide
  XENP020702 7G8_H0_L0.94_IgG1_PVA_/S267K Light Chain
DTVLTQSPASLAVSLGQRATISCKASQSVDYDGDSYMNWYQQKPGQPPKLLIYAASNLESGIPARLSGSGSGTDFTLNIHPVEEEDAATYYCQQSNKDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 25307 - protein, 111 aa, Artificial Sequence
  Description of Artificial Sequence: Synthetic polypeptide
  VL of XENP020702
DTVLTQSPASLAVSLGQRATISCKASQSVDYDGDSYMNWYQQKPGQPPKLLIYAASNLESGIPARLSGSGSGTDFTLNIHPVEEEDAATYYCQQSNKDPFTFGSGTKLEVK

SEQ ID NO: 25308 - protein, 15 aa, Artificial Sequence
  Description of Artificial Sequence: Synthetic peptide
  XENP020702 vlCDR1
KASQSVDYDGDSYMN

SEQ ID NO: 25309 - protein, 7 aa, Artificial Sequence
  Description of Artificial Sequence: Synthetic peptide
  XENP020702 vlCDR2
AASNLES

SEQ ID NO: 25310 - protein, 9 aa, Artificial Sequence
  Description of Artificial Sequence: Synthetic peptide
  XENP020702 vlCDR3
QQSNKDPFT

SEQ ID NO: 25311 - protein, 450 aa, Artificial Sequence; identical to SEQ ID NO: 22261
  Description of Artificial Sequence: Synthetic polypeptide
  XENP020703 7G8_H0_L0.95_IgG1_PVA_/S267K Heavy Chain

SEQ ID NO: 25312 - protein, 121 aa, Artificial Sequence; identical to SEQ ID NO: 22262
  Description of Artificial Sequence: Synthetic polypeptide
  VH of XENP020703

SEQ ID NO: 25313 - protein, 5 aa, Artificial Sequence
  Description of Artificial Sequence: Synthetic peptide
  XENP020703 vhCDR1
DAWMD

SEQ ID NO: 25314 - protein, 19 aa, Artificial Sequence
  Description of Artificial Sequence: Synthetic peptide
  XENP020703 vhCDR2
EIRTKANNHATYYAESVKG

SEQ ID NO: 25315 - protein, 10 aa, Artificial Sequence
  Description of Artificial Sequence: Synthetic peptide
  XENP020703 vhCDR3
LANWDWYFDV

SEQ ID NO: 25316 - protein, 218 aa, Artificial Sequence
  Description of Artificial Sequence: Synthetic polypeptide
  XENP020703 7G8_H0_L0.95_IgG1_PVA_/S267K Light Chain
DTVLTQSPASLAVSLGQRATISCKASQSVDYDGDSYMNWYQQKPGQPPKLLIYAASNLESGIPARLSGSGSGTDFTLNIHPVEEEDAATYYCQQSNSDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 25317 - protein, 111 aa, Artificial Sequence
  Description of Artificial Sequence: Synthetic polypeptide
  VL of XENP020703
DTVLTQSPASLAVSLGQRATISCKASQSVDYDGDSYMNWYQQKPGQPPKLLIYAASNLESGIPARLSGSGSGTDFTLNIHPVEEEDAATYYCQQSNSDPFTFGSGTKLEVK

SEQ ID NO: 25318 - protein, 15 aa, Artificial Sequence
  Description of Artificial Sequence: Synthetic peptide
  XENP020703 vlCDR1
KASQSVDYDGDSYMN

SEQ ID NO: 25319 - protein, 7 aa, Artificial Sequence
  Description of Artificial Sequence: Synthetic peptide
  XENP020703 vlCDR2
AASNLES

SEQ ID NO: 25320 - protein, 9 aa, Artificial Sequence
  Description of Artificial Sequence: Synthetic peptide
  XENP020703 vlCDR3
QQSNSDPFT

SEQ ID NO: 25321 - protein, 450 aa, Artificial Sequence; identical to SEQ ID NO: 22261
  Description of Artificial Sequence: Synthetic polypeptide
  XENP020704 7G8_H0_L0.96_IgG1_PVA_/S267K Heavy Chain

SEQ ID NO: 25322 - protein, 121 aa, Artificial Sequence; identical to SEQ ID NO: 22262
  Description of Artificial Sequence: Synthetic polypeptide
  VH of XENP020704

SEQ ID NO: 25323 - protein, 5 aa, Artificial Sequence
  Description of Artificial Sequence: Synthetic peptide
  XENP020704 vhCDR1
DAWMD

SEQ ID NO: 25324 - protein, 19 aa, Artificial Sequence
  Description of Artificial Sequence: Synthetic peptide
  XENP020704 vhCDR2
EIRTKANNHATYYAESVKG

SEQ ID NO: 25325 - protein, 10 aa, Artificial Sequence
  Description of Artificial Sequence: Synthetic peptide
  XENP020704 vhCDR3
LANWDWYFDV

SEQ ID NO: 25326 - protein, 218 aa, Artificial Sequence
  Description of Artificial Sequence: Synthetic polypeptide
  XENP020704 7G8_H0_L0.96_IgG1_PVA_/S267K Light Chain
DTVLTQSPASLAVSLGQRATISCKASQSVDYDGDSYMNWYQQKPGQPPKLLIYAASNLESGIPARLSGSGSGTDFTLNIHPVEEEDAATYYCQQSNHDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 25327 - protein, 111 aa, Artificial Sequence
  Description of Artificial Sequence: Synthetic polypeptide
  VL of XENP020704
DTVLTQSPASLAVSLGQRATISCKASQSVDYDGDSYMNWYQQKPGQPPKLLIYAASNLESGIPARLSGSGSGTDFTLNIHPVEEEDAATYYCQQSNHDPFTFGSGTKLEVK

SEQ ID NO: 25328 - protein, 15 aa, Artificial Sequence
  Description of Artificial Sequence: Synthetic peptide
  XENP020704 vlCDR1
KASQSVDYDGDSYMN

SEQ ID NO: 25329 - protein, 7 aa, Artificial Sequence
  Description of Artificial Sequence: Synthetic peptide
  XENP020704 vlCDR2
AASNLES

SEQ ID NO: 25330 - protein, 9 aa, Artificial Sequence
  Description of Artificial Sequence: Synthetic peptide
  XENP020704 vlCDR3
QQSNHDPFT

SEQ ID NO: 25331 - protein, 450 aa, Artificial Sequence; identical to SEQ ID NO: 22261
  Description of Artificial Sequence: Synthetic polypeptide
  XENP020705 7G8_H0_L0.97_IgG1_PVA_/S267K Heavy Chain

SEQ ID NO: 25332 - protein, 121 aa, Artificial Sequence; identical to SEQ ID NO: 22262
  Description of Artificial Sequence: Synthetic polypeptide
  VH of XENP020705

SEQ ID NO: 25333 - protein, 5 aa, Artificial Sequence
  Description of Artificial Sequence: Synthetic peptide
  XENP020705 vhCDR1
DAWMD

SEQ ID NO: 25334 - protein, 19 aa, Artificial Sequence
  Description of Artificial Sequence: Synthetic peptide
  XENP020705 vhCDR2
EIRTKANNHATYYAESVKG

SEQ ID NO: 25335 - protein, 10 aa, Artificial Sequence
  Description of Artificial Sequence: Synthetic peptide
  XENP020705 vhCDR3
LANWDWYFDV

SEQ ID NO: 25336 - protein, 218 aa, Artificial Sequence
  Description of Artificial Sequence: Synthetic polypeptide
  XENP020705 7G8_H0_L0.97_IgG1_PVA_/S267K Light Chain
DTVLTQSPASLAVSLGQRATISCKASQSVDYDGDSYMNWYQQKPGQPPKLLIYAASNLESGIPARLSGSGSGTDFTLNIHPVEEEDAATYYCQQSNADPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 25337 - protein, 111 aa, Artificial Sequence
  Description of Artificial Sequence: Synthetic polypeptide
  VL of XENP020705
DTVLTQSPASLAVSLGQRATISCKASQSVDYDGDSYMNWYQQKPGQPPKLLIYAASNLESGIPARLSGSGSGTDFTLNIHPVEEEDAATYYCQQSNADPFTFGSGTKLEVK

SEQ ID NO: 25338 - protein, 15 aa, Artificial Sequence
  Description of Artificial Sequence: Synthetic peptide
  XENP020705 vlCDR1
KASQSVDYDGDSYMN

SEQ ID NO: 25339 - protein, 7 aa, Artificial Sequence
  Description of Artificial Sequence: Synthetic peptide
  XENP020705 vlCDR2
AASNLES

SEQ ID NO: 25340 - protein, 9 aa, Artificial Sequence
  Description of Artificial Sequence: Synthetic peptide
  XENP020705 vlCDR3
QQSNADPFT

SEQ ID NO: 25341 - protein, 450 aa, Artificial Sequence; identical to SEQ ID NO: 22261
  Description of Artificial Sequence: Synthetic polypeptide
  XENP020706 7G8_H0_L0.98_IgG1_PVA_/S267K Heavy Chain

SEQ ID NO: 25342 - protein, 121 aa, Artificial Sequence; identical to SEQ ID NO: 22262
  Description of Artificial Sequence: Synthetic polypeptide
  VH of XENP020706

SEQ ID NO: 25343 - protein, 5 aa, Artificial Sequence
  Description of Artificial Sequence: Synthetic peptide
  XENP020706 vhCDR1
DAWMD

SEQ ID NO: 25344 - protein, 19 aa, Artificial Sequence
  Description of Artificial Sequence: Synthetic peptide
  XENP020706 vhCDR2
EIRTKANNHATYYAESVKG

SEQ ID NO: 25345 - protein, 10 aa, Artificial Sequence
  Description of Artificial Sequence: Synthetic peptide
  XENP020706 vhCDR3
LANWDWYFDV

SEQ ID NO: 25346 - protein, 218 aa, Artificial Sequence
  Description of Artificial Sequence: Synthetic polypeptide
  XENP020706 7G8_H0_L0.98_IgG1_PVA_/S267K Light Chain
DTVLTQSPASLAVSLGQRATISCKASQSVDYDGDSYMNWYQQKPGQPPKLLIYAASNLESGIPARLSGSGSGTDFTLNIHPVEEEDAATYYCQQSNGDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 25347 - protein, 111 aa, Artificial Sequence
  Description of Artificial Sequence: Synthetic polypeptide
  VL of XENP020706
DTVLTQSPASLAVSLGQRATISCKASQSVDYDGDSYMNWYQQKPGQPPKLLIYAASNLESGIPARLSGSGSGTDFTLNIHPVEEEDAATYYCQQSNGDPFTFGSGTKLEVK

SEQ ID NO: 25348 - protein, 15 aa, Artificial Sequence
  Description of Artificial Sequence: Synthetic peptide
  XENP020706 vlCDR1
KASQSVDYDGDSYMN

SEQ ID NO: 25349 - protein, 7 aa, Artificial Sequence
  Description of Artificial Sequence: Synthetic peptide
  XENP020706 vlCDR2
AASNLES

SEQ ID NO: 25350 - protein, 9 aa, Artificial Sequence
  Description of Artificial Sequence: Synthetic peptide
  XENP020706 vlCDR3
QQSNGDPFT

SEQ ID NO: 25351 - protein, 450 aa, Artificial Sequence; identical to SEQ ID NO: 22261
  Description of Artificial Sequence: Synthetic polypeptide
  XENP020707 7G8_H0_L0.99_IgG1_PVA_/S267K Heavy Chain

SEQ ID NO: 25352 - protein, 121 aa, Artificial Sequence; identical to SEQ ID NO: 22262
  Description of Artificial Sequence: Synthetic polypeptide
  VH of XENP020707

SEQ ID NO: 25353 - protein, 5 aa, Artificial Sequence
  Description of Artificial Sequence: Synthetic peptide
  XENP020707 vhCDR1
DAWMD

SEQ ID NO: 25354 - protein, 19 aa, Artificial Sequence
  Description of Artificial Sequence: Synthetic peptide
  XENP020707 vhCDR2
EIRTKANNHATYYAESVKG

SEQ ID NO: 25355 - protein, 10 aa, Artificial Sequence
  Description of Artificial Sequence: Synthetic peptide
  XENP020707 vhCDR3
LANWDWYFDV

SEQ ID NO: 25356 - protein, 218 aa, Artificial Sequence
  Description of Artificial Sequence: Synthetic polypeptide
  XENP020707 7G8_H0_L0.99_IgG1_PVA_/S267K Light Chain
DTVLTQSPASLAVSLGQRATISCKASQSVDYDGDSYMNWYQQKPGQPPKLLIYAASNLESGIPARLSGSGSGTDFTLNIHPVEEEDAATYYCQQSNYDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 25357 - protein, 111 aa, Artificial Sequence
  Description of Artificial Sequence: Synthetic polypeptide
  VL of XENP020707
DTVLTQSPASLAVSLGQRATISCKASQSVDYDGDSYMNWYQQKPGQPPKLLIYAASNLESGIPARLSGSGSGTDFTLNIHPVEEEDAATYYCQQSNYDPFTFGSGTKLEVK

SEQ ID NO: 25358 - protein, 15 aa, Artificial Sequence
  Description of Artificial Sequence: Synthetic peptide
  XENP020707 vlCDR1
KASQSVDYDGDSYMN

SEQ ID NO: 25359 - protein, 7 aa, Artificial Sequence
  Description of Artificial Sequence: Synthetic peptide
  XENP020707 vlCDR2
AASNLES

SEQ ID NO: 25360 - protein, 9 aa, Artificial Sequence
  Description of Artificial Sequence: Synthetic peptide
  XENP020707 vlCDR3
QQSNYDPFT

SEQ ID NO: 25361 - protein, 450 aa, Artificial Sequence; identical to SEQ ID NO: 22261
  Description of Artificial Sequence: Synthetic polypeptide
  XENP020708 7G8_H0_L0.100_IgG1_PVA_/S267K Heavy Chain

SEQ ID NO: 25362 - protein, 121 aa, Artificial Sequence; identical to SEQ ID NO: 22262
  Description of Artificial Sequence: Synthetic polypeptide
  VH of XENP020708

SEQ ID NO: 25363 - protein, 5 aa, Artificial Sequence
  Description of Artificial Sequence: Synthetic peptide
  XENP020708 vhCDR1
DAWMD

SEQ ID NO: 25364 - protein, 19 aa, Artificial Sequence
  Description of Artificial Sequence: Synthetic peptide
  XENP020708 vhCDR2
EIRTKANNHATYYAESVKG

SEQ ID NO: 25365 - protein, 10 aa, Artificial Sequence
  Description of Artificial Sequence: Synthetic peptide
  XENP020708 vhCDR3
LANWDWYFDV

SEQ ID NO: 25366 - protein, 218 aa, Artificial Sequence
  Description of Artificial Sequence: Synthetic polypeptide
  XENP020708 7G8_H0_L0.100_IgG1_PVA_/S267K Light Chain
DTVLTQSPASLAVSLGQRATISCKASQSVDYDGDSYMNWYQQKPGQPPKLLIYAASNLESGIPARLSGSGSGTDFTLNIHPVEEEDAATYYCQQSNIDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 25367 - protein, 111 aa, Artificial Sequence
  Description of Artificial Sequence: Synthetic polypeptide
  VL of XENP020708
DTVLTQSPASLAVSLGQRATISCKASQSVDYDGDSYMNWYQQKPGQPPKLLIYAASNLESGIPARLSGSGSGTDFTLNIHPVEEEDAATYYCQQSNIDPFTFGSGTKLEVK

SEQ ID NO: 25368 - protein, 15 aa, Artificial Sequence
  Description of Artificial Sequence: Synthetic peptide
  XENP020708 vlCDR1
KASQSVDYDGDSYMN

SEQ ID NO: 25369 - protein, 7 aa, Artificial Sequence
  Description of Artificial Sequence: Synthetic peptide
  XENP020708 vlCDR2
AASNLES

SEQ ID NO: 25370 - protein, 9 aa, Artificial Sequence
  Description of Artificial Sequence: Synthetic peptide
  XENP020708 vlCDR3
QQSNIDPFT

SEQ ID NO: 25371 - protein, 450 aa, Artificial Sequence; identical to SEQ ID NO: 22261
  Description of Artificial Sequence: Synthetic polypeptide
  XENP020709 7G8_H0_L0.101_IgG1_PVA_/S267K Heavy Chain

SEQ ID NO: 25372 - protein, 121 aa, Artificial Sequence; identical to SEQ ID NO: 22262
  Description of Artificial Sequence: Synthetic polypeptide
  VH of XENP020709

SEQ ID NO: 25373 - protein, 5 aa, Artificial Sequence
  Description of Artificial Sequence: Synthetic peptide
  XENP020709 vhCDR1
DAWMD

SEQ ID NO: 25374 - protein, 19 aa, Artificial Sequence
  Description of Artificial Sequence: Synthetic peptide
  XENP020709 vhCDR2
EIRTKANNHATYYAESVKG

SEQ ID NO: 25375 - protein, 10 aa, Artificial Sequence
  Description of Artificial Sequence: Synthetic peptide
  XENP020709 vhCDR3
LANWDWYFDV

SEQ ID NO: 25376 - protein, 218 aa, Artificial Sequence
  Description of Artificial Sequence: Synthetic polypeptide
  XENP020709 7G8_H0_L0.101_IgG1_PVA_/S267K Light Chain
DTVLTQSPASLAVSLGQRATISCKASQSVDYDGDSYMNWYQQKPGQPPKLLIYAASNLESGIPARLSGSGSGTDFTLNIHPVEEEDAATYYCQQSNENPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 25377 - protein, 111 aa, Artificial Sequence
  Description of Artificial Sequence: Synthetic polypeptide
  VL of XENP020709
DTVLTQSPASLAVSLGQRATISCKASQSVDYDGDSYMNWYQQKPGQPPKLLIYAASNLESGIPARLSGSGSGTDFTLNIHPVEEEDAATYYCQQSNENPFTFGSGTKLEVK

SEQ ID NO: 25378 - protein, 15 aa, Artificial Sequence
  Description of Artificial Sequence: Synthetic peptide
  XENP020709 vlCDR1
KASQSVDYDGDSYMN

SEQ ID NO: 25379 - protein, 7 aa, Artificial Sequence
  Description of Artificial Sequence: Synthetic peptide
  XENP020709 vlCDR2
AASNLES

SEQ ID NO: 25380 - protein, 9 aa, Artificial Sequence
  Description of Artificial Sequence: Synthetic peptide
  XENP020709 vlCDR3
QQSNENPFT

SEQ ID NO: 25381 - protein, 450 aa, Artificial Sequence; identical to SEQ ID NO: 22261
  Description of Artificial Sequence: Synthetic polypeptide
  XENP020710 7G8_H0_L0.102_IgG1_PVA_/S267K Heavy Chain

SEQ ID NO: 25382 - protein, 121 aa, Artificial Sequence; identical to SEQ ID NO: 22262
  Description of Artificial Sequence: Synthetic polypeptide
  VH of XENP020710

SEQ ID NO: 25383 - protein, 5 aa, Artificial Sequence
  Description of Artificial Sequence: Synthetic peptide
  XENP020710 vhCDR1
DAWMD

SEQ ID NO: 25384 - protein, 19 aa, Artificial Sequence
  Description of Artificial Sequence: Synthetic peptide
  XENP020710 vhCDR2
EIRTKANNHATYYAESVKG

SEQ ID NO: 25385 - protein, 10 aa, Artificial Sequence
  Description of Artificial Sequence: Synthetic peptide
  XENP020710 vhCDR3
LANWDWYFDV

SEQ ID NO: 25386 - protein, 218 aa, Artificial Sequence
  Description of Artificial Sequence: Synthetic polypeptide
  XENP020710 7G8_H0_L0.102_IgG1_PVA_/S267K Light Chain
DTVLTQSPASLAVSLGQRATISCKASQSVDYDGDSYMNWYQQKPGQPPKLLIYAASNLESGIPARLSGSGSGTDFTLNIHPVEEEDAATYYCQQSNEEPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 25387 - protein, 111 aa, Artificial Sequence
  Description of Artificial Sequence: Synthetic polypeptide
  VL of XENP020710
DTVLTQSPASLAVSLGQRATISCKASQSVDYDGDSYMNWYQQKPGQPPKLLIYAASNLESGIPARLSGSGSGTDFTLNIHPVEEEDAATYYCQQSNEEPFTFGSGTKLEVK

SEQ ID NO: 25388 - protein, 15 aa, Artificial Sequence
  Description of Artificial Sequence: Synthetic peptide
  XENP020710 vlCDR1
KASQSVDYDGDSYMN

SEQ ID NO: 25389 - protein, 7 aa, Artificial Sequence
  Description of Artificial Sequence: Synthetic peptide
  XENP020710 vlCDR2
AASNLES

SEQ ID NO: 25390 - protein, 9 aa, Artificial Sequence
  Description of Artificial Sequence: Synthetic peptide
  XENP020710 vlCDR3
QQSNEEPFT

SEQ ID NO: 25391 - protein, 450 aa, Artificial Sequence; identical to SEQ ID NO: 22261
  Description of Artificial Sequence: Synthetic polypeptide
  XENP020711 7G8_H0_L0.103_IgG1_PVA_/S267K Heavy Chain

SEQ ID NO: 25392 - protein, 121 aa, Artificial Sequence; identical to SEQ ID NO: 22262
  Description of Artificial Sequence: Synthetic polypeptide
  VH of XENP020711

SEQ ID NO: 25393 - protein, 5 aa, Artificial Sequence
  Description of Artificial Sequence: Synthetic peptide
  XENP020711 vhCDR1
DAWMD

SEQ ID NO: 25394 - protein, 19 aa, Artificial Sequence
  Description of Artificial Sequence: Synthetic peptide
  XENP020711 vhCDR2
EIRTKANNHATYYAESVKG

SEQ ID NO: 25395 - protein, 10 aa, Artificial Sequence
  Description of Artificial Sequence: Synthetic peptide
  XENP020711 vhCDR3
LANWDWYFDV

SEQ ID NO: 25396 - protein, 218 aa, Artificial Sequence
  Description of Artificial Sequence: Synthetic polypeptide
  XENP020711 7G8_H0_L0.103_IgG1_PVA_/S267K Light Chain
DTVLTQSPASLAVSLGQRATISCKASQSVDYDGDSYMNWYQQKPGQPPKLLIYAASNLESGIPARLSGSGSGTDFTLNIHPVEEEDAATYYCQQSNEHPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 25397 - protein, 111 aa, Artificial Sequence
  Description of Artificial Sequence: Synthetic polypeptide
  VL of XENP020711
DTVLTQSPASLAVSLGQRATISCKASQSVDYDGDSYMNWYQQKPGQPPKLLIYAASNLESGIPARLSGSGSGTDFTLNIHPVEEEDAATYYCQQSNEHPFTFGSGTKLEVK

SEQ ID NO: 25398 - protein, 15 aa, Artificial Sequence
  Description of Artificial Sequence: Synthetic peptide
  XENP020711 vlCDR1
KASQSVDYDGDSYMN

SEQ ID NO: 25399 - protein, 7 aa, Artificial Sequence
  Description of Artificial Sequence: Synthetic peptide
  XENP020711 vlCDR2
AASNLES

SEQ ID NO: 25400 - protein, 9 aa, Artificial Sequence
  Description of Artificial Sequence: Synthetic peptide
  XENP020711 vlCDR3
QQSNEHPFT

SEQ ID NO: 25401 - protein, 450 aa, Artificial Sequence; identical to SEQ ID NO: 22261
  Description of Artificial Sequence: Synthetic polypeptide
  XENP020712 7G8_H0_L0.104_IgG1_PVA_/S267K Heavy Chain

SEQ ID NO: 25402 - protein, 121 aa, Artificial Sequence; identical to SEQ ID NO: 22262
  Description of Artificial Sequence: Synthetic polypeptide
  VH of XENP020712

SEQ ID NO: 25403 - protein, 5 aa, Artificial Sequence
  Description of Artificial Sequence: Synthetic peptide
  XENP020712 vhCDR1
DAWMD

SEQ ID NO: 25404 - protein, 19 aa, Artificial Sequence
  Description of Artificial Sequence: Synthetic peptide
  XENP020712 vhCDR2
EIRTKANNHATYYAESVKG

SEQ ID NO: 25405 - protein, 10 aa, Artificial Sequence
  Description of Artificial Sequence: Synthetic peptide
  XENP020712 vhCDR3
LANWDWYFDV

SEQ ID NO: 25406 - protein, 218 aa, Artificial Sequence
  Description of Artificial Sequence: Synthetic polypeptide
  XENP020712 7G8_H0_L0.104_IgG1_PVA_/S267K Light Chain
DTVLTQSPASLAVSLGQRATISCKASQSVDYDGDSYMNWYQQKPGQPPKLLIYAASNLESGIPARLSGSGSGTDFTLNIHPVEEEDAATYYCQQSNERPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 25407 - protein, 111 aa, Artificial Sequence
  Description of Artificial Sequence: Synthetic polypeptide
  VL of XENP020712
DTVLTQSPASLAVSLGQRATISCKASQSVDYDGDSYMNWYQQKPGQPPKLLIYAASNLESGIPARLSGSGSGTDFTLNIHPVEEEDAATYYCQQSNERPFTFGSGTKLEVK

SEQ ID NO: 25408 - protein, 15 aa, Artificial Sequence
  Description of Artificial Sequence: Synthetic peptide
  XENP020712 vlCDR1
KASQSVDYDGDSYMN

SEQ ID NO: 25409 - protein, 7 aa, Artificial Sequence
  Description of Artificial Sequence: Synthetic peptide
  XENP020712 vlCDR2
AASNLES

SEQ ID NO: 25410 - protein, 9 aa, Artificial Sequence
  Description of Artificial Sequence: Synthetic peptide
  XENP020712 vlCDR3
QQSNERPFT

SEQ ID NO: 25411 - protein, 450 aa, Artificial Sequence; identical to SEQ ID NO: 22261
  Description of Artificial Sequence: Synthetic polypeptide
  XENP020713 7G8_H0_L0.105_IgG1_PVA_/S267K Heavy Chain

SEQ ID NO: 25412 - protein, 121 aa, Artificial Sequence; identical to SEQ ID NO: 22262
  Description of Artificial Sequence: Synthetic polypeptide
  VH of XENP020713

SEQ ID NO: 25413 - protein, 5 aa, Artificial Sequence
  Description of Artificial Sequence: Synthetic peptide
  XENP020713 vhCDR1
DAWMD

SEQ ID NO: 25414 - protein, 19 aa, Artificial Sequence
  Description of Artificial Sequence: Synthetic peptide
  XENP020713 vhCDR2
EIRTKANNHATYYAESVKG

SEQ ID NO: 25415 - protein, 10 aa, Artificial Sequence
  Description of Artificial Sequence: Synthetic peptide
  XENP020713 vhCDR3
LANWDWYFDV

SEQ ID NO: 25416 - protein, 218 aa, Artificial Sequence
  Description of Artificial Sequence: Synthetic polypeptide
  XENP020713 7G8_H0_L0.105_IgG1_PVA_/S267K Light Chain
DTVLTQSPASLAVSLGQRATISCKASQSVDYDGDSYMNWYQQKPGQPPKLLIYAASNLESGIPARLSGSGSGTDFTLNIHPVEEEDAATYYCQQSNELPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 25417 - protein, 111 aa, Artificial Sequence
  Description of Artificial Sequence: Synthetic polypeptide
  VL of XENP020713
DTVLTQSPASLAVSLGQRATISCKASQSVDYDGDSYMNWYQQKPGQPPKLLIYAASNLESGIPARLSGSGSGTDFTLNIHPVEEEDAATYYCQQSNELPFTFGSGTKLEVK

SEQ ID NO: 25418 - protein, 15 aa, Artificial Sequence
  Description of Artificial Sequence: Synthetic peptide
  XENP020713 vlCDR1
KASQSVDYDGDSYMN

SEQ ID NO: 25419 - protein, 7 aa, Artificial Sequence
  Description of Artificial Sequence: Synthetic peptide
  XENP020713 vlCDR2
AASNLES

SEQ ID NO: 25420 - protein, 9 aa, Artificial Sequence
  Description of Artificial Sequence: Synthetic peptide
  XENP020713 vlCDR3
QQSNELPFT

SEQ ID NO: 25421 - protein, 450 aa, Artificial Sequence; identical to SEQ ID NO: 22261
  Description of Artificial Sequence: Synthetic polypeptide
  XENP020714 7G8_H0_L0.106_IgG1_PVA_/S267K Heavy Chain

SEQ ID NO: 25422 - protein, 121 aa, Artificial Sequence; identical to SEQ ID NO: 22262
  Description of Artificial Sequence: Synthetic polypeptide
  VH of XENP020714

SEQ ID NO: 25423 - protein, 5 aa, Artificial Sequence
  Description of Artificial Sequence: Synthetic peptide
  XENP020714 vhCDR1
DAWMD

SEQ ID NO: 25424 - protein, 19 aa, Artificial Sequence
  Description of Artificial Sequence: Synthetic peptide
  XENP020714 vhCDR2
EIRTKANNHATYYAESVKG

SEQ ID NO: 25425 - protein, 10 aa, Artificial Sequence
  Description of Artificial Sequence: Synthetic peptide
  XENP020714 vhCDR3
LANWDWYFDV

SEQ ID NO: 25426 - protein, 218 aa, Artificial Sequence
  Description of Artificial Sequence: Synthetic polypeptide
  XENP020714 7G8_H0_L0.106_IgG1_PVA_/S267K Light Chain
DTVLTQSPASLAVSLGQRATISCKASQSVDYDGDSYMNWYQQKPGQPPKLLIYAASNLESGIPARLSGSGSGTDFTLNIHPVEEEDAATYYCQQSNEGPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 25427 - protein, 111 aa, Artificial Sequence
  Description of Artificial Sequence: Synthetic polypeptide
  VL of XENP020714
DTVLTQSPASLAVSLGQRATISCKASQSVDYDGDSYMNWYQQKPGQPPKLLIYAASNLESGIPARLSGSGSGTDFTLNIHPVEEEDAATYYCQQSNEGPFTFGSGTKLEVK

SEQ ID NO: 25428 - protein, 15 aa, Artificial Sequence
  Description of Artificial Sequence: Synthetic peptide
  XENP020714 vlCDR1
KASQSVDYDGDSYMN

SEQ ID NO: 25429 - protein, 7 aa, Artificial Sequence
  Description of Artificial Sequence: Synthetic peptide
  XENP020714 vlCDR2
AASNLES

SEQ ID NO: 25430 - protein, 9 aa, Artificial Sequence
  Description of Artificial Sequence: Synthetic peptide
  XENP020714 vlCDR3
QQSNEGPFT

SEQ ID NO: 25431 - protein, 450 aa, Artificial Sequence; identical to SEQ ID NO: 22261
  Description of Artificial Sequence: Synthetic polypeptide
  XENP020715 7G8_H0_L0.107_IgG1_PVA_/S267K Heavy Chain

SEQ ID NO: 25432 - protein, 121 aa, Artificial Sequence; identical to SEQ ID NO: 22262
  Description of Artificial Sequence: Synthetic polypeptide
  VH of XENP020715

SEQ ID NO: 25433 - protein, 5 aa, Artificial Sequence
  Description of Artificial Sequence: Synthetic peptide
  XENP020715 vhCDR1
DAWMD

SEQ ID NO: 25434 - protein, 19 aa, Artificial Sequence
  Description of Artificial Sequence: Synthetic peptide
  XENP020715 vhCDR2
EIRTKANNHATYYAESVKG

SEQ ID NO: 25435 - protein, 10 aa, Artificial Sequence
  Description of Artificial Sequence: Synthetic peptide
  XENP020715 vhCDR3
LANWDWYFDV

SEQ ID NO: 25436 - protein, 218 aa, Artificial Sequence
  Description of Artificial Sequence: Synthetic polypeptide
  XENP020715 7G8_H0_L0.107_IgG1_PVA_/S267K Light Chain
DTVLTQSPASLAVSLGQRATISCKASQSVDYDGDSYMNWYQQKPGQPPKLLIYAASNLESGIPARLSGSGSGTDFTLNIHPVEEEDAATYYCQQSNEYPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 25437 - protein, 111 aa, Artificial Sequence
  Description of Artificial Sequence: Synthetic polypeptide
  VL of XENP020715
DTVLTQSPASLAVSLGQRATISCKASQSVDYDGDSYMNWYQQKPGQPPKLLIYAASNLESGIPARLSGSGSGTDFTLNIHPVEEEDAATYYCQQSNEYPFTFGSGTKLEVK

SEQ ID NO: 25438 - protein, 15 aa, Artificial Sequence
  Description of Artificial Sequence: Synthetic peptide
  XENP020715 vlCDR1
KASQSVDYDGDSYMN

SEQ ID NO: 25439 - protein, 7 aa, Artificial Sequence
  Description of Artificial Sequence: Synthetic peptide
  XENP020715 vlCDR2
AASNLES

SEQ ID NO: 25440 - protein, 9 aa, Artificial Sequence
  Description of Artificial Sequence: Synthetic peptide
  XENP020715 vlCDR3
QQSNEYPFT

SEQ ID NO: 25441 - protein, 446 aa, Artificial Sequence
  Description of Artificial Sequence: Synthetic polypeptide
  XENP016275 mAb8213_H0L0_IgG1_PVA_/S267K Heavy Chain
QVQLVQSGAEVKKPGASVKVSCKASGYTFTSYWMHWVRQAPGQGLEWMGEINPSNGRTNYNEKFKTRVTITADTSTSTAYMELSSLRSEDTAVYYCARGYYLYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 25442 - protein, 117 aa, Artificial Sequence; identical to SEQ ID NO: 4641
  Description of Artificial Sequence: Synthetic polypeptide
  VH of XENP016275

SEQ ID NO: 25443 - protein, 5 aa, Artificial Sequence
  Description of Artificial Sequence: Synthetic peptide
  XENP016275 vhCDR1
SYWMH

SEQ ID NO: 25444 - protein, 17 aa, Artificial Sequence
  Description of Artificial Sequence: Synthetic peptide
  XENP016275 vhCDR2
EINPSNGRTNYNEKFKT

SEQ ID NO: 25445 - protein, 8 aa, Artificial Sequence
  Description of Artificial Sequence: Synthetic peptide
  XENP016275 vhCDR3
GYYLYFDY

SEQ ID NO: 25446 - protein, 214 aa, Artificial Sequence
  Description of Artificial Sequence: Synthetic polypeptide
  XENP016275 mAb8213_H0L0_IgG1_PVA_/S267K Light Chain
DIQMTQSPSSLSASVGDRVTITCHASQGIRINIGWYQQKPGKAPKLLIYHGTNLEDGVPSRFSGSGSGTDFTLTISSLQPEDFATYYCVQYGQFPWTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 25447 - protein, 107 aa, Artificial Sequence; identical to SEQ ID NO: 4645
  Description of Artificial Sequence: Synthetic polypeptide
  VL of XENP016275

SEQ ID NO: 25448 - protein, 11 aa, Artificial Sequence
  Description of Artificial Sequence: Synthetic peptide
  XENP016275 vlCDR1
HASQGIRINIG

SEQ ID NO: 25449 - protein, 7 aa, Artificial Sequence
  Description of Artificial Sequence: Synthetic peptide
  XENP016275 vlCDR2
HGTNLED

SEQ ID NO: 25450 - protein, 9 aa, Artificial Sequence
  Description of Artificial Sequence: Synthetic peptide
  XENP016275 vlCDR3
VQYGQFPWT

SEQ ID NO: 25451 - protein, 447 aa, Artificial Sequence
  Description of Artificial Sequence: Synthetic polypeptide
  XENP017973 ABTIM3_H0L0_IgG1_PVA_/S267K Heavy Chain
QVQLQQPGAELVKPGASVKMSCKASGYTFTSYNMHWIKQTPGQGLEWIGDIYPGNGDTSYNQKFKGKATLTADKSSSTVYMQLSSLTSEDSAVYYCARVGGAFPMDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 25452 - protein, 118 aa, Artificial Sequence
  Description of Artificial Sequence: Synthetic polypeptide
  VH of XENP017973
QVQLQQPGAELVKPGASVKMSCKASGYTFTSYNMHWIKQTPGQGLEWIGDIYPGNGDTSYNQKFKGKATLTADKSSSTVYMQLSSLTSEDSAVYYCARVGGAFPMDYWGQGTSVTVSS

SEQ ID NO: 25453 - protein, 5 aa, Artificial Sequence
  Description of Artificial Sequence: Synthetic peptide
  XENP017973 vhCDR1
SYNMH

SEQ ID NO: 25454 - protein, 17 aa, Artificial Sequence
  Description of Artificial Sequence: Synthetic peptide
  XENP017973 vhCDR2
DIYPGNGDTSYNQKFKG

SEQ ID NO: 25455 - protein, 9 aa, Artificial Sequence
  Description of Artificial Sequence: Synthetic peptide
  XENP017973 vhCDR3
VGGAFPMDY

SEQ ID NO: 25456 - protein, 218 aa, Artificial Sequence
  Description of Artificial Sequence: Synthetic polypeptide
  XENP017973 ABTIM3_H0L0_IgG1_PVA_/S267K Light Chain
DIVLTQSPASLAVSLGQRATISCRASESVEYYGTSLMQWYQQKPGQPPKLLIYAASNVESGVPARFSGSGSGTDFSLNIHPVEEDDIAIYFCQQSRKDPSTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 25457 - protein, 111 aa, Artificial Sequence
  Description of Artificial Sequence: Synthetic polypeptide
  VL of XENP017973
DIVLTQSPASLAVSLGQRATISCRASESVEYYGTSLMQWYQQKPGQPPKLLIYAASNVESGVPARFSGSGSGTDFSLNIHPVEEDDIAIYFCQQSRKDPSTFGGGTKLEIK

SEQ ID NO: 25458 - protein, 15 aa, Artificial Sequence
  Description of Artificial Sequence: Synthetic peptide
  XENP017973 vlCDR1
RASESVEYYGTSLMQ

SEQ ID NO: 25459 - protein, 7 aa, Artificial Sequence
  Description of Artificial Sequence: Synthetic peptide
  XENP017973 vlCDR2
AASNVES

SEQ ID NO: 25460 - protein, 9 aa, Artificial Sequence
  Description of Artificial Sequence: Synthetic peptide
  XENP017973 vlCDR3
QQSRKDPST

SEQ ID NO: 25461 - protein, 447 aa, Artificial Sequence
  Description of Artificial Sequence: Synthetic polypeptide
  XENP017975 ABTIM3-hum11_H0L0_IgG1_PVA_/S267K Heavy Chain
QVQLVQSGAEVKKPGSSVKVSCKASGYTFTSYNMHWVRQAPGQGLEWMGDIYPGNGDTSYNQKFKGRVTITADKSTSTVYMELSSLRSEDTAVYYCARVGGAFPMDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 25462 - protein, 118 aa, Artificial Sequence; identical to SEQ ID NO: 4609
  Description of Artificial Sequence: Synthetic polypeptide
  VH of XENP017975

SEQ ID NO: 25463 - protein, 5 aa, Artificial Sequence
  Description of Artificial Sequence: Synthetic peptide
  XENP017975 vhCDR1
SYNMH

SEQ ID NO: 25464 - protein, 17 aa, Artificial Sequence
  Description of Artificial Sequence: Synthetic peptide
  XENP017975 vhCDR2
DIYPGNGDTSYNQKFKG

SEQ ID NO: 25465 - protein, 9 aa, Artificial Sequence
  Description of Artificial Sequence: Synthetic peptide
  XENP017975 vhCDR3
VGGAFPMDY

SEQ ID NO: 25466 - protein, 218 aa, Artificial Sequence
  Description of Artificial Sequence: Synthetic polypeptide
  XENP017975 ABTIM3-hum11_H0L0_IgG1_PVA_/S267K Light Chain
AIQLTQSPSSLSASVGDRVTITCRASESVEYYGTSLMQWYQQKPGKAPKLLIYAASNVESGVPSRFSGSGSGTDFTLTISSLQPEDFATYFCQQSRKDPSTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 25467 - protein, 111 aa, Artificial Sequence; identical to SEQ ID NO: 4613
  Description of Artificial Sequence: Synthetic polypeptide
  VL of XENP017975

SEQ ID NO: 25468 - protein, 15 aa, Artificial Sequence
  Description of Artificial Sequence: Synthetic peptide
  XENP017975 vlCDR1
RASESVEYYGTSLMQ

SEQ ID NO: 25469 - protein, 7 aa, Artificial Sequence
  Description of Artificial Sequence: Synthetic peptide
  XENP017975 vlCDR2
AASNVES

SEQ ID NO: 25470 - protein, 9 aa, Artificial Sequence
  Description of Artificial Sequence: Synthetic peptide
  XENP017975 vlCDR3
QQSRKDPST

SEQ ID NO: 25471 - protein, 446 aa, Artificial Sequence
  Description of Artificial Sequence: Synthetic polypeptide
  XENP020403 1B3_H0L0_IgG1_PVA_/S267K Heavy Chain
EVKLVESGGGLVKPGGSLTLSCAASEFTFSSYAMSWVRQTPEKRLEWVASISSGGRTYYPDSVKGRFTISRDNARNILYLQMSSLRSEDTAMYYCARGRGFDVMDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 25472 - protein, 117 aa, Artificial Sequence
  Description of Artificial Sequence: Synthetic polypeptide
  VH of XENP020403
EVKLVESGGGLVKPGGSLTLSCAASEFTFSSYAMSWVRQTPEKRLEWVASISSGGRTYYPDSVKGRFTISRDNARNILYLQMSSLRSEDTAMYYCARGRGFDVMDYWGQGTSVTVSS

SEQ ID NO: 25473 - protein, 5 aa, Artificial Sequence
  Description of Artificial Sequence: Synthetic peptide
  XENP020403 vhCDR1
SYAMS

SEQ ID NO: 25474 - protein, 16 aa, Artificial Sequence
  Description of Artificial Sequence: Synthetic peptide
  XENP020403 vhCDR2
SISSGGRTYYPDSVKG

SEQ ID NO: 25475 - protein, 9 aa, Artificial Sequence
  Description of Artificial Sequence: Synthetic peptide
  XENP020403 vhCDR3
GRGFDVMDY

SEQ ID NO: 25476 - protein, 214 aa, Artificial Sequence
  Description of Artificial Sequence: Synthetic polypeptide
  XENP020403 1B3_H0L0_IgG1_PVA_/S267K Light Chain
DIQMTQTTSSLSASLGDRVTISCRASQDISNYLNWYQQKPDGTVKLLIYYTSRLHSGVPSRFSGSGSGTDYSLTISNLEQEDIATYFCQQGNTLPYTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 25477 - protein, 107 aa, Artificial Sequence
  Description of Artificial Sequence: Synthetic polypeptide
  VL of XENP020403
DIQMTQTTSSLSASLGDRVTISCRASQDISNYLNWYQQKPDGTVKLLIYYTSRLHSGVPSRFSGSGSGTDYSLTISNLEQEDIATYFCQQGNTLPYTFGGGTKLEIK

SEQ ID NO: 25478 - protein, 11 aa, Artificial Sequence
  Description of Artificial Sequence: Synthetic peptide
  XENP020403 vlCDR1
RASQDISNYLN

SEQ ID NO: 25479 - protein, 7 aa, Artificial Sequence
  Description of Artificial Sequence: Synthetic peptide
  XENP020403 vlCDR2
YTSRLHS

SEQ ID NO: 25480 - protein, 9 aa, Artificial Sequence
  Description of Artificial Sequence: Synthetic peptide
  XENP020403 vlCDR3
QQGNTLPYT

SEQ ID NO: 25481 - protein, 446 aa, Artificial Sequence
  Description of Artificial Sequence: Synthetic polypeptide
  XENP020404 1D12_H0L0_IgG1_PVA_/S267K Heavy Chain
QVQLQQSAADLARPGASVKLSCKASGYTFTSYTMHWVKQRPGQGLEWIGYLIPSSGYTDYNQRFKDKTTLTADKSSSTAYMQLSSLTSEDSAVYYCARGDSVYFDYWGQGTALTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 25482 - protein, 117 aa, Artificial Sequence
  Description of Artificial Sequence: Synthetic polypeptide
  VH of XENP020404
QVQLQQSAADLARPGASVKLSCKASGYTFTSYTMHWVKQRPGQGLEWIGYLIPSSGYTDYNQRFKDKTTLTADKSSSTAYMQLSSLTSEDSAVYYCARGDSVYFDYWGQGTALTVSS

SEQ ID NO: 25483 - protein, 5 aa, Artificial Sequence
  Description of Artificial Sequence: Synthetic peptide
  XENP020404 vhCDR1
SYTMH

SEQ ID NO: 25484 - protein, 17 aa, Artificial Sequence
  Description of Artificial Sequence: Synthetic peptide
  XENP020404 vhCDR2
YLIPSSGYTDYNQRFKD

SEQ ID NO: 25485 - protein, 8 aa, Artificial Sequence
  Description of Artificial Sequence: Synthetic peptide
  XENP020404 vhCDR3
GDSVYFDY

SEQ ID NO: 25486 - protein, 218 aa, Artificial Sequence
  Description of Artificial Sequence: Synthetic polypeptide
  XENP020404 1D12_H0L0_IgG1_PVA_/S267K Light Chain
DIVLTQSPASLAVSLGQRATISCRASESVEYYGTSLQQKYQQKPGQPPKLLIYAASNVESGVPARFSGSGSGTDFSLNIHPVEEDDIAQYFCQQSRKVPWTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 25487 - protein, 111 aa, Artificial Sequence
  Description of Artificial Sequence: Synthetic polypeptide
  VL of XENP020404
DIVLTQSPASLAVSLGQRATISCRASESVEYYGTSLQQKYQQKPGQPPKLLIYAASNVESGVPARFSGSGSGTDFSLNIHPVEEDDIAQYFCQQSRKVPWTFGGGTKLEIK

SEQ ID NO: 25488 - protein, 15 aa, Artificial Sequence
  Description of Artificial Sequence: Synthetic peptide
  XENP020404 vlCDR1
RASESVEYYGTSLQQ

SEQ ID NO: 25489 - protein, 7 aa, Artificial Sequence
  Description of Artificial Sequence: Synthetic peptide
  XENP020404 vlCDR2
AASNVES

SEQ ID NO: 25490 - protein, 9 aa, Artificial Sequence
  Description of Artificial Sequence: Synthetic peptide
  XENP020404 vlCDR3
QQSRKVPWT

SEQ ID NO: 25491 - protein, 446 aa, Artificial Sequence
  Description of Artificial Sequence: Synthetic polypeptide
  XENP020405 3H3_H0L0_IgG1_PVA_/S267K Heavy Chain
QVQLKESGPGLVAPSQSLSITCTVSGFSLNGYGVNWVRQPPGKGLEWLGYIIGDGSTDYNSALKSRLSISKDNSKSQVFLKMNSLQTDDTARYYCARSYYTSDEDYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 25492 - protein, 117 aa, Artificial Sequence
  Description of Artificial Sequence: Synthetic polypeptide
  VH of XENP020405
QVQLKESGPGLVAPSQSLSITCTVSGFSLNGYGVNWVRQPPGKGLEWLGYIIGDGSTDYNSALKSRLSISKDNSKSQVFLKMNSLQTDDTARYYCARSYYTSDEDYWGQGTLVTVSA

SEQ ID NO: 25493 - protein, 5 aa, Artificial Sequence
  Description of Artificial Sequence: Synthetic peptide
  XENP020405 vhCDR1
GYGVN

SEQ ID NO: 25494 - protein, 16 aa, Artificial Sequence
  Description of Artificial Sequence: Synthetic peptide
  XENP020405 vhCDR2
YIIGDGSTDYNSALKS

SEQ ID NO: 25495 - protein, 9 aa, Artificial Sequence
  Description of Artificial Sequence: Synthetic peptide
  XENP020405 vhCDR3
SYYTSDEDY

SEQ ID NO: 25496 - protein, 219 aa, Artificial Sequence
  Description of Artificial Sequence: Synthetic polypeptide
  XENP020405 3H3_H0L0_IgG1_PVA_/S267K Light Chain
DIVLSQSPSSLAVSAGEKVTISCKSSQSLLNSRTRKNYLAQYQQKPGQSPKLLIYSASTRESGVPDRFTGSGSGTDFTLTISSVLAEDLAVYYCKQSYSLRTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 25497 - protein, 112 aa, Artificial Sequence
  Description of Artificial Sequence: Synthetic polypeptide
  VL of XENP020405
DIVLSQSPSSLAVSAGEKVTISCKSSQSLLNSRTRKNYLAQYQQKPGQSPKLLIYSASTRESGVPDRFTGSGSGTDFTLTISSVLAEDLAVYYCKQSYSLRTFGGGTKLEIK

SEQ ID NO: 25498 - protein, 17 aa, Artificial Sequence
  Description of Artificial Sequence: Synthetic peptide
  XENP020405 vlCDR1
KSSQSLLNSRTRKNYLA

SEQ ID NO: 25499 - protein, 7 aa, Artificial Sequence
  Description of Artificial Sequence: Synthetic peptide
  XENP020405 vlCDR2
SASTRES

SEQ ID NO: 25500 - protein, 8 aa, Artificial Sequence
  Description of Artificial Sequence: Synthetic peptide
  XENP020405 vlCDR3
KQSYSLRT

SEQ ID NO: 25501 - protein, 446 aa, Artificial Sequence
  Description of Artificial Sequence: Synthetic polypeptide
  XENP020406 6D9_H0_1D12_L0_IgG1_PVA_/S267K Heavy Chain
QVQLKQSGPGLVQPSQSLSITCTVSGFSLTSYGVHWVRQSPGKGLEWLGVIISGGSTEYNAAFISRLSISKDNSKSQVFFKMNSLQADDTAIYYCARGGLLSPFDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 25502 - protein, 117 aa, Artificial Sequence
  Description of Artificial Sequence: Synthetic polypeptide
  VH of XENP020406
QVQLKQSGPGLVQPSQSLSITCTVSGFSLTSYGVHWVRQSPGKGLEWLGVIISGGSTEYNAAFISRLSISKDNSKSQVFFKMNSLQADDTAIYYCARGGLLSPFDYWGQGTTLTVSS

SEQ ID NO: 25503 - protein, 5 aa, Artificial Sequence
  Description of Artificial Sequence: Synthetic peptide
  XENP020406 vhCDR1
SYGVH

SEQ ID NO: 25504 - protein, 16 aa, Artificial Sequence
  Description of Artificial Sequence: Synthetic peptide
  XENP020406 vhCDR2
VIISGGSTEYNAAFIS

SEQ ID NO: 25505 - protein, 9 aa, Artificial Sequence
  Description of Artificial Sequence: Synthetic peptide
  XENP020406 vhCDR3
GGLLSPFDY

SEQ ID NO: 25506 - protein, 218 aa, Artificial Sequence; identical to SEQ ID NO: 25486
  Description of Artificial Sequence: Synthetic polypeptide
  XENP020406 6D9_H0_1D12_L0_IgG1_PVA_/S267K Light Chain

SEQ ID NO: 25507 - protein, 111 aa, Artificial Sequence; identical to SEQ ID NO: 25487
  Description of Artificial Sequence: Synthetic polypeptide
  VL of XENP020406

SEQ ID NO: 25508 - protein, 15 aa, Artificial Sequence
  Description of Artificial Sequence: Synthetic peptide
  XENP020406 vlCDR1
RASESVEYYGTSLQQ

SEQ ID NO: 25509 - protein, 7 aa, Artificial Sequence
  Description of Artificial Sequence: Synthetic peptide
  XENP020406 vlCDR2
AASNVES

SEQ ID NO: 25510 - protein, 9 aa, Artificial Sequence
  Description of Artificial Sequence: Synthetic peptide
  XENP020406 vlCDR3
QQSRKVPWT

SEQ ID NO: 25511 - protein, 447 aa, Artificial Sequence; identical to SEQ ID NO: 3665
  Description of Artificial Sequence: Synthetic polypeptide
  XENP020407 7B11_H0L0_IgG1_PVA_/S267K Heavy Chain

SEQ ID NO: 25512 - protein, 118 aa, Artificial Sequence; identical to SEQ ID NO: 3666
  Description of Artificial Sequence: Synthetic polypeptide
  VH of XENP020407

SEQ ID NO: 25513 - protein, 5 aa, Artificial Sequence
  Description of Artificial Sequence: Synthetic peptide
  XENP020407 vhCDR1
SYAVN

SEQ ID NO: 25514 - protein, 16 aa, Artificial Sequence
  Description of Artificial Sequence: Synthetic peptide
  XENP020407 vhCDR2
VIWSGGSTDYNAAFIS

SEQ ID NO: 25515 - protein, 10 aa, Artificial Sequence
  Description of Artificial Sequence: Synthetic peptide
  XENP020407 vhCDR3
LYYRYDGFDY

SEQ ID NO: 25516 - protein, 214 aa, Artificial Sequence
  Description of Artificial Sequence: Synthetic polypeptide
  XENP020407 7B11_H0L0_IgG1_PVA_/S267K Light Chain
DIVLTQSQKFLSTSVGDRVSVTCKASQNVGTHVARYQQKPGQSPKALVYSASYRYSGVPDRFTGSGSGTDFTLTISNVQSEDLAEYFCQQYNSYPLTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 25517 - protein, 107 aa, Artificial Sequence
  Description of Artificial Sequence: Synthetic polypeptide
  VL of XENP020407
DIVLTQSQKFLSTSVGDRVSVTCKASQNVGTHVARYQQKPGQSPKALVYSASYRYSGVPDRFTGSGSGTDFTLTISNVQSEDLAEYFCQQYNSYPLTFGGGTKLEIK

SEQ ID NO: 25518 - protein, 11 aa, Artificial Sequence
  Description of Artificial Sequence: Synthetic peptide
  XENP020407 vlCDR1
KASQNVGTHVA

SEQ ID NO: 25519 - protein, 7 aa, Artificial Sequence
  Description of Artificial Sequence: Synthetic peptide
  XENP020407 vlCDR2
SASYRYS

SEQ ID NO: 25520 - protein, 9 aa, Artificial Sequence
  Description of Artificial Sequence: Synthetic peptide
  XENP020407 vlCDR3
QQYNSYPLT

SEQ ID NO: 25521 - protein, 447 aa, Artificial Sequence; identical to SEQ ID NO: 3675
  Description of Artificial Sequence: Synthetic polypeptide
  XENP020408 7B11var_H0L0_IgG1_PVA_/S267K Heavy Chain

SEQ ID NO: 25522 - protein, 118 aa, Artificial Sequence; identical to SEQ ID NO: 3676
  Description of Artificial Sequence: Synthetic polypeptide
  VH of XENP020408

SEQ ID NO: 25523 - protein, 5 aa, Artificial Sequence
  Description of Artificial Sequence: Synthetic peptide
  XENP020408 vhCDR1
SYAVN

SEQ ID NO: 25524 - protein, 16 aa, Artificial Sequence
  Description of Artificial Sequence: Synthetic peptide
  XENP020408 vhCDR2
VIWSGGSTDYNAAFIS

SEQ ID NO: 25525 - protein, 10 aa, Artificial Sequence
  Description of Artificial Sequence: Synthetic peptide
  XENP020408 vhCDR3
LYYRYDGFDY

SEQ ID NO: 25526 - protein, 214 aa, Artificial Sequence; identical to SEQ ID NO: 25516
  Description of Artificial Sequence: Synthetic polypeptide
  XENP020408 7B11var_H0L0_IgG1_PVA_/S267K Light Chain

SEQ ID NO: 25527 - protein, 107 aa, Artificial Sequence; identical to SEQ ID NO: 25517
  Description of Artificial Sequence: Synthetic polypeptide
  VL of XENP020408

SEQ ID NO: 25528 - protein, 11 aa, Artificial Sequence
  Description of Artificial Sequence: Synthetic peptide
  XENP020408 vlCDR1
KASQNVGTHVA

SEQ ID NO: 25529 - protein, 7 aa, Artificial Sequence
  Description of Artificial Sequence: Synthetic peptide
  XENP020408 vlCDR2
SASYRYS

SEQ ID NO: 25530 - protein, 9 aa, Artificial Sequence
  Description of Artificial Sequence: Synthetic peptide
  XENP020408 vlCDR3
QQYNSYPLT

SEQ ID NO: 25531 - protein, 446 aa, Artificial Sequence
  Description of Artificial Sequence: Synthetic polypeptide
  XENP020409 6C8_H0L0_IgG1_PVA_/S267K Heavy Chain
QVQLQQSGAELVRPGTSVKISCKAAGYTFTNYAIGWVKQRPGHGLEWIGDFYPGGGYTNYNEKFKGKATLTADTSSSTAYMQLSSLTSEDSAIYFCARGYYRVFDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 25532 - protein, 117 aa, Artificial Sequence
  Description of Artificial Sequence: Synthetic polypeptide
  VH of XENP020409
QVQLQQSGAELVRPGTSVKISCKAAGYTFTNYAIGWVKQRPGHGLEWIGDFYPGGGYTNYNEKFKGKATLTADTSSSTAYMQLSSLTSEDSAIYFCARGYYRVFDYWGQGTTLTVSS

SEQ ID NO: 25533 - protein, 5 aa, Artificial Sequence
  Description of Artificial Sequence: Synthetic peptide
  XENP020409 vhCDR1
NYAIG

SEQ ID NO: 25534 - protein, 17 aa, Artificial Sequence
  Description of Artificial Sequence: Synthetic peptide
  XENP020409 vhCDR2
DFYPGGGYTNYNEKFKG

SEQ ID NO: 25535 - protein, 8 aa, Artificial Sequence
  Description of Artificial Sequence: Synthetic peptide
  XENP020409 vhCDR3
GYYRVFDY

SEQ ID NO: 25536 - protein, 214 aa, Artificial Sequence
  Description of Artificial Sequence: Synthetic polypeptide
  XENP020409 6C8_H0L0_IgG1_PVA_/S267K Light Chain
DIVLTQSQKFLSTSVGDRVSVTCKASQNVGSNVARCQQKPGQSPKALIYSASFRYSGVPDRFTGSGSGTDFTLTISNVQSEDLAEYFCQQYNSYPYTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 25537 - protein, 107 aa, Artificial Sequence
  Description of Artificial Sequence: Synthetic polypeptide
  VL of XENP020409
DIVLTQSQKFLSTSVGDRVSVTCKASQNVGSNVARCQQKPGQSPKALIYSASFRYSGVPDRFTGSGSGTDFTLTISNVQSEDLAEYFCQQYNSYPYTFGGGTKLEIK

SEQ ID NO: 25538 - protein, 11 aa, Artificial Sequence
  Description of Artificial Sequence: Synthetic peptide
  XENP020409 vlCDR1
KASQNVGSNVA

SEQ ID NO: 25539 - protein, 7 aa, Artificial Sequence
  Description of Artificial Sequence: Synthetic peptide
  XENP020409 vlCDR2
SASFRYS

SEQ ID NO: 25540 - protein, 9 aa, Artificial Sequence
  Description of Artificial Sequence: Synthetic peptide
  XENP020409 vlCDR3
QQYNSYPYT

SEQ ID NO: 25541 - protein, 446 aa, Artificial Sequence
  Description of Artificial Sequence: Synthetic polypeptide
  XENP020410 7C2_H0L0_IgG1_PVA_/S267K Heavy Chain
EVKVVESGGGLVKPGGSLKLSCAASGFTFSRYAISWVRQTPEKRLEWVASISSGGSTYYPDSVQGRFTISRDNARNILYLQMSSLRSEDTAMYYCARGDYEGYFDYWGQGTSLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 25542 - protein, 117 aa, Artificial Sequence
  Description of Artificial Sequence: Synthetic polypeptide
  VH of XENP020410
EVKVVESGGGLVKPGGSLKLSCAASGFTFSRYAISWVRQTPEKRLEWVASISSGGSTYYPDSVQGRFTISRDNARNILYLQMSSLRSEDTAMYYCARGDYEGYFDYWGQGTSLTVSS

SEQ ID NO: 25543 - protein, 5 aa, Artificial Sequence
  Description of Artificial Sequence: Synthetic peptide
  XENP020410 vhCDR1
RYAIS

SEQ ID NO: 25544 - protein, 16 aa, Artificial Sequence
  Description of Artificial Sequence: Synthetic peptide
  XENP020410 vhCDR2
SISSGGSTYYPDSVQG

SEQ ID NO: 25545 - protein, 9 aa, Artificial Sequence
  Description of Artificial Sequence: Synthetic peptide
  XENP020410 vhCDR3
GDYEGYFDY

SEQ ID NO: 25546 - protein, 220 aa, Artificial Sequence
  Description of Artificial Sequence: Synthetic polypeptide
  XENP020410 7C2_H0L0_IgG1_PVA_/S267K Light Chain
DIVLTQSPSSLATSVGQKVTVSCKSSQSLLNSINQKNYLAGYQQKPGQSPKLLVYFASTRESGVPDRFIGSGSGTDFTLTISSVQAEDLADYFCQQHYSTPLTFGAGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 25547 - protein, 113 aa, Artificial Sequence
  Description of Artificial Sequence: Synthetic polypeptide
  VL of XENP020410
DIVLTQSPSSLATSVGQKVTVSCKSSQSLLNSINQKNYLAGYQQKPGQSPKLLVYFASTRESGVPDRFIGSGSGTDFTLTISSVQAEDLADYFCQQHYSTPLTFGAGTKLELK

SEQ ID NO: 25548 - protein, 17 aa, Artificial Sequence
  Description of Artificial Sequence: Synthetic peptide
  XENP020410 vlCDR1
KSSQSLLNSINQKNYLA

SEQ ID NO: 25549 - protein, 7 aa, Artificial Sequence
  Description of Artificial Sequence: Synthetic peptide
  XENP020410 vlCDR2
FASTRES

SEQ ID NO: 25550 - protein, 9 aa, Artificial Sequence
  Description of Artificial Sequence: Synthetic peptide
  XENP020410 vlCDR3
QQHYSTPLT

SEQ ID NO: 25551 - protein, 442 aa, Artificial Sequence
  Description of Artificial Sequence: Synthetic polypeptide
  XENP020411 1D10_H0L0_IgG1_PVA_/S267K Heavy Chain
EVQLVESGGGLVKPGGSLKFSCAASGFAFSSFDISWVRQTPEKRLEWVAYISSDGASTFYPDTMKGRFTISRDNAKNTLYLQMSSLKSEDTAMYYCTRLGAYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 25552 - protein, 113 aa, Artificial Sequence
  Description of Artificial Sequence: Synthetic polypeptide
  VH of XENP020411
EVQLVESGGGLVKPGGSLKFSCAASGFAFSSFDISWVRQTPEKRLEWVAYISSDGASTFYPDTMKGRFTISRDNAKNTLYLQMSSLKSEDTAMYYCTRLGAYWGQGTLVTVSA

SEQ ID NO: 25553 - protein, 5 aa, Artificial Sequence
  Description of Artificial Sequence: Synthetic peptide
  XENP020411 vhCDR1
SFDIS

SEQ ID NO: 25554 - protein, 17 aa, Artificial Sequence
  Description of Artificial Sequence: Synthetic peptide
  XENP020411 vhCDR2
YISSDGASTFYPDTMKG

SEQ ID NO: 25555 - protein, 4 aa, Artificial Sequence
  Description of Artificial Sequence: Synthetic peptide
  XENP020411 vhCDR3
LGAY

SEQ ID NO: 25556 - protein, 219 aa, Artificial Sequence
  Description of Artificial Sequence: Synthetic polypeptide
  XENP020411 1D10_H0L0_IgG1_PVA_/S267K Light Chain
DVVLTQTPLTLSVTIGQPASISCKSSQSLLDSDGKTYLNWLLQRPGQSPKRLIYLVSKLDSGVPDRFTGSGSGTDFTLKISRVEAEDLGVYYCWQGTHFPYTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 25557 - protein, 112 aa, Artificial Sequence
  Description of Artificial Sequence: Synthetic polypeptide
  VL of XENP020411
DVVLTQTPLTLSVTIGQPASISCKSSQSLLDSDGKTYLNWLLQRPGQSPKRLIYLVSKLDSGVPDRFTGSGSGTDFTLKISRVEAEDLGVYYCWQGTHFPYTFGGGTKLEIK

SEQ ID NO: 25558 - protein, 16 aa, Artificial Sequence
  Description of Artificial Sequence: Synthetic peptide
  XENP020411 vlCDR1
KSSQSLLDSDGKTYLN

SEQ ID NO: 25559 - protein, 7 aa, Artificial Sequence
  Description of Artificial Sequence: Synthetic peptide
  XENP020411 vlCDR2
LVSKLDS

SEQ ID NO: 25560 - protein, 9 aa, Artificial Sequence
  Description of Artificial Sequence: Synthetic peptide
  XENP020411 vlCDR3
WQGTHFPYT

SEQ ID NO: 25561 - protein, 448 aa, Artificial Sequence
  Description of Artificial Sequence: Synthetic polypeptide
  XENP017883 4C7_H0L0_IgG1_PVA_/S267K Heavy Chain
QVQLQESGPGLVKPSETLSLTCTVHGGSINHYYWSWIRQPPGKGLEWIGYIYYSGSTKYNPSLKSRVSISVDTSKNQFSLKLTSVTAADTAVYYCAREWPYYYYEMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 25562 - protein, 119 aa, Artificial Sequence; identical to SEQ ID NO: 3721
  Description of Artificial Sequence: Synthetic polypeptide
  VH of XENP017883

SEQ ID NO: 25563 - protein, 5 aa, Artificial Sequence
  Description of Artificial Sequence: Synthetic peptide
  XENP017883 vhCDR1
HYYWS

SEQ ID NO: 25564 - protein, 16 aa, Artificial Sequence
  Description of Artificial Sequence: Synthetic peptide
  XENP017883 vhCDR2
YIYYSGSTKYNPSLKS

SEQ ID NO: 25565 - protein, 11 aa, Artificial Sequence
  Description of Artificial Sequence: Synthetic peptide
  XENP017883 vhCDR3
EWPYYYYEMDV

SEQ ID NO: 25566 - protein, 215 aa, Artificial Sequence
  Description of Artificial Sequence: Synthetic polypeptide
  XENP017883 4C7_H0L0_IgG1_PVA_/S267K Light Chain
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSFRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 25567 - protein, 108 aa, Artificial Sequence; identical to SEQ ID NO: 3725
  Description of Artificial Sequence: Synthetic polypeptide
  VL of XENP017883

SEQ ID NO: 25568 - protein, 12 aa, Artificial Sequence
  Description of Artificial Sequence: Synthetic peptide
  XENP017883 vlCDR1
RASQSVSSSYLA

SEQ ID NO: 25569 - protein, 7 aa, Artificial Sequence
  Description of Artificial Sequence: Synthetic peptide
  XENP017883 vlCDR2
GASSRAT

SEQ ID NO: 25570 - protein, 9 aa, Artificial Sequence
  Description of Artificial Sequence: Synthetic peptide
  XENP017883 vlCDR3
QQYGSSFRT

SEQ ID NO: 25571 - protein, 450 aa, Artificial Sequence
  Description of Artificial Sequence: Synthetic polypeptide
  XENP017884 8D5_H0L0_IgG1_PVA_/S267K Heavy Chain
EVQLVESGGGLVQPGGSLRLSCAASGFTISSYDMHWVRQATGKGLEWVSVIGPAGDTYYPGSVKGRFTISRENAKNSLYLQMNSLRAGDTAVYYCAREGMAAHNYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 25572 - protein, 121 aa, Artificial Sequence; identical to SEQ ID NO: 3729
  Description of Artificial Sequence: Synthetic polypeptide
  VH of XENP017884

SEQ ID NO: 25573 - protein, 5 aa, Artificial Sequence
  Description of Artificial Sequence: Synthetic peptide
  XENP017884 vhCDR1
SYDMH

SEQ ID NO: 25574 - protein, 16 aa, Artificial Sequence
  Description of Artificial Sequence: Synthetic peptide
  XENP017884 vhCDR2
VIGPAGDTYYPGSVKG

SEQ ID NO: 25575 - protein, 13 aa, Artificial Sequence
  Description of Artificial Sequence: Synthetic peptide
  XENP017884 vhCDR3
EGMAAHNYYGMDV

SEQ ID NO: 25576 - protein, 215 aa, Artificial Sequence
  Description of Artificial Sequence: Synthetic polypeptide
  XENP017884 8D5_H0L0_IgG1_PVA_/S267K Light Chain
EIVLTQSPATLSLSPGERATLSCRASQSVSSYLAWYQQKPGQAPRLLIYDASNRATGIPARFSGSGSGTDFTLTISSLEPEDFAVYYCQQRSNWPPITFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 25577 - protein, 108 aa, Artificial Sequence; identical to SEQ ID NO: 3733
  Description of Artificial Sequence: Synthetic polypeptide
  VL of XENP017884

SEQ ID NO: 25578 - protein, 11 aa, Artificial Sequence
  Description of Artificial Sequence: Synthetic peptide
  XENP017884 vlCDR1
RASQSVSSYLA

SEQ ID NO: 25579 - protein, 7 aa, Artificial Sequence
  Description of Artificial Sequence: Synthetic peptide
  XENP017884 vlCDR2
DASNRAT

SEQ ID NO: 25580 - protein, 10 aa, Artificial Sequence
  Description of Artificial Sequence: Synthetic peptide
  XENP017884 vlCDR3
QQRSNWPPIT

SEQ ID NO: 25581 - protein, 457 aa, Artificial Sequence
  Description of Artificial Sequence: Synthetic polypeptide
  XENP017885 E8D9_H0L0_IgG1_PVA_/S267K Heavy Chain
QITLKESGPTLVKPTQTLTLTCTFSGFSLSTSGVGVGWIRQPPGKALEWLALIYWDDDKRYSPSLKSRLTITKDTSKNQVVLTMTNMDPVDTATYYCAHTSITEVRGAIIYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 25582 - protein, 128 aa, Artificial Sequence
  Description of Artificial Sequence: Synthetic polypeptide
  VH of XENP017885
QITLKESGPTLVKPTQTLTLTCTFSGFSLSTSGVGVGWIRQPPGKALEWLALIYWDDDKRYSPSLKSRLTITKDTSKNQVVLTMTNMDPVDTATYYCAHTSITEVRGAIIYYYGMDVWGQGTTVTVSS

SEQ ID NO: 25583 - protein, 7 aa, Artificial Sequence
  Description of Artificial Sequence: Synthetic peptide
  XENP017885 vhCDR1
TSGVGVG

SEQ ID NO: 25584 - protein, 16 aa, Artificial Sequence
  Description of Artificial Sequence: Synthetic peptide
  XENP017885 vhCDR2
LIYWDDDKRYSPSLKS

SEQ ID NO: 25585 - protein, 18 aa, Artificial Sequence
  Description of Artificial Sequence: Synthetic peptide
  XENP017885 vhCDR3
TSITEVRGAIIYYYGMDV

SEQ ID NO: 25586 - protein, 214 aa, Artificial Sequence
  Description of Artificial Sequence: Synthetic polypeptide
  XENP017885 E8D9_H0L0_IgG1_PVA_/S267K Light Chain
EIVLTQSPGTLSLSPGERATLSCRASQSVSSSYLAWYQQKPGQAPRLLIYGASSRATGIPDRFSGSGSGTDFTLTISRLEPEDFAVYYCQQYGHSLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 25587 - protein, 107 aa, Artificial Sequence
  Description of Artificial Sequence: Synthetic polypeptide
  VL of XENP017885
EIVLTQSPGTLSLSPGERATLSCRASQSVSSSYLAWYQQKPGQAPRLLIYGASSRATGIPDRFSGSGSGTDFTLTISRLEPEDFAVYYCQQYGHSLTFGGGTKVEIK

SEQ ID NO: 25588 - protein, 12 aa, Artificial Sequence
  Description of Artificial Sequence: Synthetic peptide
  XENP017885 vlCDR1
RASQSVSSSYLA

SEQ ID NO: 25589 - protein, 7 aa, Artificial Sequence
  Description of Artificial Sequence: Synthetic peptide
  XENP017885 vlCDR2
GASSRAT

SEQ ID NO: 25590 - protein, 8 aa, Artificial Sequence
  Description of Artificial Sequence: Synthetic peptide
  XENP017885 vlCDR3
QQYGHSLT

SEQ ID NO: 25591 - protein, 449 aa, Artificial Sequence
  Description of Artificial Sequence: Synthetic polypeptide
  XENP020267 3F6_H0L0_anti-BTLA_IgG1_PVA_/S267K Heavy Chain
EVQLQESGPSLVKPSQTLSLTCSVTGDSITSGYWNWIRKFPGNKLEYMGYLSYSGSTYYNPSLKSRISITRDTSKNQYYLQLNSVTTEDTATYYCARYFYGSYYEAMDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 25592 - protein, 120 aa, Artificial Sequence
  Description of Artificial Sequence: Synthetic polypeptide
  VH of XENP020267
EVQLQESGPSLVKPSQTLSLTCSVTGDSITSGYWNWIRKFPGNKLEYMGYLSYSGSTYYNPSLKSRISITRDTSKNQYYLQLNSVTTEDTATYYCARYFYGSYYEAMDYWGQGTSVTVSS

SEQ ID NO: 25593 - protein, 5 aa, Artificial Sequence
  Description of Artificial Sequence: Synthetic peptide
  XENP020267 vhCDR1
SGYWN

SEQ ID NO: 25594 - protein, 16 aa, Artificial Sequence
  Description of Artificial Sequence: Synthetic peptide
  XENP020267 vhCDR2
YLSYSGSTYYNPSLKS

SEQ ID NO: 25595 - protein, 12 aa, Artificial Sequence
  Description of Artificial Sequence: Synthetic peptide
  XENP020267 vhCDR3
YFYGSYYEAMDY

SEQ ID NO: 25596 - protein, 214 aa, Artificial Sequence
  Description of Artificial Sequence: Synthetic polypeptide
  XENP020267 3F6_H0L0_anti-BTLA_IgG1_PVA_/S267K Light Chain
DVQITQSPSYLAASPGETISINCRASKSISKYLAWYQEKPGKTNKLLIYSGSTLQSGIPSRFSGSGSGTDFTLTISSLEPEDFAMYYCQQHNEYPWTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 25597 - protein, 107 aa, Artificial Sequence
  Description of Artificial Sequence: Synthetic polypeptide
  VL of XENP020267
DVQITQSPSYLAASPGETISINCRASKSISKYLAWYQEKPGKTNKLLIYSGSTLQSGIPSRFSGSGSGTDFTLTISSLEPEDFAMYYCQQHNEYPWTFGGGTKLEIK

SEQ ID NO: 25598 - protein, 11 aa, Artificial Sequence
  Description of Artificial Sequence: Synthetic peptide
  XENP020267 vlCDR1
RASKSISKYLA

SEQ ID NO: 25599 - protein, 7 aa, Artificial Sequence
  Description of Artificial Sequence: Synthetic peptide
  XENP020267 vlCDR2
SGSTLQS

SEQ ID NO: 25600 - protein, 9 aa, Artificial Sequence
  Description of Artificial Sequence: Synthetic peptide
  XENP020267 vlCDR3
QQHNEYPWT

SEQ ID NO: 25601 - protein, 448 aa, Artificial Sequence
  Description of Artificial Sequence: Synthetic polypeptide
  XENP020268 1A9_H0L0_anti-BTLA_IgG1_PVA_/S267K Heavy Chain
DVQLVESGGGLVQPGGSRKLSCAASGFTFSSFGMHWVRQAPEKGLEWVAYISSGISTIYYADTVKGRFTISRDNPKNTLFLQMTSLRSEDTAMYYCARDWLRGYAMDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 25602 - protein, 119 aa, Artificial Sequence
  Description of Artificial Sequence: Synthetic polypeptide
  VH of XENP020268
DVQLVESGGGLVQPGGSRKLSCAASGFTFSSFGMHWVRQAPEKGLEWVAYISSGISTIYYADTVKGRFTISRDNPKNTLFLQMTSLRSEDTAMYYCARDWLRGYAMDYWGQGTSVTVSS

SEQ ID NO: 25603 - protein, 5 aa, Artificial Sequence
  Description of Artificial Sequence: Synthetic peptide
  XENP020268 vhCDR1
SFGMH

SEQ ID NO: 25604 - protein, 17 aa, Artificial Sequence
  Description of Artificial Sequence: Synthetic peptide
  XENP020268 vhCDR2
YISSGISTIYYADTVKG

SEQ ID NO: 25605 - protein, 10 aa, Artificial Sequence
  Description of Artificial Sequence: Synthetic peptide
  XENP020268 vhCDR3
DWLRGYAMDY

SEQ ID NO: 25606 - protein, 218 aa, Artificial Sequence
  Description of Artificial Sequence: Synthetic polypeptide
  XENP020268 1A9_H0L0_anti-BTLA_IgG1_PVA_/S267K Light Chain
DIVLTQSPASLAVSLGQRATISCKASQSIDYDGDSYMNWYQQKPGQPPKLLIYAASNLDFGIPARFSGSGSGTDFTLNIHPVEEEDAATYYCQQSNEDPWTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 25607 - protein, 111 aa, Artificial Sequence
  Description of Artificial Sequence: Synthetic polypeptide
  VL of XENP020268
DIVLTQSPASLAVSLGQRATISCKASQSIDYDGDSYMNWYQQKPGQPPKLLIYAASNLDFGIPARFSGSGSGTDFTLNIHPVEEEDAATYYCQQSNEDPWTFGGGTKLEIK

SEQ ID NO: 25608 - protein, 15 aa, Artificial Sequence
  Description of Artificial Sequence: Synthetic peptide
  XENP020268 vlCDR1
KASQSIDYDGDSYMN

SEQ ID NO: 25609 - protein, 7 aa, Artificial Sequence
  Description of Artificial Sequence: Synthetic peptide
  XENP020268 vlCDR2
AASNLDF

SEQ ID NO: 25610 - protein, 9 aa, Artificial Sequence
  Description of Artificial Sequence: Synthetic peptide
  XENP020268 vlCDR3
QQSNEDPWT

SEQ ID NO: 25611 - protein, 447 aa, Artificial Sequence
  Description of Artificial Sequence: Synthetic polypeptide
  XENP020269 9C6_H0L0_anti-BTLA_IgG1_PVA_/S267K Heavy Chain
QVQLKESGPGLVAPSQSLSITCTVSGFSLTGYGVNWVRQPPGKGLEWLGMIWIDGSTDYNSALKSRLSINKDNSKSQVFLKMNSLQTDDTARYYCARDRPDGRAMDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 25612 - protein, 118 aa, Artificial Sequence
  Description of Artificial Sequence: Synthetic polypeptide
  VH of XENP020269
QVQLKESGPGLVAPSQSLSITCTVSGFSLTGYGVNWVRQPPGKGLEWLGMIWIDGSTDYNSALKSRLSINKDNSKSQVFLKMNSLQTDDTARYYCARDRPDGRAMDYWGQGTSVTVSS

SEQ ID NO: 25613 - protein, 5 aa, Artificial Sequence
  Description of Artificial Sequence: Synthetic peptide
  XENP020269 vhCDR1
GYGVN

SEQ ID NO: 25614 - protein, 16 aa, Artificial Sequence
  Description of Artificial Sequence: Synthetic peptide
  XENP020269 vhCDR2
MIWIDGSTDYNSALKS

SEQ ID NO: 25615 - protein, 10 aa, Artificial Sequence
  Description of Artificial Sequence: Synthetic peptide
  XENP020269 vhCDR3
DRPDGRAMDY

SEQ ID NO: 25616 - protein, 213 aa, Artificial Sequence
  Description of Artificial Sequence: Synthetic polypeptide
  XENP020269 9C6_H0L0_anti-BTLA_IgG1_PVA_/S267K Light Chain
SIVMTQTPKFLLVSAGDRVTITCKASQSVSNDVAWYQQKPGQSPKLLIYYASNRYTGVPDRFTGSGYGTDFTFTISTVQAEDLAVYFCQQDYSSPTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 25617 - protein, 106 aa, Artificial Sequence
  Description of Artificial Sequence: Synthetic polypeptide
  VL of XENP020269
SIVMTQTPKFLLVSAGDRVTITCKASQSVSNDVAWYQQKPGQSPKLLIYYASNRYTGVPDRFTGSGYGTDFTFTISTVQAEDLAVYFCQQDYSSPTFGGGTKLEIK

SEQ ID NO: 25618 - protein, 11 aa, Artificial Sequence
  Description of Artificial Sequence: Synthetic peptide
  XENP020269 vlCDR1
KASQSVSNDVA

SEQ ID NO: 25619 - protein, 7 aa, Artificial Sequence
  Description of Artificial Sequence: Synthetic peptide
  XENP020269 vlCDR2
YASNRYT

SEQ ID NO: 25620 - protein, 8 aa, Artificial Sequence
  Description of Artificial Sequence: Synthetic peptide
  XENP020269 vlCDR3
QQDYSSPT

SEQ ID NO: 25621 - protein, 447 aa, Artificial Sequence; identical to SEQ ID NO: 25611
  Description of Artificial Sequence: Synthetic polypeptide
  XENP020270 7H2_H0L0_anti-BTLA_IgG1_PVA_/S267K Heavy Chain

SEQ ID NO: 25622 - protein, 118 aa, Artificial Sequence; identical to SEQ ID NO: 25612
  Description of Artificial Sequence: Synthetic polypeptide
  VH of XENP020270

SEQ ID NO: 25623 - protein, 5 aa, Artificial Sequence
  Description of Artificial Sequence: Synthetic peptide
  XENP020270 vhCDR1
GYGVN

SEQ ID NO: 25624 - protein, 16 aa, Artificial Sequence
  Description of Artificial Sequence: Synthetic peptide
  XENP020270 vhCDR2
MIWIDGSTDYNSALKS

SEQ ID NO: 25625 - protein, 10 aa, Artificial Sequence
  Description of Artificial Sequence: Synthetic peptide
  XENP020270 vhCDR3
DRPDGRAMDY

SEQ ID NO: 25626 - protein, 213 aa, Artificial Sequence
  Description of Artificial Sequence: Synthetic polypeptide
  XENP020270 7H2_H0L0_anti-BTLA_IgG1_PVA_/S267K Light Chain
SIVMTQTPKFLLVSAGDRVTITCKASQSVSNDVAWYQQKPGQSPKLLIYYASNRYTGVPDRFTGSGYGTDFTFTISTVQAEDLAVYFCQQDYNSPTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 25627 - protein, 106 aa, Artificial Sequence
  Description of Artificial Sequence: Synthetic polypeptide
  VL of XENP020270
SIVMTQTPKFLLVSAGDRVTITCKASQSVSNDVAWYQQKPGQSPKLLIYYASNRYTGVPDRFTGSGYGTDFTFTISTVQAEDLAVYFCQQDYNSPTFGGGTKLEIK

SEQ ID NO: 25628 - protein, 11 aa, Artificial Sequence
  Description of Artificial Sequence: Synthetic peptide
  XENP020270 vlCDR1
KASQSVSNDVA

SEQ ID NO: 25629 - protein, 7 aa, Artificial Sequence
  Description of Artificial Sequence: Synthetic peptide
  XENP020270 vlCDR2
YASNRYT

SEQ ID NO: 25630 - protein, 8 aa, Artificial Sequence
  Description of Artificial Sequence: Synthetic peptide
  XENP020270 vlCDR3
QQDYNSPT

SEQ ID NO: 25631 - protein, 447 aa, Artificial Sequence
  Description of Artificial Sequence: Synthetic polypeptide
  XENP020271 6C3_H0L0_anti-BTLA_IgG1_PVA_/S267K Heavy Chain
EVQLQQSGAELVRSGASVKLSCTASGFNIKDYYMHWVKQRPEQGLEWIGWLDPENGDTVYVPKFQGKATMTADTSSNTAYLQLTSLTSEDSAVYYCNAGDYGSSFNYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 25632 - protein, 118 aa, Artificial Sequence
  Description of Artificial Sequence: Synthetic polypeptide
  VH of XENP020271
EVQLQQSGAELVRSGASVKLSCTASGFNIKDYYMHWVKQRPEQGLEWIGWLDPENGDTVYVPKFQGKATMTADTSSNTAYLQLTSLTSEDSAVYYCNAGDYGSSFNYWGQGTTLTVSS

SEQ ID NO: 25633 - protein, 5 aa, Artificial Sequence
  Description of Artificial Sequence: Synthetic peptide
  XENP020271 vhCDR1
DYYMH

SEQ ID NO: 25634 - protein, 17 aa, Artificial Sequence
  Description of Artificial Sequence: Synthetic peptide
  XENP020271 vhCDR2
WLDPENGDTVYVPKFQG

SEQ ID NO: 25635 - protein, 9 aa, Artificial Sequence
  Description of Artificial Sequence: Synthetic peptide
  XENP020271 vhCDR3
GDYGSSFNY

SEQ ID NO: 25636 - protein, 219 aa, Artificial Sequence
  Description of Artificial Sequence: Synthetic polypeptide
  XENP020271 6C3_H0L0_anti-BTLA_IgG1_PVA_/S267K Light Chain
DIVMSQSPSSLAVSVGEKVTMSCKSSQSLLYSGNQKNYLAWYQQRPGQSPKLLIYWASTRESGVPDRFTGSGSGTDFTLTISSVKTEDLAVYYCQQYYTYHTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 25637 - protein, 112 aa, Artificial Sequence
  Description of Artificial Sequence: Synthetic polypeptide
  VL of XENP020271
DIVMSQSPSSLAVSVGEKVTMSCKSSQSLLYSGNQKNYLAWYQQRPGQSPKLLIYWASTRESGVPDRFTGSGSGTDFTLTISSVKTEDLAVYYCQQYYTYHTFGGGTKLEIK

SEQ ID NO: 25638 - protein, 17 aa, Artificial Sequence
  Description of Artificial Sequence: Synthetic peptide
  XENP020271 vlCDR1
KSSQSLLYSGNQKNYLA

SEQ ID NO: 25639 - protein, 7 aa, Artificial Sequence
  Description of Artificial Sequence: Synthetic peptide
  XENP020271 vlCDR2
WASTRES

SEQ ID NO: 25640 - protein, 8 aa, Artificial Sequence
  Description of Artificial Sequence: Synthetic peptide
  XENP020271 vlCDR3
QQYYTYHT

SEQ ID NO: 25641 - protein, 449 aa, Artificial Sequence
  Description of Artificial Sequence: Synthetic polypeptide
  XENP020272 9C10_H0L0_anti-BTLA_IgG1_PVA_/S267K Heavy Chain
EVQLQESGPSLVKPSQTLSLTCSVTGDSITSGYWNWIRKFPGNKLEYMGYISYSGSTYYNPSLKSRISITRDTSKNQYYLQLNSVTTEDTATYYCARYYYGSYYEAMDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 25642 - protein, 120 aa, Artificial Sequence
  Description of Artificial Sequence: Synthetic polypeptide
  VH of XENP020272
EVQLQESGPSLVKPSQTLSLTCSVTGDSITSGYWNWIRKFPGNKLEYMGYISYSGSTYYNPSLKSRISITRDTSKNQYYLQLNSVTTEDTATYYCARYYYGSYYEAMDYWGQGTSVTVSS

SEQ ID NO: 25643 - protein, 5 aa, Artificial Sequence
  Description of Artificial Sequence: Synthetic peptide
  XENP020272 vhCDR1
SGYWN

SEQ ID NO: 25644 - protein, 16 aa, Artificial Sequence
  Description of Artificial Sequence: Synthetic peptide
  XENP020272 vhCDR2
YISYSGSTYYNPSLKS

SEQ ID NO: 25645 - protein, 12 aa, Artificial Sequence
  Description of Artificial Sequence: Synthetic peptide
  XENP020272 vhCDR3
YYYGSYYEAMDY

SEQ ID NO: 25646 - protein, 214 aa, Artificial Sequence
  Description of Artificial Sequence: Synthetic polypeptide
  XENP020272 9C10_H0L0_anti-BTLA_IgG1_PVA_/S267K Light Chain
DVQITQSPSYLAASPGETITINCRASKSISKYLAWYQEKPGKTNKLLLYSGSTLQSGIPSRFSGSGSGTDFTLTISSLEPEDFAMYYCQQHNEYPWTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 25647 - protein, 107 aa, Artificial Sequence
  Description of Artificial Sequence: Synthetic polypeptide
  VL of XENP020272
DVQITQSPSYLAASPGETITINCRASKSISKYLAWYQEKPGKTNKLLLYSGSTLQSGIPSRFSGSGSGTDFTLTISSLEPEDFAMYYCQQHNEYPWTFGGGTKLEIK

SEQ ID NO: 25648 - protein, 11 aa, Artificial Sequence
  Description of Artificial Sequence: Synthetic peptide
  XENP020272 vlCDR1
RASKSISKYLA

SEQ ID NO: 25649 - protein, 7 aa, Artificial Sequence
  Description of Artificial Sequence: Synthetic peptide
  XENP020272 vlCDR2
SGSTLQS

SEQ ID NO: 25650 - protein, 9 aa, Artificial Sequence
  Description of Artificial Sequence: Synthetic peptide
  XENP020272 vlCDR3
QQHNEYPWT

SEQ ID NO: 25651 - protein, 443 aa, Artificial Sequence
  Description of Artificial Sequence: Synthetic polypeptide
  XENP020273 12E6_H0L0_anti-BTLA_IgG1_PVA_/S267K Heavy Chain
QVQLQQSGAELMKPGASVKISCKATGYTFSNYWIEWVKQRPGHGLEWIGEILPGSGGTNYNEKFKGKATFTADTSSNTAYMQLSGLTSEDSAVYYCASPRYDLWGQGTSVTASSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 25652 - protein, 114 aa, Artificial Sequence
  Description of Artificial Sequence: Synthetic polypeptide
  VH of XENP020273
QVQLQQSGAELMKPGASVKISCKATGYTFSNYWIEWVKQRPGHGLEWIGEILPGSGGTNYNEKFKGKATFTADTSSNTAYMQLSGLTSEDSAVYYCASPRYDLWGQGTSVTASS

SEQ ID NO: 25653 - protein, 5 aa, Artificial Sequence
  Description of Artificial Sequence: Synthetic peptide
  XENP020273 vhCDR1
NYWIE

SEQ ID NO: 25654 - protein, 17 aa, Artificial Sequence
  Description of Artificial Sequence: Synthetic peptide
  XENP020273 vhCDR2
EILPGSGGTNYNEKFKG

SEQ ID NO: 25655 - protein, 5 aa, Artificial Sequence
  Description of Artificial Sequence: Synthetic peptide
  XENP020273 vhCDR3
PRYDL

SEQ ID NO: 25656 - protein, 219 aa, Artificial Sequence
  Description of Artificial Sequence: Synthetic polypeptide
  XENP020273 12E6_H0L0_anti-BTLA_IgG1_PVA_/S267K Light Chain
DVVMTQTPLTLSVTVGQPASISCKSSQSLLHSDGETYLNWFLQRPGQSPKRLIYLVSKRDSGVPDRFTGSGSGTDFTLKISRVEAEDLGVYYCWQGIHFPQTFGRGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 25657 - protein, 112 aa, Artificial Sequence
  Description of Artificial Sequence: Synthetic polypeptide
  VL of XENP020273
DVVMTQTPLTLSVTVGQPASISCKSSQSLLHSDGETYLNWFLQRPGQSPKRLIYLVSKRDSGVPDRFTGSGSGTDFTLKISRVEAEDLGVYYCWQGIHFPQTFGRGTKLEIK

SEQ ID NO: 25658 - protein, 16 aa, Artificial Sequence
  Description of Artificial Sequence: Synthetic peptide
  XENP020273 vlCDR1
KSSQSLLHSDGETYLN

SEQ ID NO: 25659 - protein, 7 aa, Artificial Sequence
  Description of Artificial Sequence: Synthetic peptide
  XENP020273 vlCDR2
LVSKRDS

SEQ ID NO: 25660 - protein, 9 aa, Artificial Sequence
  Description of Artificial Sequence: Synthetic peptide
  XENP020273 vlCDR3
WQGIHFPQT

SEQ ID NO: 25661 - protein, 442 aa, Artificial Sequence
  Description of Artificial Sequence: Synthetic polypeptide
  XENP020274 4C11A_H0L0_anti-BTLA_IgG1_PVA_/S267K Heavy Chain
QVQLQQSGAELVKPGASVKLSCKASGYTFTSYYMDWVKQRPGQGLEWIGEINPSNGDTKFNEKFKSKATLTVDKSSTTAYMQLSSLTSEDSAVYYCTRDYGYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 25662 - protein, 113 aa, Artificial Sequence
  Description of Artificial Sequence: Synthetic polypeptide
  VH of XENP020274
QVQLQQSGAELVKPGASVKLSCKASGYTFTSYYMDWVKQRPGQGLEWIGEINPSNGDTKFNEKFKSKATLTVDKSSTTAYMQLSSLTSEDSAVYYCTRDYGYWGQGTTLTVSS

SEQ ID NO: 25663 - protein, 5 aa, Artificial Sequence
  Description of Artificial Sequence: Synthetic peptide
  XENP020274 vhCDR1
SYYMD

SEQ ID NO: 25664 - protein, 17 aa, Artificial Sequence
  Description of Artificial Sequence: Synthetic peptide
  XENP020274 vhCDR2
EINPSNGDTKFNEKFKS

SEQ ID NO: 25665 - protein, 4 aa, Artificial Sequence
  Description of Artificial Sequence: Synthetic peptide
  XENP020274 vhCDR3
DYGY

SEQ ID NO: 25666 - protein, 214 aa, Artificial Sequence
  Description of Artificial Sequence: Synthetic polypeptide
  XENP020274 4C11A_H0L0_anti-BTLA_IgG1_PVA_/S267K Light Chain
DIVMTQSPATLSVTPGDRVSLSCRASQSISDYLHWYQQKSHESPRLLIKYASQSISGIPSRFSGSGSGSDFTLNINGVEPEDVGVYYCQNGHSFPPTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 25667 - protein, 107 aa, Artificial Sequence
  Description of Artificial Sequence: Synthetic polypeptide
  VL of XENP020274
DIVMTQSPATLSVTPGDRVSLSCRASQSISDYLHWYQQKSHESPRLLIKYASQSISGIPSRFSGSGSGSDFTLNINGVEPEDVGVYYCQNGHSFPPTFGGGTKLEIK

SEQ ID NO: 25668 - protein, 11 aa, Artificial Sequence
  Description of Artificial Sequence: Synthetic peptide
  XENP020274 vlCDR1
RASQSISDYLH

SEQ ID NO: 25669 - protein, 7 aa, Artificial Sequence
  Description of Artificial Sequence: Synthetic peptide
  XENP020274 vlCDR2
YASQSIS

SEQ ID NO: 25670 - protein, 9 aa, Artificial Sequence
  Description of Artificial Sequence: Synthetic peptide
  XENP020274 vlCDR3
QNGHSFPPT

SEQ ID NO: 25671 - protein, 442 aa, Artificial Sequence; identical to SEQ ID NO: 25661
  Description of Artificial Sequence: Synthetic polypeptide
  XENP020275 4C11B_H0L0_anti-BTLA_IgG1_PVA_/S267K Heavy Chain

SEQ ID NO: 25672 - protein, 113 aa, Artificial Sequence; identical to SEQ ID NO: 25662
  Description of Artificial Sequence: Synthetic polypeptide
  VH of XENP020275

SEQ ID NO: 25673 - protein, 5 aa, Artificial Sequence
  Description of Artificial Sequence: Synthetic peptide
  XENP020275 vhCDR1
SYYMD

SEQ ID NO: 25674 - protein, 17 aa, Artificial Sequence
  Description of Artificial Sequence: Synthetic peptide
  XENP020275 vhCDR2
EINPSNGDTKFNEKFKS

SEQ ID NO: 25675 - protein, 4 aa, Artificial Sequence
  Description of Artificial Sequence: Synthetic peptide
  XENP020275 vhCDR3
DYGY

SEQ ID NO: 25676 - protein, 213 aa, Artificial Sequence; identical to SEQ ID NO: 25616
  Description of Artificial Sequence: Synthetic polypeptide
  XENP020275 4C11B_H0L0_anti-BTLA_IgG1_PVA_/S267K Light Chain

SEQ ID NO: 25677 - protein, 106 aa, Artificial Sequence; identical to SEQ ID NO: 25617
  Description of Artificial Sequence: Synthetic polypeptide
  VL of XENP020275

SEQ ID NO: 25678 - protein, 11 aa, Artificial Sequence
  Description of Artificial Sequence: Synthetic peptide
  XENP020275 vlCDR1
KASQSVSNDVA

SEQ ID NO: 25679 - protein, 7 aa, Artificial Sequence
  Description of Artificial Sequence: Synthetic peptide
  XENP020275 vlCDR2
YASNRYT

SEQ ID NO: 25680 - protein, 8 aa, Artificial Sequence
  Description of Artificial Sequence: Synthetic peptide
  XENP020275 vlCDR3
QQDYSSPT

SEQ ID NO: 25681 - protein, 449 aa, Artificial Sequence
  Description of Artificial Sequence: Synthetic polypeptide
  XENP020276 7B10_H0L0_anti-BTLA_IgG1_PVA_/S267K Heavy Chain
QVTLKESGPGILQPSQTLSLTCSFSGFSLSTFGMGVNWIRQPSGKGLEWLAHIYWDDDKHYNPSLKSRLTISKDTSNNQVFLKITTVDTADTATYYCARYYRYDVPYIMDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 25682 - protein, 122 aa, Artificial Sequence
  Description of Artificial Sequence: Synthetic polypeptide
  VH of XENP020276
QVTLKESGPGILQPSQTLSLTCSFSGFSLSTFGMGVNWIRQPSGKGLEWLAHIYWDDDKHYNPSLKSRLTISKDTSNNQVFLKITTVDTADTATYYCARYYRYDVPYIMDYWGQGTSVTVSS

SEQ ID NO: 25683 - protein, 7 aa, Artificial Sequence
  Description of Artificial Sequence: Synthetic peptide
  XENP020276 vhCDR1
TFGMGVN

SEQ ID NO: 25684 - protein, 16 aa, Artificial Sequence
  Description of Artificial Sequence: Synthetic peptide
  XENP020276 vhCDR2
HIYWDDDKHYNPSLKS

SEQ ID NO: 25685 - protein, 12 aa, Artificial Sequence
  Description of Artificial Sequence: Synthetic peptide
  XENP020276 vhCDR3
YYRYDVPYIMDY

SEQ ID NO: 25686 - protein, 219 aa, Artificial Sequence
  Description of Artificial Sequence: Synthetic polypeptide
  XENP020276 7B10_H0L0_anti-BTLA_IgG1_PVA_/S267K Light Chain
DIVMSQSPSSLAVSVGEKVTMSCKSSQSLLYSSNQKNYLAWYQQKPGQSPKLLIYWASTRESGVPDRFTGSGSGTDFTLTISSVKAEDLAVYYCHQYYSYYTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 25687 - protein, 112 aa, Artificial Sequence
  Description of Artificial Sequence: Synthetic polypeptide
  VL of XENP020276
DIVMSQSPSSLAVSVGEKVTMSCKSSQSLLYSSNQKNYLAWYQQKPGQSPKLLIYWASTRESGVPDRFTGSGSGTDFTLTISSVKAEDLAVYYCHQYYSYYTFGGGTKLEIK

SEQ ID NO: 25688 - protein, 17 aa, Artificial Sequence
  Description of Artificial Sequence: Synthetic peptide
  XENP020276 vlCDR1
KSSQSLLYSSNQKNYLA

SEQ ID NO: 25689 - protein, 7 aa, Artificial Sequence
  Description of Artificial Sequence: Synthetic peptide
  XENP020276 vlCDR2
WASTRES

SEQ ID NO: 25690 - protein, 8 aa, Artificial Sequence
  Description of Artificial Sequence: Synthetic peptide
  XENP020276 vlCDR3
HQYYSYYT

SEQ ID NO: 25691 - protein, 449 aa, Artificial Sequence
  Description of Artificial Sequence: Synthetic polypeptide
  XENP020277 8C1A_H0L0_anti-BTLA_IgG1_PVA_/S267K Heavy Chain
EVQLQESGPSLVKPSQTLSLTCSVTGDSVTSGYWNWIRKFPGNKLEYMGYINYSGSTYYNPSLKSRISITRDTSKNQYYLQLNSVTTEDTATYYCARSFIATVGYAMDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 25692 - protein, 120 aa, Artificial Sequence
  Description of Artificial Sequence: Synthetic polypeptide
  VH of XENP020277
EVQLQESGPSLVKPSQTLSLTCSVTGDSVTSGYWNWIRKFPGNKLEYMGYINYSGSTYYNPSLKSRISITRDTSKNQYYLQLNSVTTEDTATYYCARSFIATVGYAMDYWGQGTSVTVSS

SEQ ID NO: 25693 - protein, 5 aa, Artificial Sequence
  Description of Artificial Sequence: Synthetic peptide
  XENP020277 vhCDR1
SGYWN

SEQ ID NO: 25694 - protein, 16 aa, Artificial Sequence
  Description of Artificial Sequence: Synthetic peptide
  XENP020277 vhCDR2
YINYSGSTYYNPSLKS

SEQ ID NO: 25695 - protein, 12 aa, Artificial Sequence
  Description of Artificial Sequence: Synthetic peptide
  XENP020277 vhCDR3
SFIATVGYAMDY

SEQ ID NO: 25696 - protein, 214 aa, Artificial Sequence
  Description of Artificial Sequence: Synthetic polypeptide
  XENP020277 8C1A_H0L0_anti-BTLA_IgG1_PVA_/S267K Light Chain
SIVMTQTPKFLLVSAGDRVTITCKASQSVNNDVSWYQQKPGQSPKLLIYSASNRYTGVPDRFTGSGYGTDFTFTISTVQAEDLAVYFCQQDYSSPWTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 25697 - protein, 107 aa, Artificial Sequence
  Description of Artificial Sequence: Synthetic polypeptide
  VL of XENP020277
SIVMTQTPKFLLVSAGDRVTITCKASQSVNNDVSWYQQKPGQSPKLLIYSASNRYTGVPDRFTGSGYGTDFTFTISTVQAEDLAVYFCQQDYSSPWTFGGGTKLEIK

SEQ ID NO: 25698 - protein, 11 aa, Artificial Sequence
  Description of Artificial Sequence: Synthetic peptide
  XENP020277 vlCDR1
KASQSVNNDVS

SEQ ID NO: 25699 - protein, 7 aa, Artificial Sequence
  Description of Artificial Sequence: Synthetic peptide
  XENP020277 vlCDR2
SASNRYT

SEQ ID NO: 25700 - protein, 9 aa, Artificial Sequence
  Description of Artificial Sequence: Synthetic peptide
  XENP020277 vlCDR3
QQDYSSPWT

SEQ ID NO: 25701 - protein, 441 aa, Artificial Sequence
  Description of Artificial Sequence: Synthetic polypeptide
  XENP020278 8C1B_H0L0_anti-BTLA_IgG1_PVA_/S267K Heavy Chain
QVQLQQPGAELVRPGASVRLSCKASGYTFTSYWIHWVKQRPGQGLEWIGNIYSSDSYTNYNQKFKDKATLTVDKSSSTAYIHLSSPTSEDSAVYYCTRVDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 25702 - protein, 112 aa, Artificial Sequence
  Description of Artificial Sequence: Synthetic polypeptide
  VH of XENP020278
QVQLQQPGAELVRPGASVRLSCKASGYTFTSYWIHWVKQRPGQGLEWIGNIYSSDSYTNYNQKFKDKATLTVDKSSSTAYIHLSSPTSEDSAVYYCTRVDYWGQGTTLTVSS

SEQ ID NO: 25703 - protein, 5 aa, Artificial Sequence
  Description of Artificial Sequence: Synthetic peptide
  XENP020278 vhCDR1
SYWIH

SEQ ID NO: 25704 - protein, 17 aa, Artificial Sequence
  Description of Artificial Sequence: Synthetic peptide
  XENP020278 vhCDR2
NIYSSDSYTNYNQKFKD

SEQ ID NO: 25705 - protein, 3 aa, Artificial Sequence
  Description of Artificial Sequence: Synthetic peptide
  XENP020278 vhCDR3
VDY

SEQ ID NO: 25706 - protein, 214 aa, Artificial Sequence; identical to SEQ ID NO: 25696
  Description of Artificial Sequence: Synthetic polypeptide
  XENP020278 8C1B_H0L0_anti-BTLA_IgG1_PVA_/S267K Light Chain

SEQ ID NO: 25707 - protein, 107 aa, Artificial Sequence; identical to SEQ ID NO: 25697
  Description of Artificial Sequence: Synthetic polypeptide
  VL of XENP020278

SEQ ID NO: 25708 - protein, 11 aa, Artificial Sequence
  Description of Artificial Sequence: Synthetic peptide
  XENP020278 vlCDR1
KASQSVNNDVS

SEQ ID NO: 25709 - protein, 7 aa, Artificial Sequence
  Description of Artificial Sequence: Synthetic peptide
  XENP020278 vlCDR2
SASNRYT

SEQ ID NO: 25710 - protein, 9 aa, Artificial Sequence
  Description of Artificial Sequence: Synthetic peptide
  XENP020278 vlCDR3
QQDYSSPWT

SEQ ID NO: 25711 - protein, 447 aa, Artificial Sequence
  Description of Artificial Sequence: Synthetic polypeptide
  XENP020279 10B6_H0L0_anti-BTLA_IgG1_PVA_/S267K Heavy Chain
QVQLKESGPGLVAPSQSLSITCTVSGFSLTGYGVNWVRQPPGKGLEWLGMIWIDGSTDYNSALKSRLSISKDNSKSQVFLKMNSLQTDDTARYYCARDRPDGRAMDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 25712 - protein, 118 aa, Artificial Sequence
  Description of Artificial Sequence: Synthetic polypeptide
  VH of XENP020279
QVQLKESGPGLVAPSQSLSITCTVSGFSLTGYGVNWVRQPPGKGLEWLGMIWIDGSTDYNSALKSRLSISKDNSKSQVFLKMNSLQTDDTARYYCARDRPDGRAMDYWGQGTSVTVSS

SEQ ID NO: 25713 - protein, 5 aa, Artificial Sequence
  Description of Artificial Sequence: Synthetic peptide
  XENP020279 vhCDR1
GYGVN

SEQ ID NO: 25714 - protein, 16 aa, Artificial Sequence
  Description of Artificial Sequence: Synthetic peptide
  XENP020279 vhCDR2
MIWIDGSTDYNSALKS

SEQ ID NO: 25715 - protein, 10 aa, Artificial Sequence
  Description of Artificial Sequence: Synthetic peptide
  XENP020279 vhCDR3
DRPDGRAMDY

SEQ ID NO: 25716 - protein, 213 aa, Artificial Sequence
  Description of Artificial Sequence: Synthetic polypeptide
  XENP020279 10B6_H0L0_anti-BTLA_IgG1_PVA_/S267K Light Chain
SIVMTQTPKFLLVSAGDRVTITCKASQTVSNDVTWYQQKPGQSPKLLIYYASNRYTGVPDRFTGSGYGTDFTFTISTVQAEDLAVYFCQQDYSSPTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 25717 - protein, 106 aa, Artificial Sequence
  Description of Artificial Sequence: Synthetic polypeptide
  VL of XENP020279
SIVMTQTPKFLLVSAGDRVTITCKASQTVSNDVTWYQQKPGQSPKLLIYYASNRYTGVPDRFTGSGYGTDFTFTISTVQAEDLAVYFCQQDYSSPTFGGGTKLEIK

SEQ ID NO: 25718 - protein, 11 aa, Artificial Sequence
  Description of Artificial Sequence: Synthetic peptide
  XENP020279 vlCDR1
KASQTVSNDVT

SEQ ID NO: 25719 - protein, 7 aa, Artificial Sequence
  Description of Artificial Sequence: Synthetic peptide
  XENP020279 vlCDR2
YASNRYT

SEQ ID NO: 25720 - protein, 8 aa, Artificial Sequence
  Description of Artificial Sequence: Synthetic peptide
  XENP020279 vlCDR3
QQDYSSPT

SEQ ID NO: 25721 - protein, 447 aa, Artificial Sequence; identical to SEQ ID NO: 25611
  Description of Artificial Sequence: Synthetic polypeptide
  XENP020744 9C6_H0L1_anti-BTLA_IgG1_PVA_/S267K Heavy Chain

SEQ ID NO: 25722 - protein, 118 aa, Artificial Sequence; identical to SEQ ID NO: 25612
  Description of Artificial Sequence: Synthetic polypeptide
  VH of XENP020744

SEQ ID NO: 25723 - protein, 5 aa, Artificial Sequence
  Description of Artificial Sequence: Synthetic peptide
  XENP020744 vhCDR1
GYGVN

SEQ ID NO: 25724 - protein, 16 aa, Artificial Sequence
  Description of Artificial Sequence: Synthetic peptide
  XENP020744 vhCDR2
MIWIDGSTDYNSALKS

SEQ ID NO: 25725 - protein, 10 aa, Artificial Sequence
  Description of Artificial Sequence: Synthetic peptide
  XENP020744 vhCDR3
DRPDGRAMDY

SEQ ID NO: 25726 - protein, 213 aa, Artificial Sequence; identical to SEQ ID NO: 3160
  Description of Artificial Sequence: Synthetic polypeptide
  XENP020744 9C6_H0L1_anti-BTLA_IgG1_PVA_/S267K Light Chain

SEQ ID NO: 25727 - protein, 106 aa, Artificial Sequence; identical to SEQ ID NO: 3161
  Description of Artificial Sequence: Synthetic polypeptide
  VL of XENP020744

SEQ ID NO: 25728 - protein, 11 aa, Artificial Sequence
  Description of Artificial Sequence: Synthetic peptide
  XENP020744 vlCDR1
KASQSVSNDVA

SEQ ID NO: 25729 - protein, 7 aa, Artificial Sequence
  Description of Artificial Sequence: Synthetic peptide
  XENP020744 vlCDR2
YASNRYT

SEQ ID NO: 25730 - protein, 8 aa, Artificial Sequence
  Description of Artificial Sequence: Synthetic peptide
  XENP020744 vlCDR3
QQDYSSPT

SEQ ID NO: 25731 - protein, 447 aa, Artificial Sequence; identical to SEQ ID NO: 25611
  Description of Artificial Sequence: Synthetic polypeptide
  XENP020745 9C6_H0L2_anti-BTLA_IgG1_PVA_/S267K Heavy Chain

SEQ ID NO: 25732 - protein, 118 aa, Artificial Sequence; identical to SEQ ID NO: 25612
  Description of Artificial Sequence: Synthetic polypeptide
  VH of XENP020745

SEQ ID NO: 25733 - protein, 5 aa, Artificial Sequence
  Description of Artificial Sequence: Synthetic peptide
  XENP020745 vhCDR1
GYGVN

SEQ ID NO: 25734 - protein, 16 aa, Artificial Sequence
  Description of Artificial Sequence: Synthetic peptide
  XENP020745 vhCDR2
MIWIDGSTDYNSALKS

SEQ ID NO: 25735 - protein, 10 aa, Artificial Sequence
  Description of Artificial Sequence: Synthetic peptide
  XENP020745 vhCDR3
DRPDGRAMDY

SEQ ID NO: 25736 - protein, 213 aa, Artificial Sequence
  Description of Artificial Sequence: Synthetic polypeptide
  XENP020745 9C6_H0L2_anti-BTLA_IgG1_PVA_/S267K Light Chain
SIVMTQSPLSLPVTPGEPASISCRASQSVSNDVAWYLQKPGQSPQLLIYYASNRYTGVPDRFTGSGYGTDFTLKISRVEAEDVGVYFCQQDYSSPTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 25737 - protein, 106 aa, Artificial Sequence
  Description of Artificial Sequence: Synthetic polypeptide
  VL of XENP020745
SIVMTQSPLSLPVTPGEPASISCRASQSVSNDVAWYLQKPGQSPQLLIYYASNRYTGVPDRFTGSGYGTDFTLKISRVEAEDVGVYFCQQDYSSPTFGGGTKLEIK

SEQ ID NO: 25738 - protein, 11 aa, Artificial Sequence
  Description of Artificial Sequence: Synthetic peptide
  XENP020745 vlCDR1
RASQSVSNDVA

SEQ ID NO: 25739 - protein, 7 aa, Artificial Sequence
  Description of Artificial Sequence: Synthetic peptide
  XENP020745 vlCDR2
YASNRYT

SEQ ID NO: 25740 - protein, 8 aa, Artificial Sequence
  Description of Artificial Sequence: Synthetic peptide
  XENP020745 vlCDR3
QQDYSSPT

SEQ ID NO: 25741 - protein, 447 aa, Artificial Sequence
  Description of Artificial Sequence: Synthetic polypeptide
  XENP020746 9C6_H1L0_anti-BTLA_IgG1_PVA_/S267K Heavy Chain
QVQLVQSGAEVKKPGASVKVSCKVSGFSLTGYGVNWVRQAPGQGLEWMGMIWIDGSTDYNSKFQGRVTMTKDNSKSTVYMELSSLRSEDTAVYYCARDRPDGRAMDYWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 25742 - protein, 118 aa, Artificial Sequence
  Description of Artificial Sequence: Synthetic polypeptide
  VH of XENP020746
QVQLVQSGAEVKKPGASVKVSCKVSGFSLTGYGVNWVRQAPGQGLEWMGMIWIDGSTDYNSKFQGRVTMTKDNSKSTVYMELSSLRSEDTAVYYCARDRPDGRAMDYWGQGTMVTVSS

SEQ ID NO: 25743 - protein, 5 aa, Artificial Sequence
  Description of Artificial Sequence: Synthetic peptide
  XENP020746 vhCDR1
GYGVN

SEQ ID NO: 25744 - protein, 16 aa, Artificial Sequence
  Description of Artificial Sequence: Synthetic peptide
  XENP020746 vhCDR2
MIWIDGSTDYNSKFQG

SEQ ID NO: 25745 - protein, 10 aa, Artificial Sequence
  Description of Artificial Sequence: Synthetic peptide
  XENP020746 vhCDR3
DRPDGRAMDY

SEQ ID NO: 25746 - protein, 213 aa, Artificial Sequence; identical to SEQ ID NO: 25616
  Description of Artificial Sequence: Synthetic polypeptide
  XENP020746 9C6_H1L0_anti-BTLA_IgG1_PVA_/S267K Light Chain

SEQ ID NO: 25747 - protein, 106 aa, Artificial Sequence; identical to SEQ ID NO: 25617
  Description of Artificial Sequence: Synthetic polypeptide
  VL of XENP020746

SEQ ID NO: 25748 - protein, 11 aa, Artificial Sequence
  Description of Artificial Sequence: Synthetic peptide
  XENP020746 vlCDR1
KASQSVSNDVA

SEQ ID NO: 25749 - protein, 7 aa, Artificial Sequence
  Description of Artificial Sequence: Synthetic peptide
  XENP020746 vlCDR2
YASNRYT

SEQ ID NO: 25750 - protein, 8 aa, Artificial Sequence
  Description of Artificial Sequence: Synthetic peptide
  XENP020746 vlCDR3
QQDYSSPT

SEQ ID NO: 25751 - protein, 447 aa, Artificial Sequence; identical to SEQ ID NO: 25741
  Description of Artificial Sequence: Synthetic polypeptide
  XENP020747 9C6_H1L1_anti-BTLA_IgG1_PVA_/S267K Heavy Chain

SEQ ID NO: 25752 - protein, 118 aa, Artificial Sequence; identical to SEQ ID NO: 25742
  Description of Artificial Sequence: Synthetic polypeptide
  VH of XENP020747

SEQ ID NO: 25753 - protein, 5 aa, Artificial Sequence
  Description of Artificial Sequence: Synthetic peptide
  XENP020747 vhCDR1
GYGVN

SEQ ID NO: 25754 - protein, 16 aa, Artificial Sequence
  Description of Artificial Sequence: Synthetic peptide
  XENP020747 vhCDR2
MIWIDGSTDYNSKFQG

SEQ ID NO: 25755 - protein, 10 aa, Artificial Sequence
  Description of Artificial Sequence: Synthetic peptide
  XENP020747 vhCDR3
DRPDGRAMDY

SEQ ID NO: 25756 - protein, 213 aa, Artificial Sequence; identical to SEQ ID NO: 3160
  Description of Artificial Sequence: Synthetic polypeptide
  XENP020747 9C6_H1L1_anti-BTLA_IgG1_PVA_/S267K Light Chain

SEQ ID NO: 25757 - protein, 106 aa, Artificial Sequence; identical to SEQ ID NO: 3161
  Description of Artificial Sequence: Synthetic polypeptide
  VL of XENP020747

SEQ ID NO: 25758 - protein, 11 aa, Artificial Sequence
  Description of Artificial Sequence: Synthetic peptide
  XENP020747 vlCDR1
KASQSVSNDVA

SEQ ID NO: 25759 - protein, 7 aa, Artificial Sequence
  Description of Artificial Sequence: Synthetic peptide
  XENP020747 vlCDR2
YASNRYT

SEQ ID NO: 25760 - protein, 8 aa, Artificial Sequence
  Description of Artificial Sequence: Synthetic peptide
  XENP020747 vlCDR3
QQDYSSPT

SEQ ID NO: 25761 - protein, 447 aa, Artificial Sequence; identical to SEQ ID NO: 25741
  Description of Artificial Sequence: Synthetic polypeptide
  XENP020748 9C6_H1L2_anti-BTLA_IgG1_PVA_/S267K Heavy Chain

SEQ ID NO: 25762 - protein, 118 aa, Artificial Sequence; identical to SEQ ID NO: 25742
  Description of Artificial Sequence: Synthetic polypeptide
  VH of XENP020748

SEQ ID NO: 25763 - protein, 5 aa, Artificial Sequence
  Description of Artificial Sequence: Synthetic peptide
  XENP020748 vhCDR1
GYGVN

SEQ ID NO: 25764 - protein, 16 aa, Artificial Sequence
  Description of Artificial Sequence: Synthetic peptide
  XENP020748 vhCDR2
MIWIDGSTDYNSKFQG

SEQ ID NO: 25765 - protein, 10 aa, Artificial Sequence
  Description of Artificial Sequence: Synthetic peptide
  XENP020748 vhCDR3
DRPDGRAMDY

SEQ ID NO: 25766 - protein, 213 aa, Artificial Sequence; identical to SEQ ID NO: 25736
  Description of Artificial Sequence: Synthetic polypeptide
  XENP020748 9C6_H1L2_anti-BTLA_IgG1_PVA_/S267K Light Chain

SEQ ID NO: 25767 - protein, 106 aa, Artificial Sequence; identical to SEQ ID NO: 25737
  Description of Artificial Sequence: Synthetic polypeptide
  VL of XENP020748

SEQ ID NO: 25768 - protein, 11 aa, Artificial Sequence
  Description of Artificial Sequence: Synthetic peptide
  XENP020748 vlCDR1
RASQSVSNDVA

SEQ ID NO: 25769 - protein, 7 aa, Artificial Sequence
  Description of Artificial Sequence: Synthetic peptide
  XENP020748 vlCDR2
YASNRYT

SEQ ID NO: 25770 - protein, 8 aa, Artificial Sequence
  Description of Artificial Sequence: Synthetic peptide
  XENP020748 vlCDR3
QQDYSSPT

SEQ ID NO: 25771 - protein, 447 aa, Artificial Sequence
  Description of Artificial Sequence: Synthetic polypeptide
  XENP020749 9C6_H2L0_anti-BTLA_IgG1_PVA_/S267K Heavy Chain
EVQLVESGGGLVQPGGSLRLSCAVSGFSLTGYGVNWVRQAPGKGLEWVSMIWIDGSTDYNPSVKGRFTISKDNSKSTVYLQMNSLRAEDTAVYYCARDRPDGRAMDYWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 25772 - protein, 118 aa, Artificial Sequence
  Description of Artificial Sequence: Synthetic polypeptide
  VH of XENP020749
EVQLVESGGGLVQPGGSLRLSCAVSGFSLTGYGVNWVRQAPGKGLEWVSMIWIDGSTDYNPSVKGRFTISKDNSKSTVYLQMNSLRAEDTAVYYCARDRPDGRAMDYWGQGTMVTVSS

SEQ ID NO: 25773 - protein, 5 aa, Artificial Sequence
  Description of Artificial Sequence: Synthetic peptide
  XENP020749 vhCDR1
GYGVN

SEQ ID NO: 25774 - protein, 16 aa, Artificial Sequence
  Description of Artificial Sequence: Synthetic peptide
  XENP020749 vhCDR2
MIWIDGSTDYNPSVKG

SEQ ID NO: 25775 - protein, 10 aa, Artificial Sequence
  Description of Artificial Sequence: Synthetic peptide
  XENP020749 vhCDR3
DRPDGRAMDY

SEQ ID NO: 25776 - protein, 213 aa, Artificial Sequence; identical to SEQ ID NO: 25616
  Description of Artificial Sequence: Synthetic polypeptide
  XENP020749 9C6_H2L0_anti-BTLA_IgG1_PVA_/S267K Light Chain

SEQ ID NO: 25777 - protein, 106 aa, Artificial Sequence; identical to SEQ ID NO: 25617
  Description of Artificial Sequence: Synthetic polypeptide
  VL of XENP020749

SEQ ID NO: 25778 - protein, 11 aa, Artificial Sequence
  Description of Artificial Sequence: Synthetic peptide
  XENP020749 vlCDR1
KASQSVSNDVA

SEQ ID NO: 25779 - protein, 7 aa, Artificial Sequence
  Description of Artificial Sequence: Synthetic peptide
  XENP020749 vlCDR2
YASNRYT

SEQ ID NO: 25780 - protein, 8 aa, Artificial Sequence
  Description of Artificial Sequence: Synthetic peptide
  XENP020749 vlCDR3
QQDYSSPT

SEQ ID NO: 25781 - protein, 447 aa, Artificial Sequence; identical to SEQ ID NO: 25771
  Description of Artificial Sequence: Synthetic polypeptide
  XENP020750 9C6_H2L1_anti-BTLA_IgG1_PVA_/S267K Heavy Chain

SEQ ID NO: 25782 - protein, 118 aa, Artificial Sequence; identical to SEQ ID NO: 25772
  Description of Artificial Sequence: Synthetic polypeptide
  VH of XENP020750

SEQ ID NO: 25783 - protein, 5 aa, Artificial Sequence
  Description of Artificial Sequence: Synthetic peptide
  XENP020750 vhCDR1
GYGVN

SEQ ID NO: 25784 - protein, 16 aa, Artificial Sequence
  Description of Artificial Sequence: Synthetic peptide
  XENP020750 vhCDR2
MIWIDGSTDYNPSVKG

SEQ ID NO: 25785 - protein, 10 aa, Artificial Sequence
  Description of Artificial Sequence: Synthetic peptide
  XENP020750 vhCDR3
DRPDGRAMDY

SEQ ID NO: 25786 - protein, 213 aa, Artificial Sequence; identical to SEQ ID NO: 3160
  Description of Artificial Sequence: Synthetic polypeptide
  XENP020750 9C6_H2L1_anti-BTLA_IgG1_PVA_/S267K Light Chain

SEQ ID NO: 25787 - protein, 106 aa, Artificial Sequence; identical to SEQ ID NO: 3161
  Description of Artificial Sequence: Synthetic polypeptide
  VL of XENP020750

SEQ ID NO: 25788 - protein, 11 aa, Artificial Sequence
  Description of Artificial Sequence: Synthetic peptide
  XENP020750 vlCDR1
KASQSVSNDVA

SEQ ID NO: 25789 - protein, 7 aa, Artificial Sequence
  Description of Artificial Sequence: Synthetic peptide
  XENP020750 vlCDR2
YASNRYT

SEQ ID NO: 25790 - protein, 8 aa, Artificial Sequence
  Description of Artificial Sequence: Synthetic peptide
  XENP020750 vlCDR3
QQDYSSPT

SEQ ID NO: 25791 - protein, 447 aa, Artificial Sequence; identical to SEQ ID NO: 25771
  Description of Artificial Sequence: Synthetic polypeptide
  XENP020751 9C6_H2L2_anti-BTLA_IgG1_PVA_/S267K Heavy Chain

SEQ ID NO: 25792 - protein, 118 aa, Artificial Sequence; identical to SEQ ID NO: 25772
  Description of Artificial Sequence: Synthetic polypeptide
  VH of XENP020751

SEQ ID NO: 25793 - protein, 5 aa, Artificial Sequence
  Description of Artificial Sequence: Synthetic peptide
  XENP020751 vhCDR1
GYGVN

SEQ ID NO: 25794 - protein, 16 aa, Artificial Sequence
  Description of Artificial Sequence: Synthetic peptide
  XENP020751 vhCDR2
MIWIDGSTDYNPSVKG

SEQ ID NO: 25795 - protein, 10 aa, Artificial Sequence
  Description of Artificial Sequence: Synthetic peptide
  XENP020751 vhCDR3
DRPDGRAMDY

SEQ ID NO: 25796 - protein, 213 aa, Artificial Sequence; identical to SEQ ID NO: 25736
  Description of Artificial Sequence: Synthetic polypeptide
  XENP020751 9C6_H2L2_anti-BTLA_IgG1_PVA_/S267K Light Chain

SEQ ID NO: 25797 - protein, 106 aa, Artificial Sequence; identical to SEQ ID NO: 25737
  Description of Artificial Sequence: Synthetic polypeptide
  VL of XENP020751

SEQ ID NO: 25798 - protein, 11 aa, Artificial Sequence
  Description of Artificial Sequence: Synthetic peptide
  XENP020751 vlCDR1
RASQSVSNDVA

SEQ ID NO: 25799 - protein, 7 aa, Artificial Sequence
  Description of Artificial Sequence: Synthetic peptide
  XENP020751 vlCDR2
YASNRYT

SEQ ID NO: 25800 - protein, 8 aa, Artificial Sequence
  Description of Artificial Sequence: Synthetic peptide
  XENP020751 vlCDR3
QQDYSSPT

SEQ ID NO: 25801 - protein, 447 aa, Artificial Sequence
  Description of Artificial Sequence: Synthetic polypeptide
  XENP020752 9C6_H3L0_anti-BTLA_IgG1_PVA_/S267K Heavy Chain
QVTLKESGPVLVKPTETLTLTCTVSGFSLTGYGVNWVRQPPGKGLEWLAMIWIDGSTDYNPSLKSRLTISKDNSKSQVVLTMTNMDPVDTATYYCARDRPDGRAMDYWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 25802 - protein, 118 aa, Artificial Sequence
  Description of Artificial Sequence: Synthetic polypeptide
  VH of XENP020752
QVTLKESGPVLVKPTETLTLTCTVSGFSLTGYGVNWVRQPPGKGLEWLAMIWIDGSTDYNPSLKSRLTISKDNSKSQVVLTMTNMDPVDTATYYCARDRPDGRAMDYWGQGTMVTVSS

SEQ ID NO: 25803 - protein, 5 aa, Artificial Sequence
  Description of Artificial Sequence: Synthetic peptide
  XENP020752 vhCDR1
GYGVN

SEQ ID NO: 25804 - protein, 16 aa, Artificial Sequence
  Description of Artificial Sequence: Synthetic peptide
  XENP020752 vhCDR2
MIWIDGSTDYNPSLKS

SEQ ID NO: 25805 - protein, 10 aa, Artificial Sequence
  Description of Artificial Sequence: Synthetic peptide
  XENP020752 vhCDR3
DRPDGRAMDY

SEQ ID NO: 25806 - protein, 213 aa, Artificial Sequence; identical to SEQ ID NO: 25616
  Description of Artificial Sequence: Synthetic polypeptide
  XENP020752 9C6_H3L0_anti-BTLA_IgG1_PVA_/S267K Light Chain

SEQ ID NO: 25807 - protein, 106 aa, Artificial Sequence; identical to SEQ ID NO: 25617
  Description of Artificial Sequence: Synthetic polypeptide
  VL of XENP020752

SEQ ID NO: 25808 - protein, 11 aa, Artificial Sequence
  Description of Artificial Sequence: Synthetic peptide
  XENP020752 vlCDR1
KASQSVSNDVA

SEQ ID NO: 25809 - protein, 7 aa, Artificial Sequence
  Description of Artificial Sequence: Synthetic peptide
  XENP020752 vlCDR2
YASNRYT

SEQ ID NO: 25810 - protein, 8 aa, Artificial Sequence
  Description of Artificial Sequence: Synthetic peptide
  XENP020752 vlCDR3
QQDYSSPT

SEQ ID NO: 25811 - protein, 447 aa, Artificial Sequence; identical to SEQ ID NO: 25801
  Description of Artificial Sequence: Synthetic polypeptide
  XENP020753 9C6_H3L1_anti-BTLA_IgG1_PVA_/S267K Heavy Chain

SEQ ID NO: 25812 - protein, 118 aa, Artificial Sequence; identical to SEQ ID NO: 25802
  Description of Artificial Sequence: Synthetic polypeptide
  VH of XENP020753

SEQ ID NO: 25813 - protein, 5 aa, Artificial Sequence
  Description of Artificial Sequence: Synthetic peptide
  XENP020753 vhCDR1
GYGVN

SEQ ID NO: 25814 - protein, 16 aa, Artificial Sequence
  Description of Artificial Sequence: Synthetic peptide
  XENP020753 vhCDR2
MIWIDGSTDYNPSLKS

SEQ ID NO: 25815 - protein, 10 aa, Artificial Sequence
  Description of Artificial Sequence: Synthetic peptide
  XENP020753 vhCDR3
DRPDGRAMDY

SEQ ID NO: 25816 - protein, 213 aa, Artificial Sequence; identical to SEQ ID NO: 3160
  Description of Artificial Sequence: Synthetic polypeptide
  XENP020753 9C6_H3L1_anti-BTLA_IgG1_PVA_/S267K Light Chain

SEQ ID NO: 25817 - protein, 106 aa, Artificial Sequence; identical to SEQ ID NO: 3161
  Description of Artificial Sequence: Synthetic polypeptide
  VL of XENP020753

SEQ ID NO: 25818 - protein, 11 aa, Artificial Sequence
  Description of Artificial Sequence: Synthetic peptide
  XENP020753 vlCDR1
KASQSVSNDVA

SEQ ID NO: 25819 - protein, 7 aa, Artificial Sequence
  Description of Artificial Sequence: Synthetic peptide
  XENP020753 vlCDR2
YASNRYT

SEQ ID NO: 25820 - protein, 8 aa, Artificial Sequence
  Description of Artificial Sequence: Synthetic peptide
  XENP020753 vlCDR3
QQDYSSPT

SEQ ID NO: 25821 - protein, 447 aa, Artificial Sequence; identical to SEQ ID NO: 25801
  Description of Artificial Sequence: Synthetic polypeptide
  XENP020754 9C6_H3L2_anti-BTLA_IgG1_PVA_/S267K Heavy Chain

SEQ ID NO: 25822 - protein, 118 aa, Artificial Sequence; identical to SEQ ID NO: 25802
  Description of Artificial Sequence: Synthetic polypeptide
  VH of XENP020754

SEQ ID NO: 25823 - protein, 5 aa, Artificial Sequence
  Description of Artificial Sequence: Synthetic peptide
  XENP020754 vhCDR1
GYGVN

SEQ ID NO: 25824 - protein, 16 aa, Artificial Sequence
  Description of Artificial Sequence: Synthetic peptide
  XENP020754 vhCDR2
MIWIDGSTDYNPSLKS

SEQ ID NO: 25825 - protein, 10 aa, Artificial Sequence
  Description of Artificial Sequence: Synthetic peptide
  XENP020754 vhCDR3
DRPDGRAMDY

SEQ ID NO: 25826 - protein, 213 aa, Artificial Sequence; identical to SEQ ID NO: 25736
  Description of Artificial Sequence: Synthetic polypeptide
  XENP020754 9C6_H3L2_anti-BTLA_IgG1_PVA_/S267K Light Chain

SEQ ID NO: 25827 - protein, 106 aa, Artificial Sequence; identical to SEQ ID NO: 25737
  Description of Artificial Sequence: Synthetic polypeptide
  VL of XENP020754

SEQ ID NO: 25828 - protein, 11 aa, Artificial Sequence
  Description of Artificial Sequence: Synthetic peptide
  XENP020754 vlCDR1
RASQSVSNDVA

SEQ ID NO: 25829 - protein, 7 aa, Artificial Sequence
  Description of Artificial Sequence: Synthetic peptide
  XENP020754 vlCDR2
YASNRYT

SEQ ID NO: 25830 - protein, 8 aa, Artificial Sequence
  Description of Artificial Sequence: Synthetic peptide
  XENP020754 vlCDR3
QQDYSSPT

SEQ ID NO: 25831 - protein, 443 aa, Artificial Sequence; identical to SEQ ID NO: 25651
  Description of Artificial Sequence: Synthetic polypeptide
  XENP020758 12E6_H0L1_anti-BTLA_IgG1_PVA_/S267K Heavy Chain

SEQ ID NO: 25832 - protein, 5 aa, Artificial Sequence
  Description of Artificial Sequence: Synthetic peptide
  XENP020758 vhCDR1
NYWIE

SEQ ID NO: 25833 - protein, 17 aa, Artificial Sequence
  Description of Artificial Sequence: Synthetic peptide
  XENP020758 vhCDR2
EILPGSGGTNYNEKFKG

SEQ ID NO: 25834 - protein, 5 aa, Artificial Sequence
  Description of Artificial Sequence: Synthetic peptide
  XENP020758 vhCDR3
PRYDL

SEQ ID NO: 25835 - protein, 219 aa, Artificial Sequence
  Description of Artificial Sequence: Synthetic polypeptide
  XENP020758 12E6_H0L1_anti-BTLA_IgG1_PVA_/S267K Light Chain
DVVLTQSPLSLPVTLGQPASISCRSSQSLLHSDGETYLNYFQQRPGQSPRRLIYLVSKRDSGVPDRFTGSGSGTDFTLKISRVEAEDVGVYYCWQGIHFPQTFGRGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 25836 - protein, 112 aa, Artificial Sequence
  Description of Artificial Sequence: Synthetic polypeptide
  VL of XENP020758
DVVLTQSPLSLPVTLGQPASISCRSSQSLLHSDGETYLNYFQQRPGQSPRRLIYLVSKRDSGVPDRFTGSGSGTDFTLKISRVEAEDVGVYYCWQGIHFPQTFGRGTKLEIK

SEQ ID NO: 25837 - protein, 16 aa, Artificial Sequence
  Description of Artificial Sequence: Synthetic peptide
  XENP020758 vlCDR1
RSSQSLLHSDGETYLN

SEQ ID NO: 25838 - protein, 7 aa, Artificial Sequence
  Description of Artificial Sequence: Synthetic peptide
  XENP020758 vlCDR2
LVSKRDS

SEQ ID NO: 25839 - protein, 9 aa, Artificial Sequence
  Description of Artificial Sequence: Synthetic peptide
  XENP020758 vlCDR3
WQGIHFPQT

SEQ ID NO: 25840 - protein, 443 aa, Artificial Sequence
  Description of Artificial Sequence: Synthetic polypeptide
  XENP020759 12E6_H1L0_anti-BTLA_IgG1_PVA_/S267K Heavy Chain
QVQLVQSGAEVKKPGASVKVSCKASGYTFSNYGIEWVRQAPGQGLEWMGEILPGSGGTNYNEKFQGRVTMTADTSINTAYMELSRLRSDDTAVYYCASPRYDLWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 25841 - protein, 114 aa, Artificial Sequence
  Description of Artificial Sequence: Synthetic polypeptide
  VH of XENP020759
QVQLVQSGAEVKKPGASVKVSCKASGYTFSNYGIEWVRQAPGQGLEWMGEILPGSGGTNYNEKFQGRVTMTADTSINTAYMELSRLRSDDTAVYYCASPRYDLWGQGTLVTVSS

SEQ ID NO: 25842 - protein, 5 aa, Artificial Sequence
  Description of Artificial Sequence: Synthetic peptide
  XENP020759 vhCDR1
NYGIE

SEQ ID NO: 25843 - protein, 17 aa, Artificial Sequence
  Description of Artificial Sequence: Synthetic peptide
  XENP020759 vhCDR2
EILPGSGGTNYNEKFQG

SEQ ID NO: 25844 - protein, 5 aa, Artificial Sequence
  Description of Artificial Sequence: Synthetic peptide
  XENP020759 vhCDR3
PRYDL

SEQ ID NO: 25845 - protein, 219 aa, Artificial Sequence; identical to SEQ ID NO: 25656
  Description of Artificial Sequence: Synthetic polypeptide
  XENP020759 12E6_H1L0_anti-BTLA_IgG1_PVA_/S267K Light Chain

SEQ ID NO: 25846 - protein, 112 aa, Artificial Sequence; identical to SEQ ID NO: 25657
  Description of Artificial Sequence: Synthetic polypeptide
  VL of XENP020759

SEQ ID NO: 25847 - protein, 16 aa, Artificial Sequence
  Description of Artificial Sequence: Synthetic peptide
  XENP020759 vlCDR1
KSSQSLLHSDGETYLN

SEQ ID NO: 25848 - protein, 7 aa, Artificial Sequence
  Description of Artificial Sequence: Synthetic peptide
  XENP020759 vlCDR2
LVSKRDS

SEQ ID NO: 25849 - protein, 9 aa, Artificial Sequence
  Description of Artificial Sequence: Synthetic peptide
  XENP020759 vlCDR3
WQGIHFPQT

SEQ ID NO: 25850 - protein, 443 aa, Artificial Sequence; identical to SEQ ID NO: 25840
  Description of Artificial Sequence: Synthetic polypeptide
  XENP020760 12E6_H1L1_anti-BTLA_IgG1_PVA_/S267K Heavy Chain

SEQ ID NO: 25851 - protein, 114 aa, Artificial Sequence; identical to SEQ ID NO: 25841
  Description of Artificial Sequence: Synthetic polypeptide
  VH of XENP020760

SEQ ID NO: 25852 - protein, 5 aa, Artificial Sequence
  Description of Artificial Sequence: Synthetic peptide
  XENP020760 vhCDR1
NYGIE

SEQ ID NO: 25853 - protein, 17 aa, Artificial Sequence
  Description of Artificial Sequence: Synthetic peptide
  XENP020760 vhCDR2
EILPGSGGTNYNEKFQG

SEQ ID NO: 25854 - protein, 5 aa, Artificial Sequence
  Description of Artificial Sequence: Synthetic peptide
  XENP020760 vhCDR3
PRYDL

SEQ ID NO: 25855 - protein, 219 aa, Artificial Sequence; identical to SEQ ID NO: 25835
  Description of Artificial Sequence: Synthetic polypeptide
  XENP020760 12E6_H1L1_anti-BTLA_IgG1_PVA_/S267K Light Chain

SEQ ID NO: 25856 - protein, 112 aa, Artificial Sequence; identical to SEQ ID NO: 25836
  Description of Artificial Sequence: Synthetic polypeptide
  VL of XENP020760

SEQ ID NO: 25857 - protein, 16 aa, Artificial Sequence
  Description of Artificial Sequence: Synthetic peptide
  XENP020760 vlCDR1
RSSQSLLHSDGETYLN

SEQ ID NO: 25858 - protein, 7 aa, Artificial Sequence
  Description of Artificial Sequence: Synthetic peptide
  XENP020760 vlCDR2
LVSKRDS

SEQ ID NO: 25859 - protein, 9 aa, Artificial Sequence
  Description of Artificial Sequence: Synthetic peptide
  XENP020760 vlCDR3
WQGIHFPQT

SEQ ID NO: 25860 - protein, 443 aa, Artificial Sequence
  Description of Artificial Sequence: Synthetic polypeptide
  XENP020761 12E6_H2L0_anti-BTLA_IgG1_PVA_/S267K Heavy Chain
EVQLLESGGGLVQPGGSLRLSCAASGYTFSNYGIEWVRQAPGKGLEWVSEILPGSGGTNYNPSVKGRFTISADTSKNTAYLQMNSLRAEDTAVYYCASPRYDLWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 25861 - protein, 114 aa, Artificial Sequence
  Description of Artificial Sequence: Synthetic polypeptide
  VH of XENP020761
EVQLLESGGGLVQPGGSLRLSCAASGYTFSNYGIEWVRQAPGKGLEWVSEILPGSGGTNYNPSVKGRFTISADTSKNTAYLQMNSLRAEDTAVYYCASPRYDLWGQGTLVTVSS

SEQ ID NO: 25862 - protein, 5 aa, Artificial Sequence
  Description of Artificial Sequence: Synthetic peptide
  XENP020761 vhCDR1
NYGIE

SEQ ID NO: 25863 - protein, 17 aa, Artificial Sequence
  Description of Artificial Sequence: Synthetic peptide
  XENP020761 vhCDR2
EILPGSGGTNYNPSVKG

SEQ ID NO: 25864 - protein, 5 aa, Artificial Sequence
  Description of Artificial Sequence: Synthetic peptide
  XENP020761 vhCDR3
PRYDL

SEQ ID NO: 25865 - protein, 219 aa, Artificial Sequence; identical to SEQ ID NO: 25656
  Description of Artificial Sequence: Synthetic polypeptide
  XENP020761 12E6_H2L0_anti-BTLA_IgG1_PVA_/S267K Light Chain

SEQ ID NO: 25866 - protein, 112 aa, Artificial Sequence; identical to SEQ ID NO: 25657
  Description of Artificial Sequence: Synthetic polypeptide
  VL of XENP020761

SEQ ID NO: 25867 - protein, 16 aa, Artificial Sequence
  Description of Artificial Sequence: Synthetic peptide
  XENP020761 vlCDR1
KSSQSLLHSDGETYLN

SEQ ID NO: 25868 - protein, 7 aa, Artificial Sequence
  Description of Artificial Sequence: Synthetic peptide
  XENP020761 vlCDR2
LVSKRDS

SEQ ID NO: 25869 - protein, 9 aa, Artificial Sequence
  Description of Artificial Sequence: Synthetic peptide
  XENP020761 vlCDR3
WQGIHFPQT

SEQ ID NO: 25870 - protein, 443 aa, Artificial Sequence; identical to SEQ ID NO: 25860
  Description of Artificial Sequence: Synthetic polypeptide
  XENP020762 12E6_H2L1_anti-BTLA_IgG1_PVA_/S267K Heavy Chain

SEQ ID NO: 25871 - protein, 114 aa, Artificial Sequence; identical to SEQ ID NO: 25861
  Description of Artificial Sequence: Synthetic polypeptide
  VH of XENP020762

SEQ ID NO: 25872 - protein, 5 aa, Artificial Sequence
  Description of Artificial Sequence: Synthetic peptide
  XENP020762 vhCDR1
NYGIE

SEQ ID NO: 25873 - protein, 17 aa, Artificial Sequence
  Description of Artificial Sequence: Synthetic peptide
  XENP020762 vhCDR2
EILPGSGGTNYNPSVKG

SEQ ID NO: 25874 - protein, 5 aa, Artificial Sequence
  Description of Artificial Sequence: Synthetic peptide
  XENP020762 vhCDR3
PRYDL

SEQ ID NO: 25875 - protein, 219 aa, Artificial Sequence; identical to SEQ ID NO: 25835
  Description of Artificial Sequence: Synthetic polypeptide
  XENP020762 12E6_H2L1_anti-BTLA_IgG1_PVA_/S267K Light Chain

SEQ ID NO: 25876 - protein, 112 aa, Artificial Sequence; identical to SEQ ID NO: 25836
  Description of Artificial Sequence: Synthetic polypeptide
  VL of XENP020762

SEQ ID NO: 25877 - protein, 16 aa, Artificial Sequence
  Description of Artificial Sequence: Synthetic peptide
  XENP020762 vlCDR1
RSSQSLLHSDGETYLN

SEQ ID NO: 25878 - protein, 7 aa, Artificial Sequence
  Description of Artificial Sequence: Synthetic peptide
  XENP020762 vlCDR2
LVSKRDS

SEQ ID NO: 25879 - protein, 9 aa, Artificial Sequence
  Description of Artificial Sequence: Synthetic peptide
  XENP020762 vlCDR3
WQGIHFPQT

SEQ ID NO: 25880 - protein, 447 aa, Artificial Sequence
  Description of Artificial Sequence: Synthetic polypeptide
  XENP020872 9C6_H1.1_L1_anti-BTLA_IgG1_PVA_/S267K Heavy Chain
QVQLKESGAEVKKPGASVKVSCKVSGFSLTGYGVNWVRQAPGQGLEWMGMIWIDGSTDYNSKFQGRVTMTKDNSKSTVYMELSSLRSEDTAVYYCARDRPDGRAMDYWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 25881 - protein, 118 aa, Artificial Sequence; identical to SEQ ID NO: 3146
  Description of Artificial Sequence: Synthetic polypeptide
  VH of XENP020872

SEQ ID NO: 25882 - protein, 5 aa, Artificial Sequence
  Description of Artificial Sequence: Synthetic peptide
  XENP020872 vhCDR1
GYGVN

SEQ ID NO: 25883 - protein, 16 aa, Artificial Sequence
  Description of Artificial Sequence: Synthetic peptide
  XENP020872 vhCDR2
MIWIDGSTDYNSKFQG

SEQ ID NO: 25884 - protein, 10 aa, Artificial Sequence
  Description of Artificial Sequence: Synthetic peptide
  XENP020872 vhCDR3
DRPDGRAMDY

SEQ ID NO: 25885 - protein, 213 aa, Artificial Sequence; identical to SEQ ID NO: 3160
  Description of Artificial Sequence: Synthetic polypeptide
  XENP020872 9C6_H1.1_L1_anti-BTLA_IgG1_PVA_/S267K Light Chain

SEQ ID NO: 25886 - protein, 106 aa, Artificial Sequence; identical to SEQ ID NO: 3161
  Description of Artificial Sequence: Synthetic polypeptide
  VL of XENP020872

SEQ ID NO: 25887 - protein, 11 aa, Artificial Sequence
  Description of Artificial Sequence: Synthetic peptide
  XENP020872 vlCDR1
KASQSVSNDVA

SEQ ID NO: 25888 - protein, 7 aa, Artificial Sequence
  Description of Artificial Sequence: Synthetic peptide
  XENP020872 vlCDR2
YASNRYT

SEQ ID NO: 25889 - protein, 8 aa, Artificial Sequence
  Description of Artificial Sequence: Synthetic peptide
  XENP020872 vlCDR3
QQDYSSPT

SEQ ID NO: 25890 - protein, 447 aa, Artificial Sequence
  Description of Artificial Sequence: Synthetic polypeptide
  XENP020873 9C6_H1.2_L1_anti-BTLA_IgG1_PVA_/S267K Heavy Chain
QVQLVQSGPGLVAPGASVKVSCKVSGFSLTGYGVNWVRQAPGQGLEWMGMIWIDGSTDYNSKFQGRVTMTKDNSKSTVYMELSSLRSEDTAVYYCARDRPDGRAMDYWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 25891 - protein, 118 aa, Artificial Sequence
  Description of Artificial Sequence: Synthetic polypeptide
  VH of XENP020873
QVQLVQSGPGLVAPGASVKVSCKVSGFSLTGYGVNWVRQAPGQGLEWMGMIWIDGSTDYNSKFQGRVTMTKDNSKSTVYMELSSLRSEDTAVYYCARDRPDGRAMDYWGQGTMVTVSS

SEQ ID NO: 25892 - protein, 5 aa, Artificial Sequence
  Description of Artificial Sequence: Synthetic peptide
  XENP020873 vhCDR1
GYGVN

SEQ ID NO: 25893 - protein, 16 aa, Artificial Sequence
  Description of Artificial Sequence: Synthetic peptide
  XENP020873 vhCDR2
MIWIDGSTDYNSKFQG

SEQ ID NO: 25894 - protein, 10 aa, Artificial Sequence
  Description of Artificial Sequence: Synthetic peptide
  XENP020873 vhCDR3
DRPDGRAMDY

SEQ ID NO: 25895 - protein, 213 aa, Artificial Sequence; identical to SEQ ID NO: 3160
  Description of Artificial Sequence: Synthetic polypeptide
  XENP020873 9C6_H1.2_L1_anti-BTLA_IgG1_PVA_/S267K Light Chain

SEQ ID NO: 25896 - protein, 106 aa, Artificial Sequence; identical to SEQ ID NO: 3161
  Description of Artificial Sequence: Synthetic polypeptide
  VL of XENP020873

SEQ ID NO: 25897 - protein, 11 aa, Artificial Sequence
  Description of Artificial Sequence: Synthetic peptide
  XENP020873 vlCDR1
KASQSVSNDVA

SEQ ID NO: 25898 - protein, 7 aa, Artificial Sequence
  Description of Artificial Sequence: Synthetic peptide
  XENP020873 vlCDR2
YASNRYT

SEQ ID NO: 25899 - protein, 8 aa, Artificial Sequence
  Description of Artificial Sequence: Synthetic peptide
  XENP020873 vlCDR3
QQDYSSPT

SEQ ID NO: 25900 - protein, 447 aa, Artificial Sequence
  Description of Artificial Sequence: Synthetic polypeptide
  XENP020874 9C6_H1.3_L1_anti-BTLA_IgG1_PVA_/S267K Heavy Chain
QVQLVQSGAEVKKPSQSVKVSCKVSGFSLTGYGVNWVRQAPGQGLEWMGMIWIDGSTDYNSKFQGRVTMTKDNSKSTVYMELSSLRSEDTAVYYCARDRPDGRAMDYWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 25901 - protein, 118 aa, Artificial Sequence
  Description of Artificial Sequence: Synthetic polypeptide
  VH of XENP020874
QVQLVQSGAEVKKPSQSVKVSCKVSGFSLTGYGVNWVRQAPGQGLEWMGMIWIDGSTDYNSKFQGRVTMTKDNSKSTVYMELSSLRSEDTAVYYCARDRPDGRAMDYWGQGTMVTVSS

SEQ ID NO: 25902 - protein, 5 aa, Artificial Sequence
  Description of Artificial Sequence: Synthetic peptide
  XENP020874 vhCDR1
GYGVN

SEQ ID NO: 25903 - protein, 16 aa, Artificial Sequence
  Description of Artificial Sequence: Synthetic peptide
  XENP020874 vhCDR2
MIWIDGSTDYNSKFQG

SEQ ID NO: 25904 - protein, 10 aa, Artificial Sequence
  Description of Artificial Sequence: Synthetic peptide
  XENP020874 vhCDR3
DRPDGRAMDY

SEQ ID NO: 25905 - protein, 213 aa, Artificial Sequence; identical to SEQ ID NO: 3160
  Description of Artificial Sequence: Synthetic polypeptide
  XENP020874 9C6_H1.3_L1_anti-BTLA_IgG1_PVA_/S267K Light Chain

SEQ ID NO: 25906 - protein, 106 aa, Artificial Sequence; identical to SEQ ID NO: 3161
  Description of Artificial Sequence: Synthetic polypeptide
  VL of XENP020874

SEQ ID NO: 25907 - protein, 11 aa, Artificial Sequence
  Description of Artificial Sequence: Synthetic peptide
  XENP020874 vlCDR1
KASQSVSNDVA

SEQ ID NO: 25908 - protein, 7 aa, Artificial Sequence
  Description of Artificial Sequence: Synthetic peptide
  XENP020874 vlCDR2
YASNRYT

SEQ ID NO: 25909 - protein, 8 aa, Artificial Sequence
  Description of Artificial Sequence: Synthetic peptide
  XENP020874 vlCDR3
QQDYSSPT

SEQ ID NO: 25910 - protein, 447 aa, Artificial Sequence
  Description of Artificial Sequence: Synthetic polypeptide
  XENP020875 9C6_H1.4_L1_anti-BTLA_IgG1_PVA_/S267K Heavy Chain
QVQLVQSGAEVKKPGASLSITCKVSGFSLTGYGVNWVRQAPGQGLEWMGMIWIDGSTDYNSKFQGRVTMTKDNSKSTVYMELSSLRSEDTAVYYCARDRPDGRAMDYWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 25911 - protein, 118 aa, Artificial Sequence
  Description of Artificial Sequence: Synthetic polypeptide
  VH of XENP020875
QVQLVQSGAEVKKPGASLSITCKVSGFSLTGYGVNWVRQAPGQGLEWMGMIWIDGSTDYNSKFQGRVTMTKDNSKSTVYMELSSLRSEDTAVYYCARDRPDGRAMDYWGQGTMVTVSS

SEQ ID NO: 25912 - protein, 5 aa, Artificial Sequence
  Description of Artificial Sequence: Synthetic peptide
  XENP020875 vhCDR1
GYGVN

SEQ ID NO: 25913 - protein, 16 aa, Artificial Sequence
  Description of Artificial Sequence: Synthetic peptide
  XENP020875 vhCDR2
MIWIDGSTDYNSKFQG

SEQ ID NO: 25914 - protein, 10 aa, Artificial Sequence
  Description of Artificial Sequence: Synthetic peptide
  XENP020875 vhCDR3
DRPDGRAMDY

SEQ ID NO: 25915 - protein, 213 aa, Artificial Sequence; identical to SEQ ID NO: 3160
  Description of Artificial Sequence: Synthetic polypeptide
  XENP020875 9C6_H1.4_L1_anti-BTLA_IgG1_PVA_/S267K Light Chain

SEQ ID NO: 25916 - protein, 106 aa, Artificial Sequence; identical to SEQ ID NO: 3161
  Description of Artificial Sequence: Synthetic polypeptide
  VL of XENP020875

SEQ ID NO: 25917 - protein, 11 aa, Artificial Sequence
  Description of Artificial Sequence: Synthetic peptide
  XENP020875 vlCDR1
KASQSVSNDVA

SEQ ID NO: 25918 - protein, 7 aa, Artificial Sequence
  Description of Artificial Sequence: Synthetic peptide
  XENP020875 vlCDR2
YASNRYT

SEQ ID NO: 25919 - protein, 8 aa, Artificial Sequence
  Description of Artificial Sequence: Synthetic peptide
  XENP020875 vlCDR3
QQDYSSPT

SEQ ID NO: 25920 - protein, 447 aa, Artificial Sequence
  Description of Artificial Sequence: Synthetic polypeptide
  XENP020876 9C6_H1.5_L1_anti-BTLA_IgG1_PVA_/S267K Heavy Chain
QVQLVQSGAEVKKPGASVKVSCTVSGFSLTGYGVNWVRQAPGQGLEWMGMIWIDGSTDYNSKFQGRVTMTKDNSKSTVYMELSSLRSEDTAVYYCARDRPDGRAMDYWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 25921 - protein, 118 aa, Artificial Sequence
  Description of Artificial Sequence: Synthetic polypeptide
  VH of XENP020876
QVQLVQSGAEVKKPGASVKVSCTVSGFSLTGYGVNWVRQAPGQGLEWMGMIWIDGSTDYNSKFQGRVTMTKDNSKSTVYMELSSLRSEDTAVYYCARDRPDGRAMDYWGQGTMVTVSS

SEQ ID NO: 25922 - protein, 5 aa, Artificial Sequence
  Description of Artificial Sequence: Synthetic peptide
  XENP020876 vhCDR1
GYGVN

SEQ ID NO: 25923 - protein, 16 aa, Artificial Sequence
  Description of Artificial Sequence: Synthetic peptide
  XENP020876 vhCDR2
MIWIDGSTDYNSKFQG

SEQ ID NO: 25924 - protein, 10 aa, Artificial Sequence
  Description of Artificial Sequence: Synthetic peptide
  XENP020876 vhCDR3
DRPDGRAMDY

SEQ ID NO: 25925 - protein, 213 aa, Artificial Sequence; identical to SEQ ID NO: 3160
  Description of Artificial Sequence: Synthetic polypeptide
  XENP020876 9C6_H1.5_L1_anti-BTLA_IgG1_PVA_/S267K Light Chain

SEQ ID NO: 25926 - protein, 106 aa, Artificial Sequence; identical to SEQ ID NO: 3161
  Description of Artificial Sequence: Synthetic polypeptide
  VL of XENP020876

SEQ ID NO: 25927 - protein, 11 aa, Artificial Sequence
  Description of Artificial Sequence: Synthetic peptide
  XENP020876 vlCDR1
KASQSVSNDVA

SEQ ID NO: 25928 - protein, 7 aa, Artificial Sequence
  Description of Artificial Sequence: Synthetic peptide
  XENP020876 vlCDR2
YASNRYT

SEQ ID NO: 25929 - protein, 8 aa, Artificial Sequence
  Description of Artificial Sequence: Synthetic peptide
  XENP020876 vlCDR3
QQDYSSPT

SEQ ID NO: 25930 - protein, 447 aa, Artificial Sequence
  Description of Artificial Sequence: Synthetic polypeptide
  XENP020877 9C6_H1.6_L1_anti-BTLA_IgG1_PVA_/S267K Heavy Chain
QVQLVQSGAEVKKPGASVKVSCKVSGFSLTGYGVNWVRQPPGKGLEWMGMIWIDGSTDYNSKFQGRVTMTKDNSKSTVYMELSSLRSEDTAVYYCARDRPDGRAMDYWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 25931 - protein, 118 aa, Artificial Sequence
  Description of Artificial Sequence: Synthetic polypeptide
  VH of XENP020877
QVQLVQSGAEVKKPGASVKVSCKVSGFSLTGYGVNWVRQPPGKGLEWMGMIWIDGSTDYNSKFQGRVTMTKDNSKSTVYMELSSLRSEDTAVYYCARDRPDGRAMDYWGQGTMVTVSS

SEQ ID NO: 25932 - protein, 5 aa, Artificial Sequence
  Description of Artificial Sequence: Synthetic peptide
  XENP020877 vhCDR1
GYGVN

SEQ ID NO: 25933 - protein, 16 aa, Artificial Sequence
  Description of Artificial Sequence: Synthetic peptide
  XENP020877 vhCDR2
MIWIDGSTDYNSKFQG

SEQ ID NO: 25934 - protein, 10 aa, Artificial Sequence
  Description of Artificial Sequence: Synthetic peptide
  XENP020877 vhCDR3
DRPDGRAMDY

SEQ ID NO: 25935 - protein, 213 aa, Artificial Sequence; identical to SEQ ID NO: 3160
  Description of Artificial Sequence: Synthetic polypeptide
  XENP020877 9C6_H1.6_L1_anti-BTLA_IgG1_PVA_/S267K Light Chain

SEQ ID NO: 25936 - protein, 106 aa, Artificial Sequence; identical to SEQ ID NO: 3161
  Description of Artificial Sequence: Synthetic polypeptide
  VL of XENP020877

SEQ ID NO: 25937 - protein, 11 aa, Artificial Sequence
  Description of Artificial Sequence: Synthetic peptide
  XENP020877 vlCDR1
KASQSVSNDVA

SEQ ID NO: 25938 - protein, 7 aa, Artificial Sequence
  Description of Artificial Sequence: Synthetic peptide
  XENP020877 vlCDR2
YASNRYT

SEQ ID NO: 25939 - protein, 8 aa, Artificial Sequence
  Description of Artificial Sequence: Synthetic peptide
  XENP020877 vlCDR3
QQDYSSPT

SEQ ID NO: 25940 - protein, 447 aa, Artificial Sequence
  Description of Artificial Sequence: Synthetic polypeptide
  XENP020878 9C6_H1.7_L1_anti-BTLA_IgG1_PVA_/S267K Heavy Chain
QVQLVQSGAEVKKPGASVKVSCKVSGFSLTGYGVNWVRQAPGQGLEWLGMIWIDGSTDYNSKFQGRVTMTKDNSKSTVYMELSSLRSEDTAVYYCARDRPDGRAMDYWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 25941 - protein, 118 aa, Artificial Sequence
  Description of Artificial Sequence: Synthetic polypeptide
  VH of XENP020878
QVQLVQSGAEVKKPGASVKVSCKVSGFSLTGYGVNWVRQAPGQGLEWLGMIWIDGSTDYNSKFQGRVTMTKDNSKSTVYMELSSLRSEDTAVYYCARDRPDGRAMDYWGQGTMVTVSS

SEQ ID NO: 25942 - protein, 5 aa, Artificial Sequence
  Description of Artificial Sequence: Synthetic peptide
  XENP020878 vhCDR1
GYGVN

SEQ ID NO: 25943 - protein, 16 aa, Artificial Sequence
  Description of Artificial Sequence: Synthetic peptide
  XENP020878 vhCDR2
MIWIDGSTDYNSKFQG

SEQ ID NO: 25944 - protein, 10 aa, Artificial Sequence
  Description of Artificial Sequence: Synthetic peptide
  XENP020878 vhCDR3
DRPDGRAMDY

SEQ ID NO: 25945 - protein, 213 aa, Artificial Sequence; identical to SEQ ID NO: 3160
  Description of Artificial Sequence: Synthetic polypeptide
  XENP020878 9C6_H1.7_L1_anti-BTLA_IgG1_PVA_/S267K Light Chain

SEQ ID NO: 25946 - protein, 106 aa, Artificial Sequence; identical to SEQ ID NO: 3161
  Description of Artificial Sequence: Synthetic polypeptide
  VL of XENP020878

SEQ ID NO: 25947 - protein, 11 aa, Artificial Sequence
  Description of Artificial Sequence: Synthetic peptide
  XENP020878 vlCDR1
KASQSVSNDVA

SEQ ID NO: 25948 - protein, 7 aa, Artificial Sequence
  Description of Artificial Sequence: Synthetic peptide
  XENP020878 vlCDR2
YASNRYT

SEQ ID NO: 25949 - protein, 8 aa, Artificial Sequence
  Description of Artificial Sequence: Synthetic peptide
  XENP020878 vlCDR3
QQDYSSPT

SEQ ID NO: 25950 - protein, 447 aa, Artificial Sequence
  Description of Artificial Sequence: Synthetic polypeptide
  XENP020879 9C6_H1.8_L1_anti-BTLA_IgG1_PVA_/S267K Heavy Chain
QVQLVQSGAEVKKPGASVKVSCKVSGFSLTGYGVNWVRQAPGQGLEWMGMIWIDGSTDYNSAFQGRVTMTKDNSKSTVYMELSSLRSEDTAVYYCARDRPDGRAMDYWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 25951 - protein, 118 aa, Artificial Sequence
  Description of Artificial Sequence: Synthetic polypeptide
  VH of XENP020879
QVQLVQSGAEVKKPGASVKVSCKVSGFSLTGYGVNWVRQAPGQGLEWMGMIWIDGSTDYNSAFQGRVTMTKDNSKSTVYMELSSLRSEDTAVYYCARDRPDGRAMDYWGQGTMVTVSS

SEQ ID NO: 25952 - protein, 5 aa, Artificial Sequence
  Description of Artificial Sequence: Synthetic peptide
  XENP020879 vhCDR1
GYGVN

SEQ ID NO: 25953 - protein, 16 aa, Artificial Sequence
  Description of Artificial Sequence: Synthetic peptide
  XENP020879 vhCDR2
MIWIDGSTDYNSAFQG

SEQ ID NO: 25954 - protein, 10 aa, Artificial Sequence
  Description of Artificial Sequence: Synthetic peptide
  XENP020879 vhCDR3
DRPDGRAMDY

SEQ ID NO: 25955 - protein, 213 aa, Artificial Sequence; identical to SEQ ID NO: 3160
  Description of Artificial Sequence: Synthetic polypeptide
  XENP020879 9C6_H1.8_L1_anti-BTLA_IgG1_PVA_/S267K Light Chain

SEQ ID NO: 25956 - protein, 106 aa, Artificial Sequence; identical to SEQ ID NO: 3161
  Description of Artificial Sequence: Synthetic polypeptide
  VL of XENP020879

SEQ ID NO: 25957 - protein, 11 aa, Artificial Sequence
  Description of Artificial Sequence: Synthetic peptide
  XENP020879 vlCDR1
KASQSVSNDVA

SEQ ID NO: 25958 - protein, 7 aa, Artificial Sequence
  Description of Artificial Sequence: Synthetic peptide
  XENP020879 vlCDR2
YASNRYT

SEQ ID NO: 25959 - protein, 8 aa, Artificial Sequence
  Description of Artificial Sequence: Synthetic peptide
  XENP020879 vlCDR3
QQDYSSPT

SEQ ID NO: 25960 - protein, 447 aa, Artificial Sequence
  Description of Artificial Sequence: Synthetic polypeptide
  XENP020880 9C6_H1.9_L1_anti-BTLA_IgG1_PVA_/S267K Heavy Chain
QVQLVQSGAEVKKPGASVKVSCKVSGFSLTGYGVNWVRQAPGQGLEWMGMIWIDGSTDYNSALKSRVTMTKDNSKSTVYMELSSLRSEDTAVYYCARDRPDGRAMDYWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 25961 - protein, 118 aa, Artificial Sequence
  Description of Artificial Sequence: Synthetic polypeptide
  VH of XENP020880
QVQLVQSGAEVKKPGASVKVSCKVSGFSLTGYGVNWVRQAPGQGLEWMGMIWIDGSTDYNSALKSRVTMTKDNSKSTVYMELSSLRSEDTAVYYCARDRPDGRAMDYWGQGTMVTVSS

SEQ ID NO: 25962 - protein, 5 aa, Artificial Sequence
  Description of Artificial Sequence: Synthetic peptide
  XENP020880 vhCDR1
GYGVN

SEQ ID NO: 25963 - protein, 16 aa, Artificial Sequence
  Description of Artificial Sequence: Synthetic peptide
  XENP020880 vhCDR2
MIWIDGSTDYNSALKS

SEQ ID NO: 25964 - protein, 10 aa, Artificial Sequence
  Description of Artificial Sequence: Synthetic peptide
  XENP020880 vhCDR3
DRPDGRAMDY

SEQ ID NO: 25965 - protein, 213 aa, Artificial Sequence; identical to SEQ ID NO: 3160
  Description of Artificial Sequence: Synthetic polypeptide
  XENP020880 9C6_H1.9_L1_anti-BTLA_IgG1_PVA_/S267K Light Chain

SEQ ID NO: 25966 - protein, 106 aa, Artificial Sequence; identical to SEQ ID NO: 3161
  Description of Artificial Sequence: Synthetic polypeptide
  VL of XENP020880

SEQ ID NO: 25967 - protein, 11 aa, Artificial Sequence
  Description of Artificial Sequence: Synthetic peptide
  XENP020880 vlCDR1
KASQSVSNDVA

SEQ ID NO: 25968 - protein, 7 aa, Artificial Sequence
  Description of Artificial Sequence: Synthetic peptide
  XENP020880 vlCDR2
YASNRYT

SEQ ID NO: 25969 - protein, 8 aa, Artificial Sequence
  Description of Artificial Sequence: Synthetic peptide
  XENP020880 vlCDR3
QQDYSSPT

SEQ ID NO: 25970 - protein, 447 aa, Artificial Sequence
  Description of Artificial Sequence: Synthetic polypeptide
  XENP020881 9C6_H1.10_L1_anti-BTLA_IgG1_PVA_/S267K Heavy Chain
QVQLVQSGAEVKKPGASVKVSCKVSGFSLTGYGVNWVRQAPGQGLEWMGMIWIDGSTDYNSKFKGRVTMTKDNSKSTVYMELSSLRSEDTAVYYCARDRPDGRAMDYWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 25971 - protein, 118 aa, Artificial Sequence
  Description of Artificial Sequence: Synthetic polypeptide
  VH of XENP020881
QVQLVQSGAEVKKPGASVKVSCKVSGFSLTGYGVNWVRQAPGQGLEWMGMIWIDGSTDYNSKFKGRVTMTKDNSKSTVYMELSSLRSEDTAVYYCARDRPDGRAMDYWGQGTMVTVSS

SEQ ID NO: 25972 - protein, 5 aa, Artificial Sequence
  Description of Artificial Sequence: Synthetic peptide
  XENP020881 vhCDR1
GYGVN

SEQ ID NO: 25973 - protein, 16 aa, Artificial Sequence
  Description of Artificial Sequence: Synthetic peptide
  XENP020881 vhCDR2
MIWIDGSTDYNSKFKG

SEQ ID NO: 25974 - protein, 10 aa, Artificial Sequence
  Description of Artificial Sequence: Synthetic peptide
  XENP020881 vhCDR3
DRPDGRAMDY

SEQ ID NO: 25975 - protein, 213 aa, Artificial Sequence; identical to SEQ ID NO: 3160
  Description of Artificial Sequence: Synthetic polypeptide
  XENP020881 9C6_H1.10_L1_anti-BTLA_IgG1_PVA_/S267K Light Chain

SEQ ID NO: 25976 - protein, 106 aa, Artificial Sequence; identical to SEQ ID NO: 3161
  Description of Artificial Sequence: Synthetic polypeptide
  VL of XENP020881

SEQ ID NO: 25977 - protein, 11 aa, Artificial Sequence
  Description of Artificial Sequence: Synthetic peptide
  XENP020881 vlCDR1
KASQSVSNDVA

SEQ ID NO: 25978 - protein, 7 aa, Artificial Sequence
  Description of Artificial Sequence: Synthetic peptide
  XENP020881 vlCDR2
YASNRYT

SEQ ID NO: 25979 - protein, 8 aa, Artificial Sequence
  Description of Artificial Sequence: Synthetic peptide
  XENP020881 vlCDR3
QQDYSSPT

SEQ ID NO: 25980 - protein, 447 aa, Artificial Sequence
  Description of Artificial Sequence: Synthetic polypeptide
  XENP020882 9C6_H1.11_L1_anti-BTLA_IgG1_PVA_/S267K Heavy Chain
QVQLVQSGAEVKKPGASVKVSCKVSGFSLTGYGVNWVRQAPGQGLEWMGMIWIDGSTDYNSKFQGRLSINKDNSKSTVYMELSSLRSEDTAVYYCARDRPDGRAMDYWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 25981 - protein, 118 aa, Artificial Sequence
  Description of Artificial Sequence: Synthetic polypeptide
  VH of XENP020882
QVQLVQSGAEVKKPGASVKVSCKVSGFSLTGYGVNWVRQAPGQGLEWMGMIWIDGSTDYNSKFQGRLSINKDNSKSTVYMELSSLRSEDTAVYYCARDRPDGRAMDYWGQGTMVTVSS

SEQ ID NO: 25982 - protein, 5 aa, Artificial Sequence
  Description of Artificial Sequence: Synthetic peptide
  XENP020882 vhCDR1
GYGVN

SEQ ID NO: 25983 - protein, 16 aa, Artificial Sequence
  Description of Artificial Sequence: Synthetic peptide
  XENP020882 vhCDR2
MIWIDGSTDYNSKFQG

SEQ ID NO: 25984 - protein, 10 aa, Artificial Sequence
  Description of Artificial Sequence: Synthetic peptide
  XENP020882 vhCDR3
DRPDGRAMDY

SEQ ID NO: 25985 - protein, 213 aa, Artificial Sequence; identical to SEQ ID NO: 3160
  Description of Artificial Sequence: Synthetic polypeptide
  XENP020882 9C6_H1.11_L1_anti-BTLA_IgG1_PVA_/S267K Light Chain

SEQ ID NO: 25986 - protein, 106 aa, Artificial Sequence; identical to SEQ ID NO: 3161
  Description of Artificial Sequence: Synthetic polypeptide
  VL of XENP020882

SEQ ID NO: 25987 - protein, 11 aa, Artificial Sequence
  Description of Artificial Sequence: Synthetic peptide
  XENP020882 vlCDR1
KASQSVSNDVA

SEQ ID NO: 25988 - protein, 7 aa, Artificial Sequence
  Description of Artificial Sequence: Synthetic peptide
  XENP020882 vlCDR2
YASNRYT

SEQ ID NO: 25989 - protein, 8 aa, Artificial Sequence
  Description of Artificial Sequence: Synthetic peptide
  XENP020882 vlCDR3
QQDYSSPT

SEQ ID NO: 25990 - protein, 447 aa, Artificial Sequence
  Description of Artificial Sequence: Synthetic polypeptide
  XENP020883 9C6_H1.12_L1_anti-BTLA_IgG1_PVA_/S267K Heavy Chain
QVQLVQSGAEVKKPGASVKVSCKVSGFSLTGYGVNWVRQAPGQGLEWMGMIWIDGSTDYNSKFQGRVTMTKDNSKSQVYMELSSLRSEDTAVYYCARDRPDGRAMDYWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 25991 - protein, 118 aa, Artificial Sequence
  Description of Artificial Sequence: Synthetic polypeptide
  VH of XENP020883
QVQLVQSGAEVKKPGASVKVSCKVSGFSLTGYGVNWVRQAPGQGLEWMGMIWIDGSTDYNSKFQGRVTMTKDNSKSQVYMELSSLRSEDTAVYYCARDRPDGRAMDYWGQGTMVTVSS

SEQ ID NO: 25992 - protein, 5 aa, Artificial Sequence
  Description of Artificial Sequence: Synthetic peptide
  XENP020883 vhCDR1
GYGVN

SEQ ID NO: 25993 - protein, 16 aa, Artificial Sequence
  Description of Artificial Sequence: Synthetic peptide
  XENP020883 vhCDR2
MIWIDGSTDYNSKFQG

SEQ ID NO: 25994 - protein, 10 aa, Artificial Sequence
  Description of Artificial Sequence: Synthetic peptide
  XENP020883 vhCDR3
DRPDGRAMDY

SEQ ID NO: 25995 - protein, 213 aa, Artificial Sequence; identical to SEQ ID NO: 3160
  Description of Artificial Sequence: Synthetic polypeptide
  XENP020883 9C6_H1.12_L1_anti-BTLA_IgG1_PVA_/S267K Light Chain

SEQ ID NO: 25996 - protein, 106 aa, Artificial Sequence; identical to SEQ ID NO: 3161
  Description of Artificial Sequence: Synthetic polypeptide
  VL of XENP020883

SEQ ID NO: 25997 - protein, 11 aa, Artificial Sequence
  Description of Artificial Sequence: Synthetic peptide
  XENP020883 vlCDR1
KASQSVSNDVA

SEQ ID NO: 25998 - protein, 7 aa, Artificial Sequence
  Description of Artificial Sequence: Synthetic peptide
  XENP020883 vlCDR2
YASNRYT

SEQ ID NO: 25999 - protein, 8 aa, Artificial Sequence
  Description of Artificial Sequence: Synthetic peptide
  XENP020883 vlCDR3
QQDYSSPT

SEQ ID NO: 26000 - protein, 447 aa, Artificial Sequence
  Description of Artificial Sequence: Synthetic polypeptide
  XENP020884 9C6_H1.13_L1_anti-BTLA_IgG1_PVA_/S267K Heavy Chain
QVQLVQSGAEVKKPGASVKVSCKVSGFSLTGYGVNWVRQAPGQGLEWMGMIWIDGSTDYNSKFQGRVTMTKDNSKSTVFLKMNSLRSEDTAVYYCARDRPDGRAMDYWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 26001 - protein, 118 aa, Artificial Sequence
  Description of Artificial Sequence: Synthetic polypeptide
  VH of XENP020884
QVQLVQSGAEVKKPGASVKVSCKVSGFSLTGYGVNWVRQAPGQGLEWMGMIWIDGSTDYNSKFQGRVTMTKDNSKSTVFLKMNSLRSEDTAVYYCARDRPDGRAMDYWGQGTMVTVSS

SEQ ID NO: 26002 - protein, 5 aa, Artificial Sequence
  Description of Artificial Sequence: Synthetic peptide
  XENP020884 vhCDR1
GYGVN

SEQ ID NO: 26003 - protein, 16 aa, Artificial Sequence
  Description of Artificial Sequence: Synthetic peptide
  XENP020884 vhCDR2
MIWIDGSTDYNSKFQG

SEQ ID NO: 26004 - protein, 10 aa, Artificial Sequence
  Description of Artificial Sequence: Synthetic peptide
  XENP020884 vhCDR3
DRPDGRAMDY

SEQ ID NO: 26005 - protein, 213 aa, Artificial Sequence; identical to SEQ ID NO: 3160
  Description of Artificial Sequence: Synthetic polypeptide
  XENP020884 9C6_H1.13_L1_anti-BTLA_IgG1_PVA_/S267K Light Chain

SEQ ID NO: 26006 - protein, 106 aa, Artificial Sequence; identical to SEQ ID NO: 3161
  Description of Artificial Sequence: Synthetic polypeptide
  VL of XENP020884

SEQ ID NO: 26007 - protein, 11 aa, Artificial Sequence
  Description of Artificial Sequence: Synthetic peptide
  XENP020884 vlCDR1
KASQSVSNDVA

SEQ ID NO: 26008 - protein, 7 aa, Artificial Sequence
  Description of Artificial Sequence: Synthetic peptide
  XENP020884 vlCDR2
YASNRYT

SEQ ID NO: 26009 - protein, 8 aa, Artificial Sequence
  Description of Artificial Sequence: Synthetic peptide
  XENP020884 vlCDR3
QQDYSSPT

SEQ ID NO: 26010 - protein, 447 aa, Artificial Sequence
  Description of Artificial Sequence: Synthetic polypeptide
  XENP020885 9C6_H1.14_L1_anti-BTLA_IgG1_PVA_/S267K Heavy Chain
QVQLVQSGAEVKKPGASVKVSCKVSGFSLTGYGVNWVRQAPGQGLEWMGMIWIDGSTDYNSKFQGRVTMTKDNSKSTVYMELSSLQTDDTAVYYCARDRPDGRAMDYWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 26011 - protein, 118 aa, Artificial Sequence
  Description of Artificial Sequence: Synthetic polypeptide
  VH of XENP020885
QVQLVQSGAEVKKPGASVKVSCKVSGFSLTGYGVNWVRQAPGQGLEWMGMIWIDGSTDYNSKFQGRVTMTKDNSKSTVYMELSSLQTDDTAVYYCARDRPDGRAMDYWGQGTMVTVSS

SEQ ID NO: 26012 - protein, 5 aa, Artificial Sequence
  Description of Artificial Sequence: Synthetic peptide
  XENP020885 vhCDR1
GYGVN

SEQ ID NO: 26013 - protein, 16 aa, Artificial Sequence
  Description of Artificial Sequence: Synthetic peptide
  XENP020885 vhCDR2
MIWIDGSTDYNSKFQG

SEQ ID NO: 26014 - protein, 10 aa, Artificial Sequence
  Description of Artificial Sequence: Synthetic peptide
  XENP020885 vhCDR3
DRPDGRAMDY

SEQ ID NO: 26015 - protein, 213 aa, Artificial Sequence; identical to SEQ ID NO: 3160
  Description of Artificial Sequence: Synthetic polypeptide
  XENP020885 9C6_H1.14_L1_anti-BTLA_IgG1_PVA_/S267K Light Chain

SEQ ID NO: 26016 - protein, 106 aa, Artificial Sequence; identical to SEQ ID NO: 3161
  Description of Artificial Sequence: Synthetic polypeptide
  VL of XENP020885

SEQ ID NO: 26017 - protein, 11 aa, Artificial Sequence
  Description of Artificial Sequence: Synthetic peptide
  XENP020885 vlCDR1
KASQSVSNDVA

SEQ ID NO: 26018 - protein, 7 aa, Artificial Sequence
  Description of Artificial Sequence: Synthetic peptide
  XENP020885 vlCDR2
YASNRYT

SEQ ID NO: 26019 - protein, 8 aa, Artificial Sequence
  Description of Artificial Sequence: Synthetic peptide
  XENP020885 vlCDR3
QQDYSSPT

SEQ ID NO: 26020 - protein, 447 aa, Artificial Sequence
  Description of Artificial Sequence: Synthetic polypeptide
  XENP020886 9C6_H1.15_L1_anti-BTLA_IgG1_PVA_/S267K Heavy Chain
QVQLVQSGAEVKKPGASVKVSCKVSGFSLTGYGVNWVRQAPGQGLEWMGMIWIDGSTDYNSKFQGRVTMTKDNSKSTVYMELSSLRSEDTARYYCARDRPDGRAMDYWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 26021 - protein, 118 aa, Artificial Sequence
  Description of Artificial Sequence: Synthetic polypeptide
  VH of XENP020886
QVQLVQSGAEVKKPGASVKVSCKVSGFSLTGYGVNWVRQAPGQGLEWMGMIWIDGSTDYNSKFQGRVTMTKDNSKSTVYMELSSLRSEDTARYYCARDRPDGRAMDYWGQGTMVTVSS

SEQ ID NO: 26022 - protein, 5 aa, Artificial Sequence
  Description of Artificial Sequence: Synthetic peptide
  XENP020886 vhCDR1
GYGVN

SEQ ID NO: 26023 - protein, 16 aa, Artificial Sequence
  Description of Artificial Sequence: Synthetic peptide
  XENP020886 vhCDR2
MIWIDGSTDYNSKFQG

SEQ ID NO: 26024 - protein, 10 aa, Artificial Sequence
  Description of Artificial Sequence: Synthetic peptide
  XENP020886 vhCDR3
DRPDGRAMDY

SEQ ID NO: 26025 - protein, 213 aa, Artificial Sequence; identical to SEQ ID NO: 3160
  Description of Artificial Sequence: Synthetic polypeptide
  XENP020886 9C6_H1.15_L1_anti-BTLA_IgG1_PVA_/S267K Light Chain

SEQ ID NO: 26026 - protein, 106 aa, Artificial Sequence; identical to SEQ ID NO: 3161
  Description of Artificial Sequence: Synthetic polypeptide
  VL of XENP020886

SEQ ID NO: 26027 - protein, 11 aa, Artificial Sequence
  Description of Artificial Sequence: Synthetic peptide
  XENP020886 vlCDR1
KASQSVSNDVA

SEQ ID NO: 26028 - protein, 7 aa, Artificial Sequence
  Description of Artificial Sequence: Synthetic peptide
  XENP020886 vlCDR2
YASNRYT

SEQ ID NO: 26029 - protein, 8 aa, Artificial Sequence
  Description of Artificial Sequence: Synthetic peptide
  XENP020886 vlCDR3
QQDYSSPT

SEQ ID NO: 26030 - protein, 447 aa, Artificial Sequence
  Description of Artificial Sequence: Synthetic polypeptide
  XENP020887 9C6_H1.16_L1_anti-BTLA_IgG1_PVA_/S267K Heavy Chain
QVQLVQSGAEVKKPGASVKVSCKVSGFSLTGYGVNWVRQAPGQGLEWMGMIWIDGSTDYNSKFQGRVTMTKDNSKSTVYMELSSLRSEDTAVYYCARDRPDGRAMDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 26031 - protein, 118 aa, Artificial Sequence
  Description of Artificial Sequence: Synthetic polypeptide
  VH of XENP020887
QVQLVQSGAEVKKPGASVKVSCKVSGFSLTGYGVNWVRQAPGQGLEWMGMIWIDGSTDYNSKFQGRVTMTKDNSKSTVYMELSSLRSEDTAVYYCARDRPDGRAMDYWGQGTSVTVSS

SEQ ID NO: 26032 - protein, 5 aa, Artificial Sequence
  Description of Artificial Sequence: Synthetic peptide
  XENP020887 vhCDR1
GYGVN

SEQ ID NO: 26033 - protein, 16 aa, Artificial Sequence
  Description of Artificial Sequence: Synthetic peptide
  XENP020887 vhCDR2
MIWIDGSTDYNSKFQG

SEQ ID NO: 26034 - protein, 10 aa, Artificial Sequence
  Description of Artificial Sequence: Synthetic peptide
  XENP020887 vhCDR3
DRPDGRAMDY

SEQ ID NO: 26035 - protein, 213 aa, Artificial Sequence; identical to SEQ ID NO: 3160
  Description of Artificial Sequence: Synthetic polypeptide
  XENP020887 9C6_H1.16_L1_anti-BTLA_IgG1_PVA_/S267K Light Chain

SEQ ID NO: 26036 - protein, 106 aa, Artificial Sequence; identical to SEQ ID NO: 3161
  Description of Artificial Sequence: Synthetic polypeptide
  VL of XENP020887

SEQ ID NO: 26037 - protein, 11 aa, Artificial Sequence
  Description of Artificial Sequence: Synthetic peptide
  XENP020887 vlCDR1
KASQSVSNDVA

SEQ ID NO: 26038 - protein, 7 aa, Artificial Sequence
  Description of Artificial Sequence: Synthetic peptide
  XENP020887 vlCDR2
YASNRYT

SEQ ID NO: 26039 - protein, 8 aa, Artificial Sequence
  Description of Artificial Sequence: Synthetic peptide
  XENP020887 vlCDR3
QQDYSSPT

SEQ ID NO: 26040 - protein, 447 aa, Artificial Sequence; identical to SEQ ID NO: 25741
  Description of Artificial Sequence: Synthetic polypeptide
  XENP020888 9C6_H1_L1.1_anti-BTLA_IgG1_PVA_/S267K Heavy Chain

SEQ ID NO: 26041 - protein, 118 aa, Artificial Sequence; identical to SEQ ID NO: 25742
  Description of Artificial Sequence: Synthetic polypeptide
  VH of XENP020888

SEQ ID NO: 26042 - protein, 5 aa, Artificial Sequence
  Description of Artificial Sequence: Synthetic peptide
  XENP020888 vhCDR1
GYGVN

SEQ ID NO: 26043 - protein, 16 aa, Artificial Sequence
  Description of Artificial Sequence: Synthetic peptide
  XENP020888 vhCDR2
MIWIDGSTDYNSKFQG

SEQ ID NO: 26044 - protein, 10 aa, Artificial Sequence
  Description of Artificial Sequence: Synthetic peptide
  XENP020888 vhCDR3
DRPDGRAMDY

SEQ ID NO: 26045 - protein, 213 aa, Artificial Sequence
  Description of Artificial Sequence: Synthetic polypeptide
  XENP020888 9C6_H1_L1.1_anti-BTLA_IgG1_PVA_/S267K Light Chain
SIVMTQTPDSLAVSLGERATINCKASQSVSNDVAWYQQKPGQSPKLLIYYASNRYTGVPDRFTGSGYGTDFTLTISSLQAEDVAVYFCQQDYSSPTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 26046 - protein, 106 aa, Artificial Sequence
  Description of Artificial Sequence: Synthetic polypeptide
  VL of XENP020888
SIVMTQTPDSLAVSLGERATINCKASQSVSNDVAWYQQKPGQSPKLLIYYASNRYTGVPDRFTGSGYGTDFTLTISSLQAEDVAVYFCQQDYSSPTFGGGTKLEIK

SEQ ID NO: 26047 - protein, 11 aa, Artificial Sequence
  Description of Artificial Sequence: Synthetic peptide
  XENP020888 vlCDR1
KASQSVSNDVA

SEQ ID NO: 26048 - protein, 7 aa, Artificial Sequence
  Description of Artificial Sequence: Synthetic peptide
  XENP020888 vlCDR2
YASNRYT

SEQ ID NO: 26049 - protein, 8 aa, Artificial Sequence
  Description of Artificial Sequence: Synthetic peptide
  XENP020888 vlCDR3
QQDYSSPT

SEQ ID NO: 26050 - protein, 447 aa, Artificial Sequence; identical to SEQ ID NO: 25741
  Description of Artificial Sequence: Synthetic polypeptide
  XENP020889 9C6_H1_L1.2_anti-BTLA_IgG1_PVA_/S267K Heavy Chain

SEQ ID NO: 26051 - protein, 118 aa, Artificial Sequence; identical to SEQ ID NO: 25742
  Description of Artificial Sequence: Synthetic polypeptide
  VH of XENP020889

SEQ ID NO: 26052 - protein, 5 aa, Artificial Sequence
  Description of Artificial Sequence: Synthetic peptide
  XENP020889 vhCDR1
GYGVN

SEQ ID NO: 26053 - protein, 16 aa, Artificial Sequence
  Description of Artificial Sequence: Synthetic peptide
  XENP020889 vhCDR2
MIWIDGSTDYNSKFQG

SEQ ID NO: 26054 - protein, 10 aa, Artificial Sequence
  Description of Artificial Sequence: Synthetic peptide
  XENP020889 vhCDR3
DRPDGRAMDY

SEQ ID NO: 26055 - protein, 213 aa, Artificial Sequence
  Description of Artificial Sequence: Synthetic polypeptide
  XENP020889 9C6_H1_L1.2_anti-BTLA_IgG1_PVA_/S267K Light Chain
SIVMTQTPKFLLVSLGERATINCKASQSVSNDVAWYQQKPGQSPKLLIYYASNRYTGVPDRFTGSGYGTDFTLTISSLQAEDVAVYFCQQDYSSPTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 26056 - protein, 106 aa, Artificial Sequence
  Description of Artificial Sequence: Synthetic polypeptide
  VL of XENP020889
SIVMTQTPKFLLVSLGERATINCKASQSVSNDVAWYQQKPGQSPKLLIYYASNRYTGVPDRFTGSGYGTDFTLTISSLQAEDVAVYFCQQDYSSPTFGGGTKLEIK

SEQ ID NO: 26057 - protein, 11 aa, Artificial Sequence
  Description of Artificial Sequence: Synthetic peptide
  XENP020889 vlCDR1
KASQSVSNDVA

SEQ ID NO: 26058 - protein, 7 aa, Artificial Sequence
  Description of Artificial Sequence: Synthetic peptide
  XENP020889 vlCDR2
YASNRYT

SEQ ID NO: 26059 - protein, 8 aa, Artificial Sequence
  Description of Artificial Sequence: Synthetic peptide
  XENP020889 vlCDR3
QQDYSSPT

SEQ ID NO: 26060 - protein, 447 aa, Artificial Sequence; identical to SEQ ID NO: 25741
  Description of Artificial Sequence: Synthetic polypeptide
  XENP020890 9C6_H1_L1.3_anti-BTLA_IgG1_PVA_/S267K Heavy Chain

SEQ ID NO: 26061 - protein, 118 aa, Artificial Sequence; identical to SEQ ID NO: 25742
  Description of Artificial Sequence: Synthetic polypeptide
  VH of XENP020890

SEQ ID NO: 26062 - protein, 5 aa, Artificial Sequence
  Description of Artificial Sequence: Synthetic peptide
  XENP020890 vhCDR1
GYGVN

SEQ ID NO: 26063 - protein, 16 aa, Artificial Sequence
  Description of Artificial Sequence: Synthetic peptide
  XENP020890 vhCDR2
MIWIDGSTDYNSKFQG

SEQ ID NO: 26064 - protein, 10 aa, Artificial Sequence
  Description of Artificial Sequence: Synthetic peptide
  XENP020890 vhCDR3
DRPDGRAMDY

SEQ ID NO: 26065 - protein, 213 aa, Artificial Sequence
  Description of Artificial Sequence: Synthetic polypeptide
  XENP020890 9C6_H1_L1.3_anti-BTLA_IgG1_PVA_/S267K Light Chain
SIVMTQSPDSLAVSAGDRVTINCKASQSVSNDVAWYQQKPGQSPKLLIYYASNRYTGVPDRFTGSGYGTDFTLTISSLQAEDVAVYFCQQDYSSPTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 26066 - protein, 106 aa, Artificial Sequence
  Description of Artificial Sequence: Synthetic polypeptide
  VL of XENP020890
SIVMTQSPDSLAVSAGDRVTINCKASQSVSNDVAWYQQKPGQSPKLLIYYASNRYTGVPDRFTGSGYGTDFTLTISSLQAEDVAVYFCQQDYSSPTFGGGTKLEIK

SEQ ID NO: 26067 - protein, 11 aa, Artificial Sequence
  Description of Artificial Sequence: Synthetic peptide
  XENP020890 vlCDR1
KASQSVSNDVA

SEQ ID NO: 26068 - protein, 7 aa, Artificial Sequence
  Description of Artificial Sequence: Synthetic peptide
  XENP020890 vlCDR2
YASNRYT

SEQ ID NO: 26069 - protein, 8 aa, Artificial Sequence
  Description of Artificial Sequence: Synthetic peptide
  XENP020890 vlCDR3
QQDYSSPT

SEQ ID NO: 26070 - protein, 447 aa, Artificial Sequence; identical to SEQ ID NO: 25741
  Description of Artificial Sequence: Synthetic polypeptide
  XENP020891 9C6_H1_L1.4_anti-BTLA_IgG1_PVA_/S267K Heavy Chain

SEQ ID NO: 26071 - protein, 118 aa, Artificial Sequence; identical to SEQ ID NO: 25742
  Description of Artificial Sequence: Synthetic polypeptide
  VH of XENP020891

SEQ ID NO: 26072 - protein, 5 aa, Artificial Sequence
  Description of Artificial Sequence: Synthetic peptide
  XENP020891 vhCDR1
GYGVN

SEQ ID NO: 26073 - protein, 16 aa, Artificial Sequence
  Description of Artificial Sequence: Synthetic peptide
  XENP020891 vhCDR2
MIWIDGSTDYNSKFQG

SEQ ID NO: 26074 - protein, 10 aa, Artificial Sequence
  Description of Artificial Sequence: Synthetic peptide
  XENP020891 vhCDR3
DRPDGRAMDY

SEQ ID NO: 26075 - protein, 213 aa, Artificial Sequence
  Description of Artificial Sequence: Synthetic polypeptide
  XENP020891 9C6_H1_L1.4_anti-BTLA_IgG1_PVA_/S267K Light Chain
SIVMTQSPDSLAVSLGERATITCKASQSVSNDVAWYQQKPGQSPKLLIYYASNRYTGVPDRFTGSGYGTDFTLTISSLQAEDVAVYFCQQDYSSPTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 26076 - protein, 106 aa, Artificial Sequence
  Description of Artificial Sequence: Synthetic polypeptide
  VL of XENP020891
SIVMTQSPDSLAVSLGERATITCKASQSVSNDVAWYQQKPGQSPKLLIYYASNRYTGVPDRFTGSGYGTDFTLTISSLQAEDVAVYFCQQDYSSPTFGGGTKLEIK

SEQ ID NO: 26077 - protein, 11 aa, Artificial Sequence
  Description of Artificial Sequence: Synthetic peptide
  XENP020891 vlCDR1
KASQSVSNDVA

SEQ ID NO: 26078 - protein, 7 aa, Artificial Sequence
  Description of Artificial Sequence: Synthetic peptide
  XENP020891 vlCDR2
YASNRYT

SEQ ID NO: 26079 - protein, 8 aa, Artificial Sequence
  Description of Artificial Sequence: Synthetic peptide
  XENP020891 vlCDR3
QQDYSSPT

SEQ ID NO: 26080 - protein, 447 aa, Artificial Sequence; identical to SEQ ID NO: 25741
  Description of Artificial Sequence: Synthetic polypeptide
  XENP020892 9C6_H1_L1.5_anti-BTLA_IgG1_PVA_/S267K Heavy Chain

SEQ ID NO: 26081 - protein, 118 aa, Artificial Sequence; identical to SEQ ID NO: 25742
  Description of Artificial Sequence: Synthetic polypeptide
  VH of XENP020892

SEQ ID NO: 26082 - protein, 5 aa, Artificial Sequence
  Description of Artificial Sequence: Synthetic peptide
  XENP020892 vhCDR1
GYGVN

SEQ ID NO: 26083 - protein, 16 aa, Artificial Sequence
  Description of Artificial Sequence: Synthetic peptide
  XENP020892 vhCDR2
MIWIDGSTDYNSKFQG

SEQ ID NO: 26084 - protein, 10 aa, Artificial Sequence
  Description of Artificial Sequence: Synthetic peptide
  XENP020892 vhCDR3
DRPDGRAMDY

SEQ ID NO: 26085 - protein, 213 aa, Artificial Sequence
  Description of Artificial Sequence: Synthetic polypeptide
  XENP020892 9C6_H1_L1.5_anti-BTLA_IgG1_PVA_/S267K Light Chain
SIVMTQSPDSLAVSLGERATINCKASQSVSNDVAWYQQKPGQSPKLLIYYASNRYTGVPDRFTGSGYGTDFTFTISSLQAEDVAVYFCQQDYSSPTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 26086 - protein, 106 aa, Artificial Sequence
  Description of Artificial Sequence: Synthetic polypeptide
  VL of XENP020892
SIVMTQSPDSLAVSLGERATINCKASQSVSNDVAWYQQKPGQSPKLLIYYASNRYTGVPDRFTGSGYGTDFTFTISSLQAEDVAVYFCQQDYSSPTFGGGTKLEIK

SEQ ID NO: 26087 - protein, 11 aa, Artificial Sequence
  Description of Artificial Sequence: Synthetic peptide
  XENP020892 vlCDR1
KASQSVSNDVA

SEQ ID NO: 26088 - protein, 7 aa, Artificial Sequence
  Description of Artificial Sequence: Synthetic peptide
  XENP020892 vlCDR2
YASNRYT

SEQ ID NO: 26089 - protein, 8 aa, Artificial Sequence
  Description of Artificial Sequence: Synthetic peptide
  XENP020892 vlCDR3
QQDYSSPT

SEQ ID NO: 26090 - protein, 447 aa, Artificial Sequence; identical to SEQ ID NO: 25741
  Description of Artificial Sequence: Synthetic polypeptide
  XENP020893 9C6_H1_L1.6_anti-BTLA_IgG1_PVA_/S267K Heavy Chain

SEQ ID NO: 26091 - protein, 118 aa, Artificial Sequence; identical to SEQ ID NO: 25742
  Description of Artificial Sequence: Synthetic polypeptide
  VH of XENP020893

SEQ ID NO: 26092 - protein, 5 aa, Artificial Sequence
  Description of Artificial Sequence: Synthetic peptide
  XENP020893 vhCDR1
GYGVN

SEQ ID NO: 26093 - protein, 16 aa, Artificial Sequence
  Description of Artificial Sequence: Synthetic peptide
  XENP020893 vhCDR2
MIWIDGSTDYNSKFQG

SEQ ID NO: 26094 - protein, 10 aa, Artificial Sequence
  Description of Artificial Sequence: Synthetic peptide
  XENP020893 vhCDR3
DRPDGRAMDY

SEQ ID NO: 26095 - protein, 213 aa, Artificial Sequence
  Description of Artificial Sequence: Synthetic polypeptide
  XENP020893 9C6_H1_L1.6_anti-BTLA_IgG1_PVA_/S267K Light Chain
SIVMTQSPDSLAVSLGERATINCKASQSVSNDVAWYQQKPGQSPKLLIYYASNRYTGVPDRFTGSGYGTDFTLTISTVQAEDVAVYFCQQDYSSPTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 26096 - protein, 106 aa, Artificial Sequence
  Description of Artificial Sequence: Synthetic polypeptide
  VL of XENP020893
SIVMTQSPDSLAVSLGERATINCKASQSVSNDVAWYQQKPGQSPKLLIYYASNRYTGVPDRFTGSGYGTDFTLTISTVQAEDVAVYFCQQDYSSPTFGGGTKLEIK

SEQ ID NO: 26097 - protein, 11 aa, Artificial Sequence
  Description of Artificial Sequence: Synthetic peptide
  XENP020893 vlCDR1
KASQSVSNDVA

SEQ ID NO: 26098 - protein, 7 aa, Artificial Sequence
  Description of Artificial Sequence: Synthetic peptide
  XENP020893 vlCDR2
YASNRYT

SEQ ID NO: 26099 - protein, 8 aa, Artificial Sequence
  Description of Artificial Sequence: Synthetic peptide
  XENP020893 vlCDR3
QQDYSSPT

SEQ ID NO: 26100 - protein, 447 aa, Artificial Sequence; identical to SEQ ID NO: 25741
  Description of Artificial Sequence: Synthetic polypeptide
  XENP020894 9C6_H1_L1.7_anti-BTLA_IgG1_PVA_/S267K Heavy Chain

SEQ ID NO: 26101 - protein, 118 aa, Artificial Sequence; identical to SEQ ID NO: 25742
  Description of Artificial Sequence: Synthetic polypeptide
  VH of XENP020894

SEQ ID NO: 26102 - protein, 5 aa, Artificial Sequence
  Description of Artificial Sequence: Synthetic peptide
  XENP020894 vhCDR1
GYGVN

SEQ ID NO: 26103 - protein, 16 aa, Artificial Sequence
  Description of Artificial Sequence: Synthetic peptide
  XENP020894 vhCDR2
MIWIDGSTDYNSKFQG

SEQ ID NO: 26104 - protein, 10 aa, Artificial Sequence
  Description of Artificial Sequence: Synthetic peptide
  XENP020894 vhCDR3
DRPDGRAMDY

SEQ ID NO: 26105 - protein, 213 aa, Artificial Sequence
  Description of Artificial Sequence: Synthetic polypeptide
  XENP020894 9C6_H1_L1.7_anti-BTLA_IgG1_PVA_/S267K Light Chain
SIVMTQSPDSLAVSLGERATINCKASQSVSNDVAWYQQKPGQSPKLLIYYASNRYTGVPDRFTGSGYGTDFTLTISSLQAEDLAVYFCQQDYSSPTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 26106 - protein, 106 aa, Artificial Sequence
  Description of Artificial Sequence: Synthetic polypeptide
  VL of XENP020894
SIVMTQSPDSLAVSLGERATINCKASQSVSNDVAWYQQKPGQSPKLLIYYASNRYTGVPDRFTGSGYGTDFTLTISSLQAEDLAVYFCQQDYSSPTFGGGTKLEIK

SEQ ID NO: 26107 - protein, 11 aa, Artificial Sequence
  Description of Artificial Sequence: Synthetic peptide
  XENP020894 vlCDR1
KASQSVSNDVA

SEQ ID NO: 26108 - protein, 7 aa, Artificial Sequence
  Description of Artificial Sequence: Synthetic peptide
  XENP020894 vlCDR2
YASNRYT

SEQ ID NO: 26109 - protein, 8 aa, Artificial Sequence
  Description of Artificial Sequence: Synthetic peptide
  XENP020894 vlCDR3
QQDYSSPT

SEQ ID NO: 26110 - protein, 449 aa, Artificial Sequence
  Description of Artificial Sequence: Synthetic polypeptide
  XENP021208 3F6_H1L0_anti-BTLA_IgG1_PVA_/S267K Heavy Chain
QVQLQESGPGLVKPSQTLSLTCTVSGDSITSGYWNWIRKPPGKKLEYIGYLSYSGSTYYNPSLKSRVTISRDTSKNQYSLKLSSVTAADTAVYYCARYFYGSYYEAMDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 26111 - protein, 120 aa, Artificial Sequence
  Description of Artificial Sequence: Synthetic polypeptide
  VH of XENP021208
QVQLQESGPGLVKPSQTLSLTCTVSGDSITSGYWNWIRKPPGKKLEYIGYLSYSGSTYYNPSLKSRVTISRDTSKNQYSLKLSSVTAADTAVYYCARYFYGSYYEAMDYWGQGTTVTVSS

SEQ ID NO: 26112 - protein, 5 aa, Artificial Sequence
  Description of Artificial Sequence: Synthetic peptide
  XENP021208 vhCDR1
SGYWN

SEQ ID NO: 26113 - protein, 16 aa, Artificial Sequence
  Description of Artificial Sequence: Synthetic peptide
  XENP021208 vhCDR2
YLSYSGSTYYNPSLKS

SEQ ID NO: 26114 - protein, 12 aa, Artificial Sequence
  Description of Artificial Sequence: Synthetic peptide
  XENP021208 vhCDR3
YFYGSYYEAMDY

SEQ ID NO: 26115 - protein, 214 aa, Artificial Sequence; identical to SEQ ID NO: 25596
  Description of Artificial Sequence: Synthetic polypeptide
  XENP021208 3F6_H1L0_anti-BTLA_IgG1_PVA_/S267K Light Chain

SEQ ID NO: 26116 - protein, 107 aa, Artificial Sequence; identical to SEQ ID NO: 25597
  Description of Artificial Sequence: Synthetic polypeptide
  VL of XENP021208

SEQ ID NO: 26117 - protein, 11 aa, Artificial Sequence
  Description of Artificial Sequence: Synthetic peptide
  XENP021208 vlCDR1
RASKSISKYLA

SEQ ID NO: 26118 - protein, 7 aa, Artificial Sequence
  Description of Artificial Sequence: Synthetic peptide
  XENP021208 vlCDR2
SGSTLQS

SEQ ID NO: 26119 - protein, 9 aa, Artificial Sequence
  Description of Artificial Sequence: Synthetic peptide
  XENP021208 vlCDR3
QQHNEYPWT

SEQ ID NO: 26120 - protein, 449 aa, Artificial Sequence; identical to SEQ ID NO: 26110
  Description of Artificial Sequence: Synthetic polypeptide
  XENP021209 3F6_H1L1_anti-BTLA_IgG1_PVA_/S267K Heavy Chain

SEQ ID NO: 26121 - protein, 120 aa, Artificial Sequence; identical to SEQ ID NO: 26111
  Description of Artificial Sequence: Synthetic polypeptide
  VH of XENP021209

SEQ ID NO: 26122 - protein, 5 aa, Artificial Sequence
  Description of Artificial Sequence: Synthetic peptide
  XENP021209 vhCDR1
SGYWN

SEQ ID NO: 26123 - protein, 16 aa, Artificial Sequence
  Description of Artificial Sequence: Synthetic peptide
  XENP021209 vhCDR2
YLSYSGSTYYNPSLKS

SEQ ID NO: 26124 - protein, 12 aa, Artificial Sequence
  Description of Artificial Sequence: Synthetic peptide
  XENP021209 vhCDR3
YFYGSYYEAMDY

SEQ ID NO: 26125 - protein, 214 aa, Artificial Sequence
  Description of Artificial Sequence: Synthetic polypeptide
  XENP021209 3F6_H1L1_anti-BTLA_IgG1_PVA_/S267K Light Chain
DVQITQSPSFLSASVGDRVTITCRASKSISKYLAWYQEKPGKTNKLLIYSGSTLQSGIPSRFSGSGSGTEFTLTISSLQPEDFATYYCQQHNEYPWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 26126 - protein, 107 aa, Artificial Sequence
  Description of Artificial Sequence: Synthetic polypeptide
  VL of XENP021209
DVQITQSPSFLSASVGDRVTITCRASKSISKYLAWYQEKPGKTNKLLIYSGSTLQSGIPSRFSGSGSGTEFTLTISSLQPEDFATYYCQQHNEYPWTFGGGTKVEIK

SEQ ID NO: 26127 - protein, 11 aa, Artificial Sequence
  Description of Artificial Sequence: Synthetic peptide
  XENP021209 vlCDR1
RASKSISKYLA

SEQ ID NO: 26128 - protein, 7 aa, Artificial Sequence
  Description of Artificial Sequence: Synthetic peptide
  XENP021209 vlCDR2
SGSTLQS

SEQ ID NO: 26129 - protein, 9 aa, Artificial Sequence
  Description of Artificial Sequence: Synthetic peptide
  XENP021209 vlCDR3
QQHNEYPWT

SEQ ID NO: 26130 - protein, 448 aa, Artificial Sequence; identical to SEQ ID NO: 25601
  Description of Artificial Sequence: Synthetic polypeptide
  XENP021210 1A9_H0L1_anti-BTLA_IgG1_PVA_/S267K Heavy Chain

SEQ ID NO: 26131 - protein, 119 aa, Artificial Sequence; identical to SEQ ID NO: 25602
  Description of Artificial Sequence: Synthetic polypeptide
  VH of XENP021210

SEQ ID NO: 26132 - protein, 5 aa, Artificial Sequence
  Description of Artificial Sequence: Synthetic peptide
  XENP021210 vhCDR1
SFGMH

SEQ ID NO: 26133 - protein, 17 aa, Artificial Sequence
  Description of Artificial Sequence: Synthetic peptide
  XENP021210 vhCDR2
YISSGISTIYYADTVKG

SEQ ID NO: 26134 - protein, 10 aa, Artificial Sequence
  Description of Artificial Sequence: Synthetic peptide
  XENP021210 vhCDR3
DWLRGYAMDY

SEQ ID NO: 26135 - protein, 218 aa, Artificial Sequence
  Description of Artificial Sequence: Synthetic polypeptide
  XENP021210 1A9_H0L1_anti-BTLA_IgG1_PVA_/S267K Light Chain
DIVLTQSPSSLSASVGDRVTITCRASQSIDYDGDSYMNWYQQKPGKPPKLLIYAASNLDFGIPARFSGSGSGTDFTLTISSLQPEDFATYYCQQSNEDPWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 26136 - protein, 111 aa, Artificial Sequence
  Description of Artificial Sequence: Synthetic polypeptide
  VL of XENP021210
DIVLTQSPSSLSASVGDRVTITCRASQSIDYDGDSYMNWYQQKPGKPPKLLIYAASNLDFGIPARFSGSGSGTDFTLTISSLQPEDFATYYCQQSNEDPWTFGGGTKVEIK

SEQ ID NO: 26137 - protein, 15 aa, Artificial Sequence
  Description of Artificial Sequence: Synthetic peptide
  XENP021210 vlCDR1
RASQSIDYDGDSYMN

SEQ ID NO: 26138 - protein, 7 aa, Artificial Sequence
  Description of Artificial Sequence: Synthetic peptide
  XENP021210 vlCDR2
AASNLDF

SEQ ID NO: 26139 - protein, 9 aa, Artificial Sequence
  Description of Artificial Sequence: Synthetic peptide
  XENP021210 vlCDR3
QQSNEDPWT

SEQ ID NO: 26140 - protein, 448 aa, Artificial Sequence
  Description of Artificial Sequence: Synthetic polypeptide
  XENP021211 1A9_H1L0_anti-BTLA_IgG1_PVA_/S267K Heavy Chain
EVQLVESGGGLVQPGGSLRLSCAASGFTFSSFGMHWVRQAPGKGLEWVSYISSGISTIYYADSVKGRFTISRDNSKNTLYLQMNSLRAEDTAVYYCARDWLRGYAMDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 26141 - protein, 119 aa, Artificial Sequence
  Description of Artificial Sequence: Synthetic polypeptide
  VH of XENP021211
EVQLVESGGGLVQPGGSLRLSCAASGFTFSSFGMHWVRQAPGKGLEWVSYISSGISTIYYADSVKGRFTISRDNSKNTLYLQMNSLRAEDTAVYYCARDWLRGYAMDYWGQGTTVTVSS

SEQ ID NO: 26142 - protein, 5 aa, Artificial Sequence
  Description of Artificial Sequence: Synthetic peptide
  XENP021211 vhCDR1
SFGMH

SEQ ID NO: 26143 - protein, 17 aa, Artificial Sequence
  Description of Artificial Sequence: Synthetic peptide
  XENP021211 vhCDR2
YISSGISTIYYADSVKG

SEQ ID NO: 26144 - protein, 10 aa, Artificial Sequence
  Description of Artificial Sequence: Synthetic peptide
  XENP021211 vhCDR3
DWLRGYAMDY

SEQ ID NO: 26145 - protein, 218 aa, Artificial Sequence; identical to SEQ ID NO: 25606
  Description of Artificial Sequence: Synthetic polypeptide
  XENP021211 1A9_H1L0_anti-BTLA_IgG1_PVA_/S267K Light Chain

SEQ ID NO: 26146 - protein, 111 aa, Artificial Sequence; identical to SEQ ID NO: 25607
  Description of Artificial Sequence: Synthetic polypeptide
  VL of XENP021211

SEQ ID NO: 26147 - protein, 15 aa, Artificial Sequence
  Description of Artificial Sequence: Synthetic peptide
  XENP021211 vlCDR1
KASQSIDYDGDSYMN

SEQ ID NO: 26148 - protein, 7 aa, Artificial Sequence
  Description of Artificial Sequence: Synthetic peptide
  XENP021211 vlCDR2
AASNLDF

SEQ ID NO: 26149 - protein, 9 aa, Artificial Sequence
  Description of Artificial Sequence: Synthetic peptide
  XENP021211 vlCDR3
QQSNEDPWT

SEQ ID NO: 26150 - protein, 448 aa, Artificial Sequence; identical to SEQ ID NO: 26140
  Description of Artificial Sequence: Synthetic polypeptide
  XENP021212 1A9_H1L1_anti-BTLA_IgG1_PVA_/S267K Heavy Chain

SEQ ID NO: 26151 - protein, 119 aa, Artificial Sequence; identical to SEQ ID NO: 26141
  Description of Artificial Sequence: Synthetic polypeptide
  VH of XENP021212

SEQ ID NO: 26152 - protein, 5 aa, Artificial Sequence
  Description of Artificial Sequence: Synthetic peptide
  XENP021212 vhCDR1
SFGMH

SEQ ID NO: 26153 - protein, 17 aa, Artificial Sequence
  Description of Artificial Sequence: Synthetic peptide
  XENP021212 vhCDR2
YISSGISTIYYADSVKG

SEQ ID NO: 26154 - protein, 10 aa, Artificial Sequence
  Description of Artificial Sequence: Synthetic peptide
  XENP021212 vhCDR3
DWLRGYAMDY

SEQ ID NO: 26155 - protein, 218 aa, Artificial Sequence; identical to SEQ ID NO: 26135
  Description of Artificial Sequence: Synthetic polypeptide
  XENP021212 1A9_H1L1_anti-BTLA_IgG1_PVA_/S267K Light Chain

SEQ ID NO: 26156 - protein, 111 aa, Artificial Sequence; identical to SEQ ID NO: 26136
  Description of Artificial Sequence: Synthetic polypeptide
  VL of XENP021212

SEQ ID NO: 26157 - protein, 15 aa, Artificial Sequence
  Description of Artificial Sequence: Synthetic peptide
  XENP021212 vlCDR1
RASQSIDYDGDSYMN

SEQ ID NO: 26158 - protein, 7 aa, Artificial Sequence
  Description of Artificial Sequence: Synthetic peptide
  XENP021212 vlCDR2
AASNLDF

SEQ ID NO: 26159 - protein, 9 aa, Artificial Sequence
  Description of Artificial Sequence: Synthetic peptide
  XENP021212 vlCDR3
QQSNEDPWT

SEQ ID NO: 26160 - protein, 448 aa, Artificial Sequence; identical to SEQ ID NO: 26140
  Description of Artificial Sequence: Synthetic polypeptide
  XENP021213 1A9_H1L2_anti-BTLA_IgG1_PVA_/S267K Heavy Chain

SEQ ID NO: 26161 - protein, 119 aa, Artificial Sequence; identical to SEQ ID NO: 26141
  Description of Artificial Sequence: Synthetic polypeptide
  VH of XENP021213

SEQ ID NO: 26162 - protein, 5 aa, Artificial Sequence
  Description of Artificial Sequence: Synthetic peptide
  XENP021213 vhCDR1
SFGMH

SEQ ID NO: 26163 - protein, 17 aa, Artificial Sequence
  Description of Artificial Sequence: Synthetic peptide
  XENP021213 vhCDR2
YISSGISTIYYADSVKG

SEQ ID NO: 26164 - protein, 10 aa, Artificial Sequence
  Description of Artificial Sequence: Synthetic peptide
  XENP021213 vhCDR3
DWLRGYAMDY

SEQ ID NO: 26165 - protein, 218 aa, Artificial Sequence
  Description of Artificial Sequence: Synthetic polypeptide
  XENP021213 1A9_H1L2_anti-BTLA_IgG1_PVA_/S267K Light Chain
DIVLTQSPATLSVSPGERATLSCRASQSIDYDGDSYMNWYQQKPGQPPRLLIYAASNLDFGIPARFSGSGSGTEFTLTISSLQSEDFAVYYCQQSNEDPWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 26166 - protein, 111 aa, Artificial Sequence
  Description of Artificial Sequence: Synthetic polypeptide
  VL of XENP021213
DIVLTQSPATLSVSPGERATLSCRASQSIDYDGDSYMNWYQQKPGQPPRLLIYAASNLDFGIPARFSGSGSGTEFTLTISSLQSEDFAVYYCQQSNEDPWTFGGGTKVEIK

SEQ ID NO: 26167 - protein, 15 aa, Artificial Sequence
  Description of Artificial Sequence: Synthetic peptide
  XENP021213 vlCDR1
RASQSIDYDGDSYMN

SEQ ID NO: 26168 - protein, 7 aa, Artificial Sequence
  Description of Artificial Sequence: Synthetic peptide
  XENP021213 vlCDR2
AASNLDF

SEQ ID NO: 26169 - protein, 9 aa, Artificial Sequence
  Description of Artificial Sequence: Synthetic peptide
  XENP021213 vlCDR3
QQSNEDPWT

SEQ ID NO: 26170 - protein, 448 aa, Artificial Sequence
  Description of Artificial Sequence: Synthetic polypeptide
  XENP021214 1A9_H2L1_anti-BTLA_IgG1_PVA_/S267K Heavy Chain
QVQLVQSGAEVKKPGASVKVSCKASGFTFSSFGMHWVRQAPGQGLEWMGYISSGISTIYYADKFQGRVTMTRDNSKNTLYMELSSLRSEDTAVYYCARDWLRGYAMDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 26171 - protein, 119 aa, Artificial Sequence
  Description of Artificial Sequence: Synthetic polypeptide
  VH of XENP021214
QVQLVQSGAEVKKPGASVKVSCKASGFTFSSFGMHWVRQAPGQGLEWMGYISSGISTIYYADKFQGRVTMTRDNSKNTLYMELSSLRSEDTAVYYCARDWLRGYAMDYWGQGTTVTVSS

SEQ ID NO: 26172 - protein, 5 aa, Artificial Sequence
  Description of Artificial Sequence: Synthetic peptide
  XENP021214 vhCDR1
SFGMH

SEQ ID NO: 26173 - protein, 17 aa, Artificial Sequence
  Description of Artificial Sequence: Synthetic peptide
  XENP021214 vhCDR2
YISSGISTIYYADKFQG

SEQ ID NO: 26174 - protein, 10 aa, Artificial Sequence
  Description of Artificial Sequence: Synthetic peptide
  XENP021214 vhCDR3
DWLRGYAMDY

SEQ ID NO: 26175 - protein, 218 aa, Artificial Sequence; identical to SEQ ID NO: 26135
  Description of Artificial Sequence: Synthetic polypeptide
  XENP021214 1A9_H2L1_anti-BTLA_IgG1_PVA_/S267K Light Chain

SEQ ID NO: 26176 - protein, 111 aa, Artificial Sequence; identical to SEQ ID NO: 26136
  Description of Artificial Sequence: Synthetic polypeptide
  VL of XENP021214

SEQ ID NO: 26177 - protein, 15 aa, Artificial Sequence
  Description of Artificial Sequence: Synthetic peptide
  XENP021214 vlCDR1
RASQSIDYDGDSYMN

SEQ ID NO: 26178 - protein, 7 aa, Artificial Sequence
  Description of Artificial Sequence: Synthetic peptide
  XENP021214 vlCDR2
AASNLDF

SEQ ID NO: 26179 - protein, 9 aa, Artificial Sequence
  Description of Artificial Sequence: Synthetic peptide
  XENP021214 vlCDR3
QQSNEDPWT

SEQ ID NO: 26180 - protein, 448 aa, Artificial Sequence
  Description of Artificial Sequence: Synthetic polypeptide
  XENP019351 10A7_H0L0_IgG1_PVA_/S267K Heavy Chain
EVQLVESGGGLTQPGKSLKLSCEASGFTFSSFTMHWVRQSPGKGLEWVAFIRSGSGIVFYADAVRGRFTISRDNAKNLLFLQMNDLKSEDTAMYYCARRPLGHNTFDSWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 26181 - protein, 119 aa, Artificial Sequence; identical to SEQ ID NO: 4433
  Description of Artificial Sequence: Synthetic polypeptide
  VH of XENP019351

SEQ ID NO: 26182 - protein, 5 aa, Artificial Sequence
  Description of Artificial Sequence: Synthetic peptide
  XENP019351 vhCDR1
SFTMH

SEQ ID NO: 26183 - protein, 17 aa, Artificial Sequence
  Description of Artificial Sequence: Synthetic peptide
  XENP019351 vhCDR2
FIRSGSGIVFYADAVRG

SEQ ID NO: 26184 - protein, 10 aa, Artificial Sequence
  Description of Artificial Sequence: Synthetic peptide
  XENP019351 vhCDR3
RPLGHNTFDS

SEQ ID NO: 26185 - protein, 220 aa, Artificial Sequence
  Description of Artificial Sequence: Synthetic polypeptide
  XENP019351 10A7_H0L0_IgG1_PVA_/S267K Light Chain
DIVMTQSPSSLAVSPGEKVTMTCKSSQSLYYSGVKENLLAWYQQKPGQSPKLLIYYASIRFTGVPDRFTGSGSGTDYTLTITSVQAEDMGQYFCQQGINNPLTFGDGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 26186 - protein, 113 aa, Artificial Sequence; identical to SEQ ID NO: 4437
  Description of Artificial Sequence: Synthetic polypeptide
  VL of XENP019351

SEQ ID NO: 26187 - protein, 17 aa, Artificial Sequence
  Description of Artificial Sequence: Synthetic peptide
  XENP019351 vlCDR1
KSSQSLYYSGVKENLLA

SEQ ID NO: 26188 - protein, 7 aa, Artificial Sequence
  Description of Artificial Sequence: Synthetic peptide
  XENP019351 vlCDR2
YASIRFT

SEQ ID NO: 26189 - protein, 9 aa, Artificial Sequence
  Description of Artificial Sequence: Synthetic peptide
  XENP019351 vlCDR3
QQGINNPLT

SEQ ID NO: 26190 - protein, 448 aa, Artificial Sequence
  Description of Artificial Sequence: Synthetic polypeptide
  XENP019352 1F4_H0L0_IgG1_PVA_/S267K Heavy Chain
EVQLQQSGPELVKPGTSMKISCKASGYSFTGHLMNWVKQSHGKNLEWIGLIIPYNGGTSYNQKFKGKATLTVDKSSSTAYMELLSLTSDDSAVYFCSRGLRGFYAMDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 26191 - protein, 119 aa, Artificial Sequence; identical to SEQ ID NO: 4441
  Description of Artificial Sequence: Synthetic polypeptide
  VH of XENP019352

SEQ ID NO: 26192 - protein, 5 aa, Artificial Sequence
  Description of Artificial Sequence: Synthetic peptide
  XENP019352 vhCDR1
GHLMN

SEQ ID NO: 26193 - protein, 17 aa, Artificial Sequence
  Description of Artificial Sequence: Synthetic peptide
  XENP019352 vhCDR2
LIIPYNGGTSYNQKFKG

SEQ ID NO: 26194 - protein, 10 aa, Artificial Sequence
  Description of Artificial Sequence: Synthetic peptide
  XENP019352 vhCDR3
GLRGFYAMDY

SEQ ID NO: 26195 - protein, 219 aa, Artificial Sequence
  Description of Artificial Sequence: Synthetic polypeptide
  XENP019352 1F4_H0L0_IgG1_PVA_/S267K Light Chain
DVVLTQTPLSLSVSFGDQVSISCRSSQSLVNSYGNTFLSWYLHKPGQSPQLLIFGISNRFSGVPDRFSGSGSGTDFTLKISTIKPEDLGMYYCLQGTHQPPTFGPGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 26196 - protein, 112 aa, Artificial Sequence; identical to SEQ ID NO: 4445
  Description of Artificial Sequence: Synthetic polypeptide
  VL of XENP019352

SEQ ID NO: 26197 - protein, 16 aa, Artificial Sequence
  Description of Artificial Sequence: Synthetic peptide
  XENP019352 vlCDR1
RSSQSLVNSYGNTFLS

SEQ ID NO: 26198 - protein, 7 aa, Artificial Sequence
  Description of Artificial Sequence: Synthetic peptide
  XENP019352 vlCDR2
GISNRFS

SEQ ID NO: 26199 - protein, 9 aa, Artificial Sequence
  Description of Artificial Sequence: Synthetic peptide
  XENP019352 vlCDR3
LQGTHQPPT

SEQ ID NO: 26200 - protein, 15 aa, Artificial Sequence
  Description of Artificial Sequence: Synthetic peptide
GGGGSGGGGSGGGGS

SEQ ID NO: 26201 - protein, 18 aa, Artificial Sequence
  Description of Artificial Sequence: Synthetic peptide
GSTSGSGKPGSGEGSTKG

SEQ ID NO: 26202 - protein, 14 aa, Artificial Sequence
  Description of Artificial Sequence: Synthetic peptide
IRPRAIGGSKPRVA

SEQ ID NO: 26203 - protein, 15 aa, Artificial Sequence
  Description of Artificial Sequence: Synthetic peptide
GKGGSGKGGSGKGGS

SEQ ID NO: 26204 - protein, 15 aa, Artificial Sequence
  Description of Artificial Sequence: Synthetic peptide
GGKGSGGKGSGGKGS

SEQ ID NO: 26205 - protein, 15 aa, Artificial Sequence
  Description of Artificial Sequence: Synthetic peptide
GGGKSGGGKSGGGKS

SEQ ID NO: 26206 - protein, 15 aa, Artificial Sequence
  Description of Artificial Sequence: Synthetic peptide
GKGKSGKGKSGKGKS

SEQ ID NO: 26207 - protein, 15 aa, Artificial Sequence
  Description of Artificial Sequence: Synthetic peptide
GGGKSGGKGSGKGGS

SEQ ID NO: 26208 - protein, 15 aa, Artificial Sequence
  Description of Artificial Sequence: Synthetic peptide
GKPGSGKPGSGKPGS

SEQ ID NO: 26209 - protein, 20 aa, Artificial Sequence
  Description of Artificial Sequence: Synthetic peptide
GKPGSGKPGSGKPGSGKPGS

SEQ ID NO: 26210 - protein, 20 aa, Artificial Sequence
  Description of Artificial Sequence: Synthetic peptide
GKGKSGKGKSGKGKSGKGKS

SEQ ID NO: 26211 - protein, 20 aa, Artificial Sequence
  Description of Artificial Sequence: Synthetic peptide
GGGGSGGGGSGGGGSGGGGS

SEQ ID NO: 26212 - protein, 14 aa, Artificial Sequence
  Description of Artificial Sequence: Synthetic peptide
STAGDTHLGGEDFD

SEQ ID NO: 26213 - protein, 15 aa, Artificial Sequence
  Description of Artificial Sequence: Synthetic peptide
GEGGSGEGGSGEGGS

SEQ ID NO: 26214 - protein, 15 aa, Artificial Sequence
  Description of Artificial Sequence: Synthetic peptide
GGEGSGGEGSGGEGS

SEQ ID NO: 26215 - protein, 15 aa, Artificial Sequence
  Description of Artificial Sequence: Synthetic peptide
GGGESGGGESGGGES

SEQ ID NO: 26216 - protein, 15 aa, Artificial Sequence
  Description of Artificial Sequence: Synthetic peptide
GEGESGEGESGEGES

SEQ ID NO: 26217 - protein, 15 aa, Artificial Sequence
  Description of Artificial Sequence: Synthetic peptide
GGGESGGEGSGEGGS

SEQ ID NO: 26218 - protein, 20 aa, Artificial Sequence
  Description of Artificial Sequence: Synthetic peptide
GEGESGEGESGEGESGEGES

SEQ ID NO: 26219 - protein, 15 aa, Artificial Sequence
  Description of Artificial Sequence: Synthetic peptide
GGGGSGGGGSGGGGS

SEQ ID NO: 26220 - protein, 20 aa, Artificial Sequence
  Description of Artificial Sequence: Synthetic peptide
GGGGSGGGGSGGGGSGGGGS

SEQ ID NO: 26221 - protein, 18 aa, Artificial Sequence
  Description of Artificial Sequence: Synthetic peptide
GSTSGSGKPGSGEGSTKG

SEQ ID NO: 26222 - protein, 19 aa, Artificial Sequence
  Description of Artificial Sequence: Synthetic peptide
PRGASKSGSASQTGSAPGS

SEQ ID NO: 26223 - protein, 19 aa, Artificial Sequence
  Description of Artificial Sequence: Synthetic peptide
GTAAAGAGAAGGAAAGAAG

SEQ ID NO: 26224 - protein, 19 aa, Artificial Sequence
  Description of Artificial Sequence: Synthetic peptide
GTSGSSGSGSGGSGSGGGG

SEQ ID NO: 26225 - protein, 20 aa, Artificial Sequence
  Description of Artificial Sequence: Synthetic peptide
GKPGSGKPGSGKPGSGKPGS

SEQ ID NO: 26226 - protein, 288 aa, Homo sapiens
MQIPQAPWPVVWAVLQLGWRPGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERRAEVPTAHPSPSPRPAGQFQTLVVGVVGGLLGSLVLLVWVLAVICSRAARGTIGARRTGQPLKEDPSAVPVFSVDYGELDFQWREKTPEPPVPCVPEQTEYATIVFPSGMGTSSPARRGSADGPRSAQPLRPEDGHCSWPL

SEQ ID NO: 26227 - protein, 150 aa, Homo sapiens [sequence omitted]

SEQ ID NO: 26228 - protein, 288 aa, Macaca fascicularis
MQIPQAPWPVVWAVLQLGWRPGWFLESPDRPWNAPTFSPALLLVTEGDNATFTCSFSNASESFVLNWYRMSPSNQTDKLAAFPEDRSQPGQDCRFRVTRLPNGRDFHMSVVRARRNDSGTYLCGAISLAPKAQIKESLRAELRVTERRAEVPTAHPSPSPRPAGQFQALVVGVVGGLLGSLVLLVWVLAVICSRAAQGTIEARRTGQPLKEDPSAVPVFSVDYGELDFQWREKTPEPPAPCVPEQTEYATIVFPSGLGTSSPARRGSADGPRSPRPLRPEDGHCSWPL

SEQ ID NO: 26229 - protein, 150 aa, Macaca fascicularis
PGWFLESPDRPWNAPTFSPALLLVTEGDNATFTCSFSNASESFVLNWYRMSPSNQTDKLAAFPEDRSQPGQDCRFRVTRLPNGRDFHMSVVRARRNDSGTYLCGAISLAPKAQIKESLRAELRVTERRAEVPTAHPSPSPRPAGQFQALV

SEQ ID NO: 26230 - protein, 223 aa, Homo sapiens
MACLGFQRHKAQLNLATRTWPCTLLFFLLFIPVFCKAMHVAQPAVVLASSRGIASFVCEYASPGKATEVRVTVLRQADSQVTEVCAATYMMGNELTFLDDSICTGTSSGNQVNLTIQGLRAMDTGLYICKVELMYPPPYYLGIGNGTQIYVIDPEPCPDSDFLLWILAAVSSGLFFYSFLLTAVSLSKMLKKRSPLTTGVYVKMPPTEPECEKQFQPYFIPIN

SEQ ID NO: 26231 - protein, 126 aa, Homo sapiens [sequence omitted]

SEQ ID NO: 26232 - protein, 223 aa, Macaca fascicularis
MACLGFQRHKARLNLATRTRPYTLLFSLLFIPVFSKAMHVAQPAVVLANSRGIASFVCEYASPGKATEVRVTVLRQADSQVTEVCAATYMMGNELTFLDDSICTGTSSGNQVNLTIQGLRAMDTGLYICKVELMYPPPYYMGIGNGTQIYVIDPEPCPDSDFLLWILAAVSSGLFFYSFLLTAVSLSKMLKKRSPLTTGVYVKMPPTEPECEKQFQPYFIPIN

SEQ ID NO: 26233 - protein, 126 aa, Macaca fascicularis
KAMHVAQPAVVLANSRGIASFVCEYASPGKATEVRVTVLRQADSQVTEVCAATYMMGNELTFLDDSICTGTSSGNQVNLTIQGLRAMDTGLYICKVELMYPPPYYMGIGNGTQIYVIDPEPCPDSD

SEQ ID NO: 26234 - protein, 525 aa, Homo sapiens
MWEAQFLGLLFLQPLWVAPVKPLQPGAEVPVVWAQEGAPAQLPCSPTIPLQDLSLLRRAGVTWQHQPDSGPPAAAPGHPLAPGPHPAAPSSWGPRPRRYTVLSVGPGGLRSGRLPLQPRVQLDERGRQRGDFSLWLRPARRADAGEYRAAVHLRDRALSCRLRLRLGQASMTASPPGSLRASDWVILNCSFSRPDRPASVHWFRNRGQGRVPVRESPHHHLAESFLFLPQVSPMDSGPWGCILTYRDGFNVSIMYNLTVLGLEPPTPLTVYAGAGSRVGLPCRLPAGVGTRSFLTAKWTPPGGGPDLLVTGDNGDFTLRLEDVSQAQAGTYTCHIHLQEQQLNATVTLAIITVTPKSFGSPGSLGKLLCEVTPVSGQERFVWSSLDTPSQRSFSGPWLEAQEAQLLSQPWQCQLYQGERLLGAAVYFTELSSPGAQRSGRAPGALPAGHLLLFLILGVLSLLLLVTGAFGFHLWRRQWRPRRFSALEQGIHPPQAQSKIEELEQEPEPEPEPEPEPEPEPEPEQL

SEQ ID NO: 26235 - protein, 422 aa, Homo sapiens
VPVVWAQEGAPAQLPCSPTIPLQDLSLLRRAGVTWQHQPDSGPPAAAPGHPLAPGPHPAAPSSWGPRPRRYTVLSVGPGGLRSGRLPLQPRVQLDERGRQRGDFSLWLRPARRADAGEYRAAVHLRDRALSCRLRLRLGQASMTASPPGSLRASDWVILNCSFSRPDRPASVHWFRNRGQGRVPVRESPHHHLAESFLFLPQVSPMDSGPWGCILTYRDGFNVSIMYNLTVLGLEPPTPLTVYAGAGSRVGLPCRLPAGVGTRSFLTAKWTPPGGGPDLLVTGDNGDFTLRLEDVSQAQAGTYTCHIHLQEQQLNATVTLAIITVTPKSFGSPGSLGKLLCEVTPVSGQERFVWSSLDTPSQRSFSGPWLEAQEAQLLSQPWQCQLYQGERLLGAAVYFTELSSPGAQRSGRAPGALPAGHL

SEQ ID NO: 26236 - protein, 533 aa, Macaca fascicularis
  MOD_RES (74)..(74): Any amino acid
MWEAQFLGLLFLQPLWVAPVKPPQPGAEISVVWAQEGAPAQLPCSPTIPLQDLSLLRRAGVTWQHQPDSGPPAXAPGHPPVPGHRPAAPYSWGPRPRRYTVLSVGPGGLRSGRLPLQPRVQLDERGRQRGDFSLWLRPARRADAGEYRATVHLRDRALSCRLRLRVGQASMTASPPGSLRTSDWVILNCSFSRPDRPASVHWFRSRGQGRVPVQGSPHHHLAESFLFLPHVGPMDSGLWGCILTYRDGFNVSIMYNLTVLGLEPATPLTVYAGAGSRVELPCRLPPAVGTQSFLTAKWAPPGGGPDLLVAGDNGDFTLRLEDVSQAQAGTYICHIRLQGQQLNATVTLAIITVTPKSFGSPGSLGKLLCEVTPASGQEHFVWSPLNTPSQRSFSGPWLEAQEAQLLSQPWQCQLHQGERLLGAAVYFTELSSPGAQRSGRAPGALRAGHLPLFLILGVLFLLLLVTGAFGFHLWRRQWRPRRFSALEQGIHPPQAQSKIEELEQEPELEPEPELERELGPEPEPGPEPEPEQL

SEQ ID NO: 26237 - protein, 422 aa, Macaca fascicularis
  MOD_RES (46)..(46): Any amino acid
ISVVWAQEGAPAQLPCSPTIPLQDLSLLRRAGVTWQHQPDSGPPAXAPGHPPVPGHRPAAPYSWGPRPRRYTVLSVGPGGLRSGRLPLQPRVQLDERGRQRGDFSLWLRPARRADAGEYRATVHLRDRALSCRLRLRVGQASMTASPPGSLRTSDWVILNCSFSRPDRPASVHWFRSRGQGRVPVQGSPHHHLAESFLFLPHVGPMDSGLWGCILTYRDGFNVSIMYNLTVLGLEPATPLTVYAGAGSRVELPCRLPPAVGTQSFLTAKWAPPGGGPDLLVAGDNGDFTLRLEDVSQAQAGTYICHIRLQGQQLNATVTLAIITVTPKSFGSPGSLGKLLCEVTPASGQEHFVWSPLNTPSQRSFSGPWLEAQEAQLLSQPWQCQLHQGERLLGAAVYFTELSSPGAQRSGRAPGALRAGHL

SEQ ID NO: 26238 - protein, 300 aa, Homo sapiens
MFSHLPFDCVLLLLLLLLTRSSEVEYRAEVGQNAYLPCFYTPAAPGNLVPVCWGKGACPVFECGNVVLRTDERDVNYWTSRYWLNGDFRKGDVSLTIENVTLADSGIYCCRIQIPGIMNDEKFNLKLVIKPAKVTPAPTRQRDFTAAFPRMLTTRGHGPAETQTLGSLPDINLTQISTLANELRDSRLANDLRDSGATIRIGIYIGAGICAGLALALIFGALIFKWYSHSKEKIQNLSLISLANLPPSGLANAVAEGIRSEENIYTIEENVYEVEEPNEYYCYVSSRQQPSQPLGCRFAM

SEQ ID NO: 26239 - protein, 181 aa, Homo sapiens
SEVEYRAEVGQNAYLPCFYTPAAPGNLVPVCWGKGACPVFECGNVVLRTDERDVNYWTSRYWLNGDFRKGDVSLTIENVTLADSGIYCCRIQIPGIMNDEKFNLKLVIKPAKVTPAPTRQRDFTAAFPRMLTTRGHGPAETQTLGSLPDINLTQISTLANELRDSRLANDLRDSGATIRIG

SEQ ID NO: 26240 - protein, 302 aa, Macaca fascicularis
MFSHLPFDCVLLLLLLLLTRSSEVEYIAEVGQNAYLPCSYTPAPPGNLVPVCWGKGACPVFDCSNVVLRTDNRDVNDRTSGRYWLKGDFHKGDVSLTIENVTLADSGVYCCRIQIPGIMNDEKHNVKLVVIKPAKVTPAPTLQRDLTSAFPRMLTTGEHGPAETQTPGSLPDVNLTVSNFFCELQIFTLTNELRDSGATIRTAIYIAAGISAGLALALIFGALIFKWYSHSKEKTQNLSLISLANIPPSGLANAVAEGIRSEENIYTIEEDVYEVEEPNEYYCYVSSGQQPSQPLGCRVAMP

SEQ ID NO: 26241 - protein, 182 aa, Macaca fascicularis
SEVEYIAEVGQNAYLPCSYTPAPPGNLVPVCWGKGACPVFDCSNVVLRTDNRDVNDRTSGRYWLKGDFHKGDVSLTIENVTLADSGVYCCRIQIPGIMNDEKHNVKLVVIKPAKVTPAPTLQRDLTSAFPRMLTTGEHGPAETQTPGSLPDVNLTVSNFFCELQIFTLTNELRDSGATIRTA

SEQ ID NO: 26242 - protein, 290 aa, Homo sapiens
MRIFAVFIFMTYWHLLNAFTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERTHLVILGAILLCLGVALTFIFRLRKGRMMDVKKCGIQDTNSKKQSDTHLEET

SEQ ID NO: 26243 - protein, 220 aa, Homo sapiens
FTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 26244 - protein, 290 aa, Macaca fascicularis
MRIFAVFIFTIYWHLLNAFTVTVPKDLYVVEYGSNMTIECKFPVEKQLDLTSLIVYWEMEDKNIIQFVHGEEDLKVQHSNYRQRAQLLKDQLSLGNAALRITDVKLQDAGVYRCMISYGGADYKRITVKVNAPYNKINQRILVVDPVTSEHELTCQAEGYPKAEVIWTSSDHQVLSGKTTTTNSKREEKLLNVTSTLRINTTANEIFYCIFRRLDPEENHTAELVIPELPLALPPNERTHLVILGAIFLLLGVALTFIFYLRKGRMMDMKKCGIRVTNSKKQRDTQLEET

SEQ ID NO: 26245 - protein, 220 aa, Macaca fascicularis
FTVTVPKDLYVVEYGSNMTIECKFPVEKQLDLTSLIVYWEMEDKNIIQFVHGEEDLKVQHSNYRQRAQLLKDQLSLGNAALRITDVKLQDAGVYRCMISYGGADYKRITVKVNAPYNKINQRILVVDPVTSEHELTCQAEGYPKAEVIWTSSDHQVLSGKTTTTNSKREEKLLNVTSTLRINTTANEIFYCIFRRLDPEENHTAELVIPELPLALPPNER

SEQ ID NO: 26246 - protein, 199 aa, Homo sapiens
MKSGLWYFFLFCLRIKVLTGEINGSANYEMFIFHNGGVQILCKYPDIVQQFKMQLLKGGQILCDLTKTKGSGNTVSIKSLKFCHSQLSNNSVSFFLYNLDHSHANYYFCNLSIFDPPPFKVTLTGGYLHIYESQLCCQLKFWLPIGCAAFVVVCILGCILICWLTKKKYSSSVHDPNGEYMFMRAVNTAKKSRLTDVTL

SEQ ID NO: 26247 - protein, 120 aa, Homo sapiens
EINGSANYEMFIFHNGGVQILCKYPDIVQQFKMQLLKGGQILCDLTKTKGSGNTVSIKSLKFCHSQLSNNSVSFFLYNLDHSHANYYFCNLSIFDPPPFKVTLTGGYLHIYESQLCCQLK

SEQ ID NO: 26248 - protein, 199 aa, Macaca fascicularis
MKSGLWYFFLFCLHMKVLTGEINGSANYEMFIFHNGGVQILCKYPDIVQQFKMQLLKGGQILCDLTKTKGSGNTVSIKSLKFCHSQLSNNSVSFFLYNLDRSHANYYFCNLSIFDPPPFKVTLTGGYLHIYESQLCCQLKFWLPIGCATFVVVCIFGCILICWLTKKKYSSTVHDPNGEYMFMRAVNTAKKSRLTDVTV

SEQ ID NO: 26249 - protein, 120 aa, Macaca fascicularis
EINGSANYEMFIFHNGGVQILCKYPDIVQQFKMQLLKGGQILCDLTKTKGSGNTVSIKSLKFCHSQLSNNSVSFFLYNLDRSHANYYFCNLSIFDPPPFKVTLTGGYLHIYESQLCCQLK

SEQ ID NO: 26250 - protein, 241 aa, Homo sapiens
MAQHGAMGAFRALCGLALLCALSLGQRPTGGPGCGPGRLLLGTGTDARCCRVHTTRCCRDYPGEECCSEWDCMCVQPEFHCGDPCCTTCRHHPCPPGQGVQSQGKFSFGFQCIDCASGTFSGGHEGHCKPWTDCTQFGFLTVFPGNKTHNAVCVPGSPPAEPLGWLTVVLLAVAACVLLLTSAQLGLHIWQLRSQCMWPRETQLLLEVPPSTEDARSCQFPEEERGERSAEEKGRLGDLWV

SEQ ID NO: 26251 - protein, 137 aa, Homo sapiens
QRPTGGPGCGPGRLLLGTGTDARCCRVHTTRCCRDYPGEECCSEWDCMCVQPEFHCGDPCCTTCRHHPCPPGQGVQSQGKFSFGFQCIDCASGTFSGGHEGHCKPWTDCTQFGFLTVFPGNKTHNAVCVPGSPPAEP

SEQ ID NO: 26252 - protein, 235 aa, Macaca fascicularis
MCACGTLCCLALLCAASLGQRPTGGPGCGPGRLLLGTGKDARCCRVHPTRCCRDYQSEECCSEWDCVCVQPEFHCGNPCCTTCQHHPCPSGQGVQPQGKFSFGFRCVDCALGTFSRGHDGHCKPWTDCTQFGFLTVFPGNKTHNAVCVPGSPPAEPPGWLTIVLLAVAACVLLLTSAQLGLHIWQLGSQPTGPRETQLLLEVPPSTEDASSCQFPEEERGERLAEEKGRLGDLWV

SEQ ID NO: 26253 - protein, 137 aa, Macaca fascicularis
QRPTGGPGCGPGRLLLGTGKDARCCRVHPTRCCRDYQSEECCSEWDCVCVQPEFHCGNPCCTTCQHHPCPSGQGVQPQGKFSFGFRCVDCALGTFSRGHDGHCKPWTDCTQFGFLTVFPGNKTHNAVCVPGSPPAEP

SEQ ID NO: 26254 - protein, 277 aa, Homo sapiens
MCVGARRLGRGPCAALLLLGLGLSTVTGLHCVGDTYPSNDRCCHECRPGNGMVSRCSRSQNTVCRPCGPGFYNDVVSSKPCKPCTWCNLRSGSERKQLCTATQDTVCRCRAGTQPLDSYKPGVDCAPCPPGHFSPGDNQACKPWTNCTLAGKHTLQPASNSSDAICEDRDPPATQPQETQGPPARPITVQPTEAWPRTSQGPSTRPVEVPGGRAVAAILGLGLVLGLLGPLAILLALYLLRRDQRLPPDAHKPPGGGSFRTPIQEEQADAHSTLAKI

SEQ ID NO: 26255 - protein, 186 aa, Homo sapiens [sequence omitted]

SEQ ID NO: 26256 - protein, 277 aa, Macaca fascicularis
MCVGARRLGRGPCAALLLLGLGLSTTAKLHCVGDTYPSNDRCCQECRPGNGMVSRCNRSQNTVCRPCGPGFYNDVVSAKPCKACTWCNLRSGSERKQPCTATQDTVCRCRAGTQPLDSYKPGVDCAPCPPGHFSPGDNQACKPWTNCTLAGKHTLQPASNSSDAICEDRDPPPTQPQETQGPPARPTTVQPTEAWPRTSQRPSTRPVEVPRGPAVAAILGLGLALGLLGPLAMLLALLLLRRDQRLPPDAPKAPGGGSFRTPIQEEQADAHSALAKI

SEQ ID NO: 26257 - protein, 186 aa, Macaca fascicularis
LHCVGDTYPSNDRCCQECRPGNGMVSRCNRSQNTVCRPCGPGFYNDVVSAKPCKACTWCNLRSGSERKQPCTATQDTVCRCRAGTQPLDSYKPGVDCAPCPPGHFSPGDNQACKPWTNCTLAGKHTLQPASNSSDAICEDRDPPPTQPQETQGPPARPTTVQPTEAWPRTSQRPSTRPVEVPRGPA

SEQ ID NO: 26258 - protein, 255 aa, Homo sapiens
MGNSCYNIVATLLLVLNFERTRSLQDPCSNCPAGTFCDNNRNQICSPCPPNSFSSAGGQRTCDICRQCKGVFRTRKECSSTSNAECDCTPGFHCLGAGCSMCEQDCKQGQELTKKGCKDCCFGTFNDQKRGICRPWTNCSLDGKSVLVNGTKERDVVCGPSPADLSPGASSVTPPAPAREPGHSPQIISFFLALTSTALLFLLFFLTLRFSVVKRGRKKLLYIFKQPFMRPVQTTQEEDGCSCRFPEEEEGGCEL

SEQ ID NO: 26259 - protein, 163 aa, Homo sapiens
LQDPCSNCPAGTFCDNNRNQICSPCPPNSFSSAGGQRTCDICRQCKGVFRTRKECSSTSNAECDCTPGFHCLGAGCSMCEQDCKQGQELTKKGCKDCCFGTFNDQKRGICRPWTNCSLDGKSVLVNGTKERDVVCGPSPADLSPGASSVTPPAPAREPGHSPQ

SEQ ID NO: 26260 - protein, 254 aa, Macaca fascicularis
MGNSCYNIVATLLLVLNFERTRSLQDLCSNCPAGTFCDNNRSQICSPCPPNSFSSAGGQRTCDICRQCKGVFKTRKECSSTSNAECDCISGYHCLGAECSMCEQDCKQGQELTKKGCKDCCFGTFNDQKRGICRPWTNCSLDGKSVLVNGTKERDVVCGPSPADLSPGASSATPPAPAREPGHSPQIIFFLALTSTVVLFLLFFLVLRFSVVKRSRKKLLYIFKQPFMRPVQTTQEEDGCSCRFPEEEEGGCEL

SEQ ID NO: 26261 - protein, 163 aa, Macaca fascicularis
LQDLCSNCPAGTFCDNNRSQICSPCPPNSFSSAGGQRTCDICRQCKGVFKTRKECSSTSNAECDCISGYHCLGAECSMCEQDCKQGQELTKKGCKDCCFGTFNDQKRGICRPWTNCSLDGKSVLVNGTKERDVVCGPSPADLSPGASSATPPAPAREPGHSPQ

SEQ ID NO: 26262 - protein, 450 aa, Artificial Sequence
  Description of Artificial Sequence: Synthetic polypeptide
  XENP014410 20H4.9[4-1BB]_H0L0_IgG1_PVA_/S267K Heavy Chain
QVQLQQWGAGLLKPSETLSLTCAVYGGSFSGYYWSWIRQSPEKGLEWIGEINHGGYVTYNPSLESRVTISVDTSKNQFSLKLSSVTAADTAVYYCARDYGPGNYDWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 26263 - protein, 121 aa, Artificial Sequence [sequence omitted]

SEQ ID NO: 26264 - protein, 5 aa, Artificial Sequence
  Description of Artificial Sequence: Synthetic peptide
  XENP014410 vhCDR1
GYYWS

SEQ ID NO: 26265 - protein, 16 aa, Artificial Sequence
  Description of Artificial Sequence: Synthetic peptide
  XENP014410 vhCDR2
EINHGGYVTYNPSLES

SEQ ID NO: 26266 - protein, 13 aa, Artificial Sequence
  Description of Artificial Sequence: Synthetic peptide
  XENP014410 vhCDR3
DYGPGNYDWYFDL

SEQ ID NO: 26267 - protein, 216 aa, Artificial Sequence
  Description of Artificial Sequence: Synthetic polypeptide
  XENP014410 20H4.9[4-1BB]_H0L0_IgG1_PVA_/S267K Light Chain
EIVLTQSPATLSLSPGERATLSCRASQSVSSYLAWYQQKPGQAPRLLIYDASNRATGIPARFSGSGSGTDFTLTISSLEPEDFAVYYCQQRSNWPPALTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 26268 - protein, 109 aa, Artificial Sequence [sequence omitted]

SEQ ID NO: 26269 - protein, 11 aa, Artificial Sequence
  Description of Artificial Sequence: Synthetic peptide
  XENP014410 vlCDR1
RASQSVSSYLA

SEQ ID NO: 26270 - protein, 7 aa, Artificial Sequence
  Description of Artificial Sequence: Synthetic peptide
  XENP014410 vlCDR2
DASNRAT

SEQ ID NO: 26271 - protein, 11 aa, Artificial Sequence
  Description of Artificial Sequence: Synthetic peptide
  XENP014410 vlCDR3
QQRSNWPPALT

SEQ ID NO: 26272 - protein, 447 aa, Artificial Sequence
  Description of Artificial Sequence: Synthetic polypeptide
  XENP016437 11D4[OX40]_H0L0_IgG1_PVA_/S267K Heavy Chain
EVQLVESGGGLVQPGGSLRLSCAASGFTFSSYSMNWVRQAPGKGLEWVSYISSSSSTIDYADSVKGRFTISRDNAKNSLYLQMNSLRDEDTAVYYCARESGWYLFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 26273 - protein, 118 aa, Artificial Sequence
  Description of Artificial Sequence: Synthetic polypeptide
  VH of XENP016437
EVQLVESGGGLVQPGGSLRLSCAASGFTFSSYSMNWVRQAPGKGLEWVSYISSSSSTIDYADSVKGRFTISRDNAKNSLYLQMNSLRDEDTAVYYCARESGWYLFDYWGQGTLVTVSS

SEQ ID NO: 26274 - protein, 5 aa, Artificial Sequence
  Description of Artificial Sequence: Synthetic peptide
  XENP016437 vhCDR1
SYSMN

SEQ ID NO: 26275 - protein, 17 aa, Artificial Sequence
  Description of Artificial Sequence: Synthetic peptide
  XENP016437 vhCDR2
YISSSSSTIDYADSVKG

SEQ ID NO: 26276 - protein, 9 aa, Artificial Sequence
  Description of Artificial Sequence: Synthetic peptide
  XENP016437 vhCDR3
ESGWYLFDY

SEQ ID NO: 26277 - protein, 214 aa, Artificial Sequence
  Description of Artificial Sequence: Synthetic polypeptide
  XENP016437 11D4[OX40]_H0L0_IgG1_PVA_/S267K Light Chain
DIQMTQSPSSLSASVGDRVTITCRASQGISSWLAWYQQKPEKAPKSLIYAASSLQSGVPSRFSGSGSGTDFTLTISSLQPEDFATYYCQQYNSYPPTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 26278 - protein, 107 aa, Artificial Sequence
  Description of Artificial Sequence: Synthetic polypeptide
  VL of XENP016437
DIQMTQSPSSLSASVGDRVTITCRASQGISSWLAWYQQKPEKAPKSLIYAASSLQSGVPSRFSGSGSGTDFTLTISSLQPEDFATYYCQQYNSYPPTFGGGTKVEIK

SEQ ID NO: 26279 - protein, 11 aa, Artificial Sequence
  Description of Artificial Sequence: Synthetic peptide
  XENP016437 vlCDR1
RASQGISSWLA

SEQ ID NO: 26280 - protein, 7 aa, Artificial Sequence
  Description of Artificial Sequence: Synthetic peptide
  XENP016437 vlCDR2
AASSLQS

SEQ ID NO: 26281 - protein, 9 aa, Artificial Sequence
  Description of Artificial Sequence: Synthetic peptide
  XENP016437 vlCDR3
QQYNSYPPT

SEQ ID NO: 26282 - protein, 451 aa, Artificial Sequence
  Description of Artificial Sequence: Synthetic polypeptide
  XENP016438 1D8[GITR]_H0L0_IgG1_PVA_/S267K Heavy Chain
QVTLKESGPGILKPSQTLSLTCSFSGFSLSTSGMGVGWIRQPSGKGLEWLAHIWWDDDKYYSPSLKSQLTISKDTSRNQVFLKITSLDTADTATYYCVRSYYYGSSGAMDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 26283 - protein, 122 aa, Artificial Sequence
  Description of Artificial Sequence: Synthetic polypeptide
  VH of XENP016438
QVTLKESGPGILKPSQTLSLTCSFSGFSLSTSGMGVGWIRQPSGKGLEWLAHIWWDDDKYYSPSLKSQLTISKDTSRNQVFLKITSLDTADTATYYCVRSYYYGSSGAMDYWGQGTSVTVSS

SEQ ID NO: 26284 - protein, 7 aa, Artificial Sequence
  Description of Artificial Sequence: Synthetic peptide
  XENP016438 vhCDR1
TSGMGVG

SEQ ID NO: 26285 - protein, 16 aa, Artificial Sequence
  Description of Artificial Sequence: Synthetic peptide
  XENP016438 vhCDR2
HIWWDDDKYYSPSLKS

SEQ ID NO: 26286 - protein, 12 aa, Artificial Sequence
  Description of Artificial Sequence: Synthetic peptide
  XENP016438 vhCDR3
SYYYGSSGAMDY

SEQ ID NO: 26287 - protein, 219 aa, Artificial Sequence
  Description of Artificial Sequence: Synthetic polypeptide
  XENP016438 1D8[GITR]_H0L0_IgG1_PVA_/S267K Light Chain
DIVMTQTPLSLPVSLGDQASISCRSSQSLVHSDGNTYLHWYLQKPGQSPKLLIYKVSKRFSGVPDRFSGSGSGTDFTLKISRVEAEDLGVYFCSQSTHVPPTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 26288 - protein, 112 aa, Artificial Sequence
  Description of Artificial Sequence: Synthetic polypeptide
  VL of XENP016438
DIVMTQTPLSLPVSLGDQASISCRSSQSLVHSDGNTYLHWYLQKPGQSPKLLIYKVSKRFSGVPDRFSGSGSGTDFTLKISRVEAEDLGVYFCSQSTHVPPTFGGGTKLEIK

SEQ ID NO: 26289 - protein, 16 aa, Artificial Sequence
  Description of Artificial Sequence: Synthetic peptide
  XENP016438 vlCDR1
RSSQSLVHSDGNTYLH

SEQ ID NO: 26290 - protein, 7 aa, Artificial Sequence
  Description of Artificial Sequence: Synthetic peptide
  XENP016438 vlCDR2
KVSKRFS

SEQ ID NO: 26291 - protein, 9 aa, Artificial Sequence
  Description of Artificial Sequence: Synthetic peptide
  XENP016438 vlCDR3
SQSTHVPPT

SEQ ID NO: 26292 - protein, 454 aa, Artificial Sequence
  Description of Artificial Sequence: Synthetic polypeptide
  XENP016435 [anti-ICOS]_H0L0_IgG1_PVA_/S267K Heavy Chain
QVQLVQSGAEVKKPGASVKVSCKASGYTFTGYYMHWVRQAPGQGLEWMGWINPHSGGTNYAQKFQGRVTMTRDTSISTAYMELSRLRSDDTAVYYCARTYYYDSSGYYHDAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 26293 - protein, 125 aa, Artificial Sequence
  Description of Artificial Sequence: Synthetic polypeptide
  VH of XENP016435
QVQLVQSGAEVKKPGASVKVSCKASGYTFTGYYMHWVRQAPGQGLEWMGWINPHSGGTNYAQKFQGRVTMTRDTSISTAYMELSRLRSDDTAVYYCARTYYYDSSGYYHDAFDIWGQGTMVTVSS

SEQ ID NO: 26294 - protein, 5 aa, Artificial Sequence
  Description of Artificial Sequence: Synthetic peptide
  XENP016435 vhCDR1
GYYMH

SEQ ID NO: 26295 - protein, 17 aa, Artificial Sequence
  Description of Artificial Sequence: Synthetic peptide
  XENP016435 vhCDR2
WINPHSGGTNYAQKFQG

SEQ ID NO: 26296 - protein, 16 aa, Artificial Sequence
  Description of Artificial Sequence: Synthetic peptide
  XENP016435 vhCDR3
TYYYDSSGYYHDAFDI

SEQ ID NO: 26297 - protein, 214 aa, Artificial Sequence
  Description of Artificial Sequence: Synthetic polypeptide
  XENP016435 [anti-ICOS]_H0L0_IgG1_PVA_/S267K Light Chain
DIQMTQSPSSVSASVGDRVTITCRASQGISRLLAWYQQKPGKAPKLLIYVASSLQSGVPSRFSGSGSGTDFTLTISSLQPEDFATYYCQQANSFPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 26298 - protein, 107 aa, Artificial Sequence
  Description of Artificial Sequence: Synthetic polypeptide
  VL of XENP016435
DIQMTQSPSSVSASVGDRVTITCRASQGISRLLAWYQQKPGKAPKLLIYVASSLQSGVPSRFSGSGSGTDFTLTISSLQPEDFATYYCQQANSFPWTFGQGTKVEIK

SEQ ID NO: 26299 - protein, 11 aa, Artificial Sequence
  Description of Artificial Sequence: Synthetic peptide
  XENP016435 vlCDR1
RASQGISRLLA

SEQ ID NO: 26300 - protein, 7 aa, Artificial Sequence
  Description of Artificial Sequence: Synthetic peptide
  XENP016435 vlCDR2
VASSLQS

SEQ ID NO: 26301 - protein, 9 aa, Artificial Sequence
  Description of Artificial Sequence: Synthetic peptide
  XENP016435 vlCDR3
QQANSFPWT

SEQ ID NO: 26302 - protein, 452 aa, Artificial Sequence
  Description of Artificial Sequence: Synthetic polypeptide
  XENP021820 GSK_314.8[ICOS]_H0L0_IgG1_PVA_/S267K Heavy Chain
QVQLQQPGTELMKPGASVKLSCKASGYTFTTYWMHWVKQRPGQGLEWIGEIDPSDSYVNYNQNFKGKATLTVDKSSSTAYIQLSSLTSEDSAVYFCARSPDYYGTSLAWFDYWGQGTLVTVSTASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 26303 - protein, 123 aa, Artificial Sequence
  Description of Artificial Sequence: Synthetic polypeptide
  VH of XENP021820
QVQLQQPGTELMKPGASVKLSCKASGYTFTTYWMHWVKQRPGQGLEWIGEIDPSDSYVNYNQNFKGKATLTVDKSSSTAYIQLSSLTSEDSAVYFCARSPDYYGTSLAWFDYWGQGTLVTVST

SEQ ID NO: 26304 - protein, 5 aa, Artificial Sequence
  Description of Artificial Sequence: Synthetic peptide
  XENP021820 vhCDR1
TYWMH

SEQ ID NO: 26305 - protein, 17 aa, Artificial Sequence
  Description of Artificial Sequence: Synthetic peptide
  XENP021820 vhCDR2
EIDPSDSYVNYNQNFKG

SEQ ID NO: 26306 - protein, 14 aa, Artificial Sequence
  Description of Artificial Sequence: Synthetic peptide
  XENP021820 vhCDR3
SPDYYGTSLAWFDY

SEQ ID NO: 26307 - protein, 219 aa, Artificial Sequence
  Description of Artificial Sequence: Synthetic polypeptide
  XENP021820 GSK_314.8[ICOS]_H0L0_IgG1_PVA_/S267K Light Chain
DIVMTQAAPSVPVTPGESVSISCRSSKSPLHSNGNIYLYWFLQRPGQSPQLLIYRMSNLASGVPDRFSGSGSGTTFTLKISRVEAEDVGVYYCMQHLEYPYTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 26308 - protein, 112 aa, Artificial Sequence
  Description of Artificial Sequence: Synthetic polypeptide
  VL of XENP021820
DIVMTQAAPSVPVTPGESVSISCRSSKSPLHSNGNIYLYWFLQRPGQSPQLLIYRMSNLASGVPDRFSGSGSGTTFTLKISRVEAEDVGVYYCMQHLEYPYTFGGGTKLEIK

SEQ ID NO: 26309 - protein, 16 aa, Artificial Sequence
  Description of Artificial Sequence: Synthetic peptide
  XENP021820 vlCDR1
RSSKSPLHSNGNIYLY

SEQ ID NO: 26310 - protein, 7 aa, Artificial Sequence
  Description of Artificial Sequence: Synthetic peptide
  XENP021820 vlCDR2
RMSNLAS

SEQ ID NO: 26311 - protein, 9 aa, Artificial Sequence
  Description of Artificial Sequence: Synthetic peptide
  XENP021820 vlCDR3
MQHLEYPYT

SEQ ID NO: 26312 - protein, 453 aa, Artificial Sequence
  Description of Artificial Sequence: Synthetic polypeptide
  XENP021821 GSK_88.2[ICOS]_H0L0_IgG1_PVA_/S267K Heavy Chain
QVQLQQPGAELVRPGASVKLSCKASGYSFTSYWINWVKQRPGQGLEWIGNIYPSDSYTNYNQMFKDKATLTVDKSSNTAYMQLTSPTSEDSAVYYCTRWNLSYYFDNNYYLDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 26313 - protein, 124 aa, Artificial Sequence
  Description of Artificial Sequence: Synthetic polypeptide
  VH of XENP021821
QVQLQQPGAELVRPGASVKLSCKASGYSFTSYWINWVKQRPGQGLEWIGNIYPSDSYTNYNQMFKDKATLTVDKSSNTAYMQLTSPTSEDSAVYYCTRWNLSYYFDNNYYLDYWGQGTTLTVSS

SEQ ID NO: 26314 - protein, 5 aa, Artificial Sequence
  Description of Artificial Sequence: Synthetic peptide
  XENP021821 vhCDR1
SYWIN

SEQ ID NO: 26315 - protein, 17 aa, Artificial Sequence
  Description of Artificial Sequence: Synthetic peptide
  XENP021821 vhCDR2
NIYPSDSYTNYNQMFKD

SEQ ID NO: 26316 - protein, 15 aa, Artificial Sequence
  Description of Artificial Sequence: Synthetic peptide
  XENP021821 vhCDR3
WNLSYYFDNNYYLDY

SEQ ID NO: 26317 - protein, 219 aa, Artificial Sequence
  Description of Artificial Sequence: Synthetic polypeptide
  XENP021821 GSK_88.2[ICOS]_H0L0_IgG1_PVA_/S267K Light Chain
DIVMTQAAPSVPVTPGESVSISCRSSKSLLHSNGNTYLYWFLQRPGQSPQLLIYRMSNLASGVPDRFSGSGSGTAFTLRISRVEAEDVGVYYCMQHLEYPWTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 26318 - protein, 112 aa, Artificial Sequence
  Description of Artificial Sequence: Synthetic polypeptide
  VL of XENP021821
DIVMTQAAPSVPVTPGESVSISCRSSKSLLHSNGNTYLYWFLQRPGQSPQLLIYRMSNLASGVPDRFSGSGSGTAFTLRISRVEAEDVGVYYCMQHLEYPWTFGGGTKLEIK

SEQ ID NO: 26319 - protein, 16 aa, Artificial Sequence
  Description of Artificial Sequence: Synthetic peptide
  XENP021821 vlCDR1
RSSKSLLHSNGNTYLY

SEQ ID NO: 26320 - protein, 7 aa, Artificial Sequence
  Description of Artificial Sequence: Synthetic peptide
  XENP021821 vlCDR2
RMSNLAS

SEQ ID NO: 26321 - protein, 9 aa, Artificial Sequence
  Description of Artificial Sequence: Synthetic peptide
  XENP021821 vlCDR3
MQHLEYPWT

SEQ ID NO: 26322 - protein, 454 aa, Artificial Sequence
  Description of Artificial Sequence: Synthetic polypeptide
  XENP021822 jMab-138[ICOS]_H0L0_IgG1_PVA_/S267K Heavy Chain
EVQLVESGGGLVQPGGSLRLSCAASGFTFSSYDMHWVRQATGKGLEWVSAIGTAGDTYYPGSVKGRFTISRENAKNSLYLQMNSLRAGDTAVYYCVRDNRKVTHEHYYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 26323 - protein, 125 aa, Artificial Sequence
  Description of Artificial Sequence: Synthetic polypeptide
  VH of XENP021822
EVQLVESGGGLVQPGGSLRLSCAASGFTFSSYDMHWVRQATGKGLEWVSAIGTAGDTYYPGSVKGRFTISRENAKNSLYLQMNSLRAGDTAVYYCVRDNRKVTHEHYYYYGMDVWGQGTTVTVSS

SEQ ID NO: 26324 - protein, 5 aa, Artificial Sequence
  Description of Artificial Sequence: Synthetic peptide
  XENP021822 vhCDR1
SYDMH

SEQ ID NO: 26325 - protein, 16 aa, Artificial Sequence
  Description of Artificial Sequence: Synthetic peptide
  XENP021822 vhCDR2
AIGTAGDTYYPGSVKG

SEQ ID NO: 26326 - protein, 17 aa, Artificial Sequence
  Description of Artificial Sequence: Synthetic peptide
  XENP021822 vhCDR3
DNRKVTHEHYYYYGMDV

SEQ ID NO: 26327 - protein, 216 aa, Artificial Sequence
  Description of Artificial Sequence: Synthetic polypeptide
  XENP021822 jMab-138[ICOS]_H0L0_IgG1_PVA_/S267K Light Chain
EIVLTQSPGTLSLSPGERATLSCRASQNIRSSYLAWYQQKPGQAPGLLIYGASSRATGIPDRFSGSGSGTDFTLTISRLEPEDFAVYYCQQFGSSPMCSFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 26328 - protein, 109 aa, Artificial Sequence
  Description of Artificial Sequence: Synthetic polypeptide
  VL of XENP021822
EIVLTQSPGTLSLSPGERATLSCRASQNIRSSYLAWYQQKPGQAPGLLIYGASSRATGIPDRFSGSGSGTDFTLTISRLEPEDFAVYYCQQFGSSPMCSFGQGTKLEIK

SEQ ID NO: 26329 - protein, 12 aa, Artificial Sequence
  Description of Artificial Sequence: Synthetic peptide
  XENP021822 vlCDR1
RASQNIRSSYLA

SEQ ID NO: 26330 - protein, 7 aa, Artificial Sequence
  Description of Artificial Sequence: Synthetic peptide
  XENP021822 vlCDR2
GASSRAT

SEQ ID NO: 26331 - protein, 10 aa, Artificial Sequence
  Description of Artificial Sequence: Synthetic peptide
  XENP021822 vlCDR3
QQFGSSPMCS

SEQ ID NO: 26332 - protein, 454 aa, Artificial Sequence
  Description of Artificial Sequence: Synthetic polypeptide
  XENP021823 jMab-139[ICOS]_H0L0_IgG1_PVA_/S267K Heavy Chain
EVQLVESGGGLVQPGGSLRLSCAASGFTFSSYDMHWVRQATGKGLEWVSAIGTAGDTYYPGSVKGRFTISRENAKNSLYLQMNSLRAGDTAVYYCVRDKRTVTHEHYYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 26333 - protein, 125 aa, Artificial Sequence
  Description of Artificial Sequence: Synthetic polypeptide
  VH of XENP021823
EVQLVESGGGLVQPGGSLRLSCAASGFTFSSYDMHWVRQATGKGLEWVSAIGTAGDTYYPGSVKGRFTISRENAKNSLYLQMNSLRAGDTAVYYCVRDKRTVTHEHYYYYGMDVWGQGTTVTVSS

SEQ ID NO: 26334 - protein, 5 aa, Artificial Sequence
  Description of Artificial Sequence: Synthetic peptide
  XENP021823 vhCDR1
SYDMH

SEQ ID NO: 26335 - protein, 16 aa, Artificial Sequence
  Description of Artificial Sequence: Synthetic peptide
  XENP021823 vhCDR2
AIGTAGDTYYPGSVKG

SEQ ID NO: 26336 - protein, 17 aa, Artificial Sequence
  Description of Artificial Sequence: Synthetic peptide
  XENP021823 vhCDR3
DKRTVTHEHYYYYGMDV

SEQ ID NO: 26337 - protein, 216 aa, Artificial Sequence
  Description of Artificial Sequence: Synthetic polypeptide
  XENP021823 jMab-139[ICOS]_H0L0_IgG1_PVA_/S267K Light Chain
EIVLTQSPGTLSLSPGERATLSCRASQSISSSSLAWYQQKPGQAPGLLIFGASSRATGIPDRFSGSGSGTDFTLTISRLEPEDFAVYYCQQFGSSPMCSFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 26338 - protein, 109 aa, Artificial Sequence
  Description of Artificial Sequence: Synthetic polypeptide
  VL of XENP021823
EIVLTQSPGTLSLSPGERATLSCRASQSISSSSLAWYQQKPGQAPGLLIFGASSRATGIPDRFSGSGSGTDFTLTISRLEPEDFAVYYCQQFGSSPMCSFGQGTKLEIK

SEQ ID NO: 26339 - protein, 12 aa, Artificial Sequence
  Description of Artificial Sequence: Synthetic peptide
  XENP021823 vlCDR1
RASQSISSSSLA

SEQ ID NO: 26340 - protein, 7 aa, Artificial Sequence
  Description of Artificial Sequence: Synthetic peptide
  XENP021823 vlCDR2
GASSRAT

SEQ ID NO: 26341 - protein, 10 aa, Artificial Sequence
  Description of Artificial Sequence: Synthetic peptide
  XENP021823 vlCDR3
QQFGSSPMCS

SEQ ID NO: 26342 - protein, 450 aa, Artificial Sequence
  Description of Artificial Sequence: Synthetic polypeptide
  XENP022346 WO2016059602_GSK[ICOS]_H0L0_IgG1_PVA_/S267K Heavy Chain
QVQLVQSGAEVKKPGSSVKVSCKASGYTFTDYAMHWVRQAPGQGLEWMGLISIYSDHTNYNQKFQGRVTITADKSTSTAYMELSSLRSEDTAVYYCGRNNYGNYGWYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 26343 - protein, 121 aa, Artificial Sequence
  Description of Artificial Sequence: Synthetic polypeptide
  VH of XENP022346
QVQLVQSGAEVKKPGSSVKVSCKASGYTFTDYAMHWVRQAPGQGLEWMGLISIYSDHTNYNQKFQGRVTITADKSTSTAYMELSSLRSEDTAVYYCGRNNYGNYGWYFDVWGQGTTVTVSS

SEQ ID NO: 26344 - protein, 5 aa, Artificial Sequence
  Description of Artificial Sequence: Synthetic peptide
  XENP022346 vhCDR1
DYAMH

SEQ ID NO: 26345 - protein, 17 aa, Artificial Sequence
  Description of Artificial Sequence: Synthetic peptide
  XENP022346 vhCDR2
LISIYSDHTNYNQKFQG

SEQ ID NO: 26346 - protein, 12 aa, Artificial Sequence
  Description of Artificial Sequence: Synthetic peptide
  XENP022346 vhCDR3
NNYGNYGWYFDV

SEQ ID NO: 26347 - protein, 213 aa, Artificial Sequence
  Description of Artificial Sequence: Synthetic polypeptide
  XENP022346 WO2016059602_GSK[ICOS]_H0L0_IgG1_PVA_/S267K Light Chain
EIVLTQSPATLSLSPGERATLSCSASSSVSYMHWYQQKPGQAPRLLIYDTSKLASGIPARFSGSGSGTDYTLTISSLEPEDFAVYYCFQGSGYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 26348 - protein, 106 aa, Artificial Sequence
  Description of Artificial Sequence: Synthetic polypeptide
  VL of XENP022346
EIVLTQSPATLSLSPGERATLSCSASSSVSYMHWYQQKPGQAPRLLIYDTSKLASGIPARFSGSGSGTDYTLTISSLEPEDFAVYYCFQGSGYPYTFGQGTKLEIK

SEQ ID NO: 26349 - protein, 10 aa, Artificial Sequence
  Description of Artificial Sequence: Synthetic peptide
  XENP022346 vlCDR1
SASSSVSYMH

SEQ ID NO: 26350 - protein, 7 aa, Artificial Sequence
  Description of Artificial Sequence: Synthetic peptide
  XENP022346 vlCDR2
DTSKLAS

SEQ ID NO: 26351 - protein, 9 aa, Artificial Sequence
  Description of Artificial Sequence: Synthetic peptide
  XENP022346 vlCDR3
FQGSGYPYT

SEQ ID NO: 26352 - protein, 446 aa, Artificial Sequence
  Description of Artificial Sequence: Synthetic polypeptide
  XENP023057 Jounce_37A10S713[ICOS]_H0L0_IgG1_PVA_/S267K Heavy Chain
EVQLVESGGGLVQPGGSLRLSCAASGFTFSDYWMDWVRQAPGKGLVWVSNIDEDGSITEYSPFVKGRFTISRDNAKNTLYLQMNSLRAEDTAVYYCTRWGRFGFDSWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 26353 - protein, 117 aa, Artificial Sequence
  Description of Artificial Sequence: Synthetic polypeptide
  VH of XENP023057
EVQLVESGGGLVQPGGSLRLSCAASGFTFSDYWMDWVRQAPGKGLVWVSNIDEDGSITEYSPFVKGRFTISRDNAKNTLYLQMNSLRAEDTAVYYCTRWGRFGFDSWGQGTLVTVSS

SEQ ID NO: 26354 - protein, 5 aa, Artificial Sequence
  Description of Artificial Sequence: Synthetic peptide
  XENP023057 vhCDR1
DYWMD

SEQ ID NO: 26355 - protein, 17 aa, Artificial Sequence
  Description of Artificial Sequence: Synthetic peptide
  XENP023057 vhCDR2
NIDEDGSITEYSPFVKG

SEQ ID NO: 26356 - protein, 8 aa, Artificial Sequence
  Description of Artificial Sequence: Synthetic peptide
  XENP023057 vhCDR3
WGRFGFDS

SEQ ID NO: 26357 - protein, 218 aa, Artificial Sequence
  Description of Artificial Sequence: Synthetic polypeptide
  XENP023057 Jounce_37A10S713[ICOS]_H0L0_IgG1_PVA_/S267K Light Chain
DIVMTQSPDSLAVSLGERATINCKSSQSLLSGSFNYLTWYQQKPGQPPKLLIFYASTRHTGVPDRFSGSGSGTDFTLTISSLQAEDVAVYYCHHHYNAPPTFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 26358 - protein, 111 aa, Artificial Sequence
  Description of Artificial Sequence: Synthetic polypeptide
  VL of XENP023057
DIVMTQSPDSLAVSLGERATINCKSSQSLLSGSFNYLTWYQQKPGQPPKLLIFYASTRHTGVPDRFSGSGSGTDFTLTISSLQAEDVAVYYCHHHYNAPPTFGPGTKVDIK

SEQ ID NO: 26359 - protein, 15 aa, Artificial Sequence
  Description of Artificial Sequence: Synthetic peptide
  XENP023057 vlCDR1
KSSQSLLSGSFNYLT

SEQ ID NO: 26360 - protein, 7 aa, Artificial Sequence
  Description of Artificial Sequence: Synthetic peptide
  XENP023057 vlCDR2
YASTRHT

SEQ ID NO: 26361 - protein, 9 aa, Artificial Sequence
  Description of Artificial Sequence: Synthetic peptide
  XENP023057 vlCDR3
HHHYNAPPT

SEQ ID NO: 26362 - protein, 454 aa, Artificial Sequence
  Description of Artificial Sequence: Synthetic polypeptide
  XENP022730 [ICOS]_H0L0_Fab-1G6_L1.194_H1.279 Fab-Fc Heavy Chain
QVQLVQSGAEVKKPGASVKVSCKASGYTFTGYYMHWVRQAPGQGLEWMGWINPHSGGTNYAQKFQGRVTMTRDTSISTAYMELSRLRSDDTAVYYCARTYYYDSSGYYHDAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVLHEALHSHYTQKSLSLSPGK

SEQ ID NO: 26363 - protein, 125 aa, Artificial Sequence; identical to SEQ ID NO: 26293
  Description of Artificial Sequence: Synthetic polypeptide
  VH of XENP022730

SEQ ID NO: 26364 - protein, 5 aa, Artificial Sequence
  Description of Artificial Sequence: Synthetic peptide
  XENP022730 vhCDR1
GYYMH

SEQ ID NO: 26365 - protein, 17 aa, Artificial Sequence
  Description of Artificial Sequence: Synthetic peptide
  XENP022730 vhCDR2
WINPHSGGTNYAQKFQG

SEQ ID NO: 26366 - protein, 16 aa, Artificial Sequence
  Description of Artificial Sequence: Synthetic peptide
  XENP022730 vhCDR3
TYYYDSSGYYHDAFDI

SEQ ID NO: 26367 - protein, 480 aa, Artificial Sequence; identical to SEQ ID NO: 2930
  Description of Artificial Sequence: Synthetic polypeptide
  XENP022730 [ICOS]_H0L0_Fab-1G6_L1.194_H1.279 scFv-Fc Heavy Chain

SEQ ID NO: 26368 - protein, 107 aa, Artificial Sequence; identical to SEQ ID NO: 2871
  Description of Artificial Sequence: Synthetic polypeptide
  VH of XENP022730

SEQ ID NO: 26369 - protein, 122 aa, Artificial Sequence; identical to SEQ ID NO: 2872
  Description of Artificial Sequence: Synthetic polypeptide
  VL of XENP022730

SEQ ID NO: 26370 - protein, 231 aa, Artificial Sequence; identical to SEQ ID NO: 2409
  Description of Artificial Sequence: Synthetic polypeptide
  Fc chain of XENP022730

SEQ ID NO: 26371 - protein, 11 aa, Artificial Sequence
  Description of Artificial Sequence: Synthetic peptide
  XENP022730 vhCDR1
RASQSVGNDVA

SEQ ID NO: 26372 - protein, 7 aa, Artificial Sequence
  Description of Artificial Sequence: Synthetic peptide
  XENP022730 vhCDR2
YASHRYT

SEQ ID NO: 26373 - protein, 9 aa, Artificial Sequence
  Description of Artificial Sequence: Synthetic peptide
  XENP022730 vhCDR3
QQDFSSPRT

SEQ ID NO: 26374 - protein, 5 aa, Artificial Sequence
  Description of Artificial Sequence: Synthetic peptide
  XENP022730 vlCDR1
NYWMN

SEQ ID NO: 26375 - protein, 19 aa, Artificial Sequence
  Description of Artificial Sequence: Synthetic peptide
  XENP022730 vlCDR2
EIRLYSNNYATHYAESVKG

SEQ ID NO: 26376 - protein, 11 aa, Artificial Sequence
  Description of Artificial Sequence: Synthetic peptide
  XENP022730 vlCDR3
YYGNYGGYFDV

SEQ ID NO: 26377 - protein, 214 aa, Artificial Sequence; identical to SEQ ID NO: 26297
  Description of Artificial Sequence: Synthetic polypeptide
  XENP022730 [ICOS]_H0L0_Fab-1G6_L1.194_H1.279 Light Chain

SEQ ID NO: 26378 - protein, 107 aa, Artificial Sequence; identical to SEQ ID NO: 26298
  Description of Artificial Sequence: Synthetic polypeptide
  VL of XENP022730

SEQ ID NO: 26379 - protein, 11 aa, Artificial Sequence
  Description of Artificial Sequence: Synthetic peptide
  XENP022730 vlCDR1
RASQGISRLLA

SEQ ID NO: 26380 - protein, 7 aa, Artificial Sequence
  Description of Artificial Sequence: Synthetic peptide
  XENP022730 vlCDR2
VASSLQS

SEQ ID NO: 26381 - protein, 9 aa, Artificial Sequence
  Description of Artificial Sequence: Synthetic peptide
  XENP022730 vlCDR3
QQANSFPWT

SEQ ID NO: 26382 - protein, 447 aa, Artificial Sequence
  Description of Artificial Sequence: Synthetic polypeptide
  XENP023377 11D4[OX40]_H0L0_Fab-1G6_L1.194_H1.279_scFv Fab-Fc Heavy Chain
EVQLVESGGGLVQPGGSLRLSCAASGFTFSSYSMNWVRQAPGKGLEWVSYISSSSSTIDYADSVKGRFTISRDNAKNSLYLQMNSLRDEDTAVYYCARESGWYLFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 26383 - protein, 118 aa, Artificial Sequence; identical to SEQ ID NO: 26273
  Description of Artificial Sequence: Synthetic polypeptide
  VH of XENP023377

SEQ ID NO: 26384 - protein, 5 aa, Artificial Sequence
  Description of Artificial Sequence: Synthetic peptide
  XENP023377 vhCDR1
SYSMN

SEQ ID NO: 26385 - protein, 11 aa, Artificial Sequence
  Description of Artificial Sequence: Synthetic peptide
  XENP023377 vhCDR2
YISSSSSTIDY

SEQ ID NO: 26386 - protein, 9 aa, Artificial Sequence
  Description of Artificial Sequence: Synthetic peptide
  XENP023377 vhCDR3
ESGWYLFDY

SEQ ID NO: 26387 - protein, 480 aa, Artificial Sequence; identical to SEQ ID NO: 2870
  Description of Artificial Sequence: Synthetic polypeptide
  XENP023377 11D4[OX40]_H0L0_Fab-1G6_L1.194_H1.279_scFv scFv-Fc Heavy Chain

SEQ ID NO: 26388 - protein, 107 aa, Artificial Sequence; identical to SEQ ID NO: 2871
  Description of Artificial Sequence: Synthetic polypeptide
  VH of XENP023377

SEQ ID NO: 26389 - protein, 122 aa, Artificial Sequence; identical to SEQ ID NO: 2872
  Description of Artificial Sequence: Synthetic polypeptide
  VL of XENP023377

SEQ ID NO: 26390 - protein, 231 aa, Artificial Sequence; identical to SEQ ID NO: 2397
  Description of Artificial Sequence: Synthetic polypeptide
  Fc chain of XENP023377

SEQ ID NO: 26391 - protein, 11 aa, Artificial Sequence
  Description of Artificial Sequence: Synthetic peptide
  XENP023377 vhCDR1
RASQSVGNDVA

SEQ ID NO: 26392 - protein, 7 aa, Artificial Sequence
  Description of Artificial Sequence: Synthetic peptide
  XENP023377 vhCDR2
YASHRYT

SEQ ID NO: 26393 - protein, 9 aa, Artificial Sequence
  Description of Artificial Sequence: Synthetic peptide
  XENP023377 vhCDR3
QQDFSSPRT

SEQ ID NO: 26394 - protein, 5 aa, Artificial Sequence
  Description of Artificial Sequence: Synthetic peptide
  XENP023377 vlCDR1
NYWMN

SEQ ID NO: 26395 - protein, 19 aa, Artificial Sequence
  Description of Artificial Sequence: Synthetic peptide
  XENP023377 vlCDR2
EIRLYSNNYATHYAESVKG

SEQ ID NO: 26396 - protein, 11 aa, Artificial Sequence
  Description of Artificial Sequence: Synthetic peptide
  XENP023377 vlCDR3
YYGNYGGYFDV

SEQ ID NO: 26397 - protein, 214 aa, Artificial Sequence; identical to SEQ ID NO: 26277
  Description of Artificial Sequence: Synthetic polypeptide
  XENP023377 11D4[OX40]_H0L0_Fab-1G6_L1.194_H1.279_scFv Light Chain

SEQ ID NO: 26398 - protein, 107 aa, Artificial Sequence; identical to SEQ ID NO: 26278
  Description of Artificial Sequence: Synthetic polypeptide
  VL of XENP023377

SEQ ID NO: 26399 - protein, 11 aa, Artificial Sequence
  Description of Artificial Sequence: Synthetic peptide
  XENP023377 vlCDR1
RASQGISSWLA

SEQ ID NO: 26400 - protein, 7 aa, Artificial Sequence
  Description of Artificial Sequence: Synthetic peptide
  XENP023377 vlCDR2
AASSLQS

SEQ ID NO: 26401 - protein, 9 aa, Artificial Sequence
  Description of Artificial Sequence: Synthetic peptide
  XENP023377 vlCDR3
QQYNSYPPT

SEQ ID NO: 26402 - protein, 451 aa, Artificial Sequence
  Description of Artificial Sequence: Synthetic polypeptide
  XENP023378 1D8[GITR]_H0L0_Fab-1G6_L1.194_H1.279_scFv Fab-Fc Heavy Chain
QVTLKESGPGILKPSQTLSLTCSFSGFSLSTSGMGVGWIRQPSGKGLEWLAHIWWDDDKYYSPSLKSQLTISKDTSRNQVFLKITSLDTADTATYYCVRSYYYGSSGAMDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 26403 - protein, 122 aa, Artificial Sequence; identical to SEQ ID NO: 26283
  Description of Artificial Sequence: Synthetic polypeptide
  VH of XENP023378

SEQ ID NO: 26404 - protein, 7 aa, Artificial Sequence
  Description of Artificial Sequence: Synthetic peptide
  XENP023378 vhCDR1
TSGMGVG

SEQ ID NO: 26405 - protein, 9 aa, Artificial Sequence
  Description of Artificial Sequence: Synthetic peptide
  XENP023378 vhCDR2
HIWWDDDKY

SEQ ID NO: 26406 - protein, 12 aa, Artificial Sequence
  Description of Artificial Sequence: Synthetic peptide
  XENP023378 vhCDR3
SYYYGSSGAMDY

SEQ ID NO: 26407 - protein, 480 aa, Artificial Sequence; identical to SEQ ID NO: 2870
  Description of Artificial Sequence: Synthetic polypeptide
  XENP023378 1D8[GITR]_H0L0_Fab-1G6_L1.194_H1.279_scFv scFv-Fc Heavy Chain

SEQ ID NO: 26408 - protein, 107 aa, Artificial Sequence; identical to SEQ ID NO: 2871
  Description of Artificial Sequence: Synthetic polypeptide
  VH of XENP023378

SEQ ID NO: 26409 - protein, 122 aa, Artificial Sequence; identical to SEQ ID NO: 2872
  Description of Artificial Sequence: Synthetic polypeptide
  VL of XENP023378

SEQ ID NO: 26410 - protein, 231 aa, Artificial Sequence; identical to SEQ ID NO: 2397
  Description of Artificial Sequence: Synthetic polypeptide
  Fc chain of XENP023378

SEQ ID NO: 26411 - protein, 11 aa, Artificial Sequence
  Description of Artificial Sequence: Synthetic peptide
  XENP023378 vhCDR1
RASQSVGNDVA

SEQ ID NO: 26412 - protein, 7 aa, Artificial Sequence
  Description of Artificial Sequence: Synthetic peptide
  XENP023378 vhCDR2
YASHRYT

SEQ ID NO: 26413 - protein, 9 aa, Artificial Sequence
  Description of Artificial Sequence: Synthetic peptide
  XENP023378 vhCDR3
QQDFSSPRT

SEQ ID NO: 26414 - protein, 5 aa, Artificial Sequence
  Description of Artificial Sequence: Synthetic peptide
  XENP023378 vlCDR1
NYWMN

SEQ ID NO: 26415 - protein, 19 aa, Artificial Sequence
  Description of Artificial Sequence: Synthetic peptide
  XENP023378 vlCDR2
EIRLYSNNYATHYAESVKG

SEQ ID NO: 26416 - protein, 11 aa, Artificial Sequence
  Description of Artificial Sequence: Synthetic peptide
  XENP023378 vlCDR3
YYGNYGGYFDV

SEQ ID NO: 26417 - protein, 219 aa, Artificial Sequence; identical to SEQ ID NO: 26287
  Description of Artificial Sequence: Synthetic polypeptide
  XENP023378 1D8[GITR]_H0L0_Fab-1G6_L1.194_H1.279_scFv Light Chain

SEQ ID NO: 26418 - protein, 112 aa, Artificial Sequence; identical to SEQ ID NO: 26288
  Description of Artificial Sequence: Synthetic polypeptide
  VL of XENP023378

SEQ ID NO: 26419 - protein, 16 aa, Artificial Sequence
  Description of Artificial Sequence: Synthetic peptide
  XENP023378 vlCDR1
RSSQSLVHSDGNTYLH

SEQ ID NO: 26420 - protein, 6 aa, Artificial Sequence
  Description of Artificial Sequence: Synthetic peptide
  XENP023378 vlCDR2
KVSKRF

SEQ ID NO: 26421 - protein, 9 aa, Artificial Sequence
  Description of Artificial Sequence: Synthetic peptide
  XENP023378 vlCDR3
SQSTHVPPT

SEQ ID NO: 26422 - protein, 450 aa, Artificial Sequence
  Description of Artificial Sequence: Synthetic polypeptide
  XENP023379 20H4.9[4-1BB]_H0L0_Fab-1G6_L1.194_H1.279_scFv Fab-Fc Heavy Chain
QVQLQQWGAGLLKPSETLSLTCAVYGGSFSGYYWSWIRQSPEKGLEWIGEINHGGYVTYNPSLESRVTISVDTSKNQFSLKLSSVTAADTAVYYCARDYGPGNYDWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 26423 - protein, 121 aa, Artificial Sequence [sequence omitted]

SEQ ID NO: 26424 - protein, 5 aa, Artificial Sequence
  Description of Artificial Sequence: Synthetic peptide
  XENP023379 vhCDR1
GYYWS

SEQ ID NO: 26425 - protein, 11 aa, Artificial Sequence
  Description of Artificial Sequence: Synthetic peptide
  XENP023379 vhCDR2
EINHGGYVTYN

SEQ ID NO: 26426 - protein, 13 aa, Artificial Sequence
  Description of Artificial Sequence: Synthetic peptide
  XENP023379 vhCDR3
DYGPGNYDWYFDL

SEQ ID NO: 26427 - protein, 480 aa, Artificial Sequence; identical to SEQ ID NO: 2870
  Description of Artificial Sequence: Synthetic polypeptide
  XENP023379 20H4.9[4-1BB]_H0L0_Fab-1G6_L1.194_H1.279_scFv scFv-Fc Heavy Chain

SEQ ID NO: 26428 - protein, 107 aa, Artificial Sequence; identical to SEQ ID NO: 2871
  Description of Artificial Sequence: Synthetic polypeptide
  VH of XENP023379

SEQ ID NO: 26429 - protein, 122 aa, Artificial Sequence; identical to SEQ ID NO: 2872
  Description of Artificial Sequence: Synthetic polypeptide
  VL of XENP023379

SEQ ID NO: 26430 - protein, 231 aa, Artificial Sequence; identical to SEQ ID NO: 2397
  Description of Artificial Sequence: Synthetic polypeptide
  Fc chain of XENP023379

SEQ ID NO: 26431 - protein, 11 aa, Artificial Sequence
  Description of Artificial Sequence: Synthetic peptide
  XENP023379 vhCDR1
RASQSVGNDVA

SEQ ID NO: 26432 - protein, 7 aa, Artificial Sequence
  Description of Artificial Sequence: Synthetic peptide
  XENP023379 vhCDR2
YASHRYT

SEQ ID NO: 26433 - protein, 9 aa, Artificial Sequence
  Description of Artificial Sequence: Synthetic peptide
  XENP023379 vhCDR3
QQDFSSPRT

SEQ ID NO: 26434 - protein, 5 aa, Artificial Sequence
  Description of Artificial Sequence: Synthetic peptide
  XENP023379 vlCDR1
NYWMN

SEQ ID NO: 26435 - protein, 19 aa, Artificial Sequence
  Description of Artificial Sequence: Synthetic peptide
  XENP023379 vlCDR2
EIRLYSNNYATHYAESVKG

SEQ ID NO: 26436 - protein, 11 aa, Artificial Sequence
  Description of Artificial Sequence: Synthetic peptide
  XENP023379 vlCDR3
YYGNYGGYFDV

SEQ ID NO: 26437 - protein, 216 aa, Artificial Sequence; identical to SEQ ID NO: 26267
  Description of Artificial Sequence: Synthetic polypeptide
  XENP023379 20H4.9[4-1BB]_H0L0_Fab-1G6_L1.194_H1.279_scFv Light Chain

SEQ ID NO: 26438 - protein, 109 aa, Artificial Sequence [sequence omitted]

SEQ ID NO: 26439 - protein, 11 aa, Artificial Sequence
  Description of Artificial Sequence: Synthetic peptide
  XENP023379 vlCDR1
RASQSVSSYLA

SEQ ID NO: 26440 - protein, 7 aa, Artificial Sequence
  Description of Artificial Sequence: Synthetic peptide
  XENP023379 vlCDR2
DASNRAT

SEQ ID NO: 26441 - protein, 11 aa, Artificial Sequence
  Description of Artificial Sequence: Synthetic peptide
  XENP023379 vlCDR3
QQRSNWPPALT

SEQ ID NO: 26442 - protein, 454 aa, Artificial Sequence
  Description of Artificial Sequence: Synthetic polypeptide
  XENP020896 [ICOS]_H0L0_Fab-1G6_L1.194_H1.279 Fab-Fc Heavy Chain
QVQLVQSGAEVKKPGASVKVSCKASGYTFTGYYMHWVRQAPGQGLEWMGWINPHSGGTNYAQKFQGRVTMTRDTSISTAYMELSRLRSDDTAVYYCARTYYYDSSGYYHDAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 26443 - protein, 125 aa, Artificial Sequence; identical to SEQ ID NO: 26293
  Description of Artificial Sequence: Synthetic polypeptide
  VH of XENP020896

SEQ ID NO: 26444 - protein, 5 aa, Artificial Sequence
  Description of Artificial Sequence: Synthetic peptide
  XENP020896 vhCDR1
GYYMH

SEQ ID NO: 26445 - protein, 17 aa, Artificial Sequence
  Description of Artificial Sequence: Synthetic peptide
  XENP020896 vhCDR2
WINPHSGGTNYAQKFQG

SEQ ID NO: 26446 - protein, 16 aa, Artificial Sequence
  Description of Artificial Sequence: Synthetic peptide
  XENP020896 vhCDR3
TYYYDSSGYYHDAFDI

SEQ ID NO: 26447 - protein, 480 aa, Artificial Sequence; identical to SEQ ID NO: 2870
  Description of Artificial Sequence: Synthetic polypeptide
  XENP020896 [ICOS]_H0L0_Fab-1G6_L1.194_H1.279 scFv-Fc Heavy Chain

SEQ ID NO: 26448 - protein, 107 aa, Artificial Sequence; identical to SEQ ID NO: 2871
  Description of Artificial Sequence: Synthetic polypeptide
  VH of XENP020896

SEQ ID NO: 26449 - protein, 122 aa, Artificial Sequence; identical to SEQ ID NO: 2872
  Description of Artificial Sequence: Synthetic polypeptide
  VL of XENP020896

SEQ ID NO: 26450 - protein, 231 aa, Artificial Sequence; identical to SEQ ID NO: 2397
  Description of Artificial Sequence: Synthetic polypeptide
  Fc chain of XENP020896

SEQ ID NO: 26451 - protein, 11 aa, Artificial Sequence
  Description of Artificial Sequence: Synthetic peptide
  XENP020896 vhCDR1
RASQSVGNDVA

SEQ ID NO: 26452 - protein, 7 aa, Artificial Sequence
  Description of Artificial Sequence: Synthetic peptide
  XENP020896 vhCDR2
YASHRYT

SEQ ID NO: 26453 - protein, 9 aa, Artificial Sequence
  Description of Artificial Sequence: Synthetic peptide
  XENP020896 vhCDR3
QQDFSSPRT

SEQ ID NO: 26454 - protein, 5 aa, Artificial Sequence
  Description of Artificial Sequence: Synthetic peptide
  XENP020896 vlCDR1
NYWMN

SEQ ID NO: 26455 - protein, 19 aa, Artificial Sequence
  Description of Artificial Sequence: Synthetic peptide
  XENP020896 vlCDR2
EIRLYSNNYATHYAESVKG

SEQ ID NO: 26456 - protein, 11 aa, Artificial Sequence
  Description of Artificial Sequence: Synthetic peptide
  XENP020896 vlCDR3
YYGNYGGYFDV

SEQ ID NO: 26457 - protein, 214 aa, Artificial Sequence; identical to SEQ ID NO: 26297
  Description of Artificial Sequence: Synthetic polypeptide
  XENP020896 [ICOS]_H0L0_Fab-1G6_L1.194_H1.279 Light Chain

SEQ ID NO: 26458 - protein, 107 aa, Artificial Sequence; identical to SEQ ID NO: 26298
  Description of Artificial Sequence: Synthetic polypeptide
  VL of XENP020896

SEQ ID NO: 26459 - protein, 11 aa, Artificial Sequence
  Description of Artificial Sequence: Synthetic peptide
  XENP020896 vlCDR1
RASQGISRLLA

SEQ ID NO: 26460 - protein, 7 aa, Artificial Sequence
  Description of Artificial Sequence: Synthetic peptide
  XENP020896 vlCDR2
VASSLQS

SEQ ID NO: 26461 - protein, 9 aa, Artificial Sequence
  Description of Artificial Sequence: Synthetic peptide
  XENP020896 vlCDR3
QQANSFPWT

SEQ ID NO: 26462 - protein, 454 aa, Artificial Sequence; identical to SEQ ID NO: 26442
  Description of Artificial Sequence: Synthetic polypeptide
  XENP022433 [ICOS]_H0_L0.7_Fab-1G6_L1.194_H1.279 Fab-Fc Heavy Chain

SEQ ID NO: 26463 - protein, 125 aa, Artificial Sequence; identical to SEQ ID NO: 26293
  Description of Artificial Sequence: Synthetic polypeptide
  VH of XENP022433

SEQ ID NO: 26464 - protein, 5 aa, Artificial Sequence
  Description of Artificial Sequence: Synthetic peptide
  XENP022433 vhCDR1
GYYMH

SEQ ID NO: 26465 - protein, 17 aa, Artificial Sequence
  Description of Artificial Sequence: Synthetic peptide
  XENP022433 vhCDR2
WINPHSGGTNYAQKFQG

SEQ ID NO: 26466 - protein, 16 aa, Artificial Sequence
  Description of Artificial Sequence: Synthetic peptide
  XENP022433 vhCDR3
TYYYDSSGYYHDAFDI

SEQ ID NO: 26467 - protein, 480 aa, Artificial Sequence; identical to SEQ ID NO: 2870
  Description of Artificial Sequence: Synthetic polypeptide
  XENP022433 [ICOS]_H0_L0.7_Fab-1G6_L1.194_H1.279 scFv-Fc Heavy Chain

SEQ ID NO: 26468 - protein, 107 aa, Artificial Sequence; identical to SEQ ID NO: 2871
  Description of Artificial Sequence: Synthetic polypeptide
  VH of XENP022433

SEQ ID NO: 26469 - protein, 122 aa, Artificial Sequence; identical to SEQ ID NO: 2872
  Description of Artificial Sequence: Synthetic polypeptide
  VL of XENP022433

SEQ ID NO: 26470 - protein, 231 aa, Artificial Sequence; identical to SEQ ID NO: 2397
  Description of Artificial Sequence: Synthetic polypeptide
  Fc chain of XENP022433

SEQ ID NO: 26471 - protein, 11 aa, Artificial Sequence
  Description of Artificial Sequence: Synthetic peptide
  XENP022433 vhCDR1
RASQSVGNDVA

SEQ ID NO: 26472 - protein, 7 aa, Artificial Sequence
  Description of Artificial Sequence: Synthetic peptide
  XENP022433 vhCDR2
YASHRYT

SEQ ID NO: 26473 - protein, 9 aa, Artificial Sequence
  Description of Artificial Sequence: Synthetic peptide
  XENP022433 vhCDR3
QQDFSSPRT

SEQ ID NO: 26474 - protein, 5 aa, Artificial Sequence
  Description of Artificial Sequence: Synthetic peptide
  XENP022433 vlCDR1
NYWMN

SEQ ID NO: 26475 - protein, 19 aa, Artificial Sequence
  Description of Artificial Sequence: Synthetic peptide
  XENP022433 vlCDR2
EIRLYSNNYATHYAESVKG

SEQ ID NO: 26476 - protein, 11 aa, Artificial Sequence
  Description of Artificial Sequence: Synthetic peptide
  XENP022433 vlCDR3
YYGNYGGYFDV

SEQ ID NO: 26477 - protein, 214 aa, Artificial Sequence
  Description of Artificial Sequence: Synthetic polypeptide
  XENP022433 [ICOS]_H0_L0.7_Fab-1G6_L1.194_H1.279 Light Chain
DIQMTQSPSSVSASVGDRVTITCRASQGISSYLAWYQQKPGKAPKLLIYVASSLQSGVPSRFSGSGSGTDFTLTISSLQPEDFATYYCQQANSFPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 26478 - protein, 107 aa, Artificial Sequence
  Description of Artificial Sequence: Synthetic polypeptide
  VL of XENP022433
DIQMTQSPSSVSASVGDRVTITCRASQGISSYLAWYQQKPGKAPKLLIYVASSLQSGVPSRFSGSGSGTDFTLTISSLQPEDFATYYCQQANSFPWTFGQGTKVEIK

SEQ ID NO: 26479 - protein, 11 aa, Artificial Sequence
  Description of Artificial Sequence: Synthetic peptide
  XENP022433 vlCDR1
RASQGISSYLA

SEQ ID NO: 26480 - protein, 7 aa, Artificial Sequence
  Description of Artificial Sequence: Synthetic peptide
  XENP022433 vlCDR2
VASSLQS

SEQ ID NO: 26481 - protein, 9 aa, Artificial Sequence
  Description of Artificial Sequence: Synthetic peptide
  XENP022433 vlCDR3
QQANSFPWT

SEQ ID NO: 26482 - protein, 454 aa, Artificial Sequence; identical to SEQ ID NO: 26442
  Description of Artificial Sequence: Synthetic polypeptide
  XENP022744 [ICOS]_H0_L0.34_Fab-1G6_L1.194_H1.279 Fab-Fc Heavy Chain

SEQ ID NO: 26483 - protein, 125 aa, Artificial Sequence; identical to SEQ ID NO: 26293
  Description of Artificial Sequence: Synthetic polypeptide
  VH of XENP022744

SEQ ID NO: 26484 - protein, 5 aa, Artificial Sequence
  Description of Artificial Sequence: Synthetic peptide
  XENP022744 vhCDR1
GYYMH

SEQ ID NO: 26485 - protein, 17 aa, Artificial Sequence
  Description of Artificial Sequence: Synthetic peptide
  XENP022744 vhCDR2
WINPHSGGTNYAQKFQG

SEQ ID NO: 26486 - protein, 16 aa, Artificial Sequence
  Description of Artificial Sequence: Synthetic peptide
  XENP022744 vhCDR3
TYYYDSSGYYHDAFDI

SEQ ID NO: 26487 - protein, 480 aa, Artificial Sequence; identical to SEQ ID NO: 2870
  Description of Artificial Sequence: Synthetic polypeptide
  XENP022744 [ICOS]_H0_L0.34_Fab-1G6_L1.194_H1.279 scFv-Fc Heavy Chain

SEQ ID NO: 26488 - protein, 107 aa, Artificial Sequence; identical to SEQ ID NO: 2871
  Description of Artificial Sequence: Synthetic polypeptide
  VH of XENP022744

SEQ ID NO: 26489 - protein, 122 aa, Artificial Sequence; identical to SEQ ID NO: 2872
  Description of Artificial Sequence: Synthetic polypeptide
  VL of XENP022744

SEQ ID NO: 26490 - protein, 231 aa, Artificial Sequence; identical to SEQ ID NO: 2397
  Description of Artificial Sequence: Synthetic polypeptide
  Fc chain of XENP022744

SEQ ID NO: 26491 - protein, 11 aa, Artificial Sequence
  Description of Artificial Sequence: Synthetic peptide
  XENP022744 vhCDR1
RASQSVGNDVA

SEQ ID NO: 26492 - protein, 7 aa, Artificial Sequence
  Description of Artificial Sequence: Synthetic peptide
  XENP022744 vhCDR2
YASHRYT

SEQ ID NO: 26493 - protein, 9 aa, Artificial Sequence
  Description of Artificial Sequence: Synthetic peptide
  XENP022744 vhCDR3
QQDFSSPRT

SEQ ID NO: 26494 - protein, 5 aa, Artificial Sequence
  Description of Artificial Sequence: Synthetic peptide
  XENP022744 vlCDR1
NYWMN

SEQ ID NO: 26495 - protein, 19 aa, Artificial Sequence
  Description of Artificial Sequence: Synthetic peptide
  XENP022744 vlCDR2
EIRLYSNNYATHYAESVKG

SEQ ID NO: 26496 - protein, 11 aa, Artificial Sequence
  Description of Artificial Sequence: Synthetic peptide
  XENP022744 vlCDR3
YYGNYGGYFDV

SEQ ID NO: 26497 - protein, 214 aa, Artificial Sequence
  Description of Artificial Sequence: Synthetic polypeptide
  XENP022744 [ICOS]_H0_L0.34_Fab-1G6_L1.194_H1.279 Light Chain
DIQMTQSPSSVSASVGDRVTITCQASQDISRLLAWYQQKPGKAPKLLIYVASSLQSGVPSRFSGSGSGTDFTLTISSLQPEDFATYYCQQAESFPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 26498 - protein, 107 aa, Artificial Sequence
  Description of Artificial Sequence: Synthetic polypeptide
  VL of XENP022744
DIQMTQSPSSVSASVGDRVTITCQASQDISRLLAWYQQKPGKAPKLLIYVASSLQSGVPSRFSGSGSGTDFTLTISSLQPEDFATYYCQQAESFPWTFGQGTKVEIK

SEQ ID NO: 26499 - protein, 11 aa, Artificial Sequence
  Description of Artificial Sequence: Synthetic peptide
  XENP022744 vlCDR1
QASQDISRLLA

SEQ ID NO: 26500 - protein, 7 aa, Artificial Sequence
  Description of Artificial Sequence: Synthetic peptide
  XENP022744 vlCDR2
VASSLQS

SEQ ID NO: 26501 - protein, 9 aa, Artificial Sequence
  Description of Artificial Sequence: Synthetic peptide
  XENP022744 vlCDR3
QQAESFPWT

SEQ ID NO: 26502 - protein, 454 aa, Artificial Sequence; identical to SEQ ID NO: 26442
  Description of Artificial Sequence: Synthetic polypeptide
  XENP022746 [ICOS]_H0_L0.36_Fab-1G6_L1.194_H1.279 Fab-Fc Heavy Chain

SEQ ID NO: 26503 - protein, 125 aa, Artificial Sequence; identical to SEQ ID NO: 26293
  Description of Artificial Sequence: Synthetic polypeptide
  VH of XENP022746

SEQ ID NO: 26504 - protein, 5 aa, Artificial Sequence
  Description of Artificial Sequence: Synthetic peptide
  XENP022746 vhCDR1
GYYMH

SEQ ID NO: 26505 - protein, 17 aa, Artificial Sequence
  Description of Artificial Sequence: Synthetic peptide
  XENP022746 vhCDR2
WINPHSGGTNYAQKFQG

SEQ ID NO: 26506 - protein, 16 aa, Artificial Sequence
  Description of Artificial Sequence: Synthetic peptide
  XENP022746 vhCDR3
TYYYDSSGYYHDAFDI

SEQ ID NO: 26507 - protein, 480 aa, Artificial Sequence; identical to SEQ ID NO: 2870
  Description of Artificial Sequence: Synthetic polypeptide
  XENP022746 [ICOS]_H0_L0.36_Fab-1G6_L1.194_H1.279 scFv-Fc Heavy Chain

SEQ ID NO: 26508 - protein, 107 aa, Artificial Sequence; identical to SEQ ID NO: 2871
  Description of Artificial Sequence: Synthetic polypeptide
  VH of XENP022746

SEQ ID NO: 26509 - protein, 122 aa, Artificial Sequence; identical to SEQ ID NO: 2872
  Description of Artificial Sequence: Synthetic polypeptide
  VL of XENP022746

SEQ ID NO: 26510 - protein, 231 aa, Artificial Sequence; identical to SEQ ID NO: 2397
  Description of Artificial Sequence: Synthetic polypeptide
  Fc chain of XENP022746

SEQ ID NO: 26511 - protein, 11 aa, Artificial Sequence
  Description of Artificial Sequence: Synthetic peptide
  XENP022746 vhCDR1
RASQSVGNDVA

SEQ ID NO: 26512 - protein, 7 aa, Artificial Sequence
  Description of Artificial Sequence: Synthetic peptide
  XENP022746 vhCDR2
YASHRYT

SEQ ID NO: 26513 - protein, 9 aa, Artificial Sequence
  Description of Artificial Sequence: Synthetic peptide
  XENP022746 vhCDR3
QQDFSSPRT

SEQ ID NO: 26514 - protein, 5 aa, Artificial Sequence
  Description of Artificial Sequence: Synthetic peptide
  XENP022746 vlCDR1
NYWMN

SEQ ID NO: 26515 - protein, 19 aa, Artificial Sequence
  Description of Artificial Sequence: Synthetic peptide
  XENP022746 vlCDR2
EIRLYSNNYATHYAESVKG

SEQ ID NO: 26516 - protein, 11 aa, Artificial Sequence
  Description of Artificial Sequence: Synthetic peptide
  XENP022746 vlCDR3
YYGNYGGYFDV

SEQ ID NO: 26517 - protein, 214 aa, Artificial Sequence
  Description of Artificial Sequence: Synthetic polypeptide
  XENP022746 [ICOS]_H0_L0.36_Fab-1G6_L1.194_H1.279 Light Chain
DIQMTQSPSSVSASVGDRVTITCQASQDISSLLAWYQQKPGKAPKLLIYVASSLQSGVPSRFSGSGSGTDFTLTISSLQPEDFATYYCQQAESFPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 26518 - protein, 107 aa, Artificial Sequence
  Description of Artificial Sequence: Synthetic polypeptide
  VL of XENP022746
DIQMTQSPSSVSASVGDRVTITCQASQDISSLLAWYQQKPGKAPKLLIYVASSLQSGVPSRFSGSGSGTDFTLTISSLQPEDFATYYCQQAESFPWTFGQGTKVEIK

SEQ ID NO: 26519 - protein, 11 aa, Artificial Sequence
  Description of Artificial Sequence: Synthetic peptide
  XENP022746 vlCDR1
QASQDISSLLA

SEQ ID NO: 26520 - protein, 7 aa, Artificial Sequence
  Description of Artificial Sequence: Synthetic peptide
  XENP022746 vlCDR2
VASSLQS

SEQ ID NO: 26521 - protein, 9 aa, Artificial Sequence
  Description of Artificial Sequence: Synthetic peptide
  XENP022746 vlCDR3
QQAESFPWT

SEQ ID NO: 26522 - protein, 454 aa, Artificial Sequence; identical to SEQ ID NO: 26442
  Description of Artificial Sequence: Synthetic polypeptide
  XENP022747 [ICOS]_H0_L0.37_Fab-1G6_L1.194_H1.279 Fab-Fc Heavy Chain

SEQ ID NO: 26523 - protein, 125 aa, Artificial Sequence; identical to SEQ ID NO: 26293
  Description of Artificial Sequence: Synthetic polypeptide
  VH of XENP022747

SEQ ID NO: 26524 - protein, 5 aa, Artificial Sequence
  Description of Artificial Sequence: Synthetic peptide
  XENP022747 vhCDR1
GYYMH

SEQ ID NO: 26525 - protein, 17 aa, Artificial Sequence
  Description of Artificial Sequence: Synthetic peptide
  XENP022747 vhCDR2
WINPHSGGTNYAQKFQG

SEQ ID NO: 26526 - protein, 16 aa, Artificial Sequence
  Description of Artificial Sequence: Synthetic peptide
  XENP022747 vhCDR3
TYYYDSSGYYHDAFDI

SEQ ID NO: 26527 - protein, 480 aa, Artificial Sequence; identical to SEQ ID NO: 2870
  Description of Artificial Sequence: Synthetic polypeptide
  XENP022747 [ICOS]_H0_L0.37_Fab-1G6_L1.194_H1.279 scFv-Fc Heavy Chain

SEQ ID NO: 26528 - protein, 107 aa, Artificial Sequence; identical to SEQ ID NO: 2871
  Description of Artificial Sequence: Synthetic polypeptide
  VH of XENP022747

SEQ ID NO: 26529 - protein, 122 aa, Artificial Sequence; identical to SEQ ID NO: 2872
  Description of Artificial Sequence: Synthetic polypeptide
  VL of XENP022747

SEQ ID NO: 26530 - protein, 231 aa, Artificial Sequence; identical to SEQ ID NO: 2397
  Description of Artificial Sequence: Synthetic polypeptide
  Fc chain of XENP022747

SEQ ID NO: 26531 - protein, 11 aa, Artificial Sequence
  Description of Artificial Sequence: Synthetic peptide
  XENP022747 vhCDR1
RASQSVGNDVA

SEQ ID NO: 26532 - protein, 7 aa, Artificial Sequence
  Description of Artificial Sequence: Synthetic peptide
  XENP022747 vhCDR2
YASHRYT

SEQ ID NO: 26533 - protein, 9 aa, Artificial Sequence
  Description of Artificial Sequence: Synthetic peptide
  XENP022747 vhCDR3
QQDFSSPRT

SEQ ID NO: 26534 - protein, 5 aa, Artificial Sequence
  Description of Artificial Sequence: Synthetic peptide
  XENP022747 vlCDR1
NYWMN

SEQ ID NO: 26535 - protein, 19 aa, Artificial Sequence
  Description of Artificial Sequence: Synthetic peptide
  XENP022747 vlCDR2
EIRLYSNNYATHYAESVKG

SEQ ID NO: 26536 - protein, 11 aa, Artificial Sequence
  Description of Artificial Sequence: Synthetic peptide
  XENP022747 vlCDR3
YYGNYGGYFDV

SEQ ID NO: 26537 - protein, 214 aa, Artificial Sequence
  Description of Artificial Sequence: Synthetic polypeptide
  XENP022747 [ICOS]_H0_L0.37_Fab-1G6_L1.194_H1.279 Light Chain
DIQMTQSPSSVSASVGDRVTITCQASQDISRLLAWYQQKPGKAPKLLIYAASSLQSGVPSRFSGSGSGTDFTLTISSLQPEDFATYYCQQAESFPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 26538 - protein, 107 aa, Artificial Sequence
  Description of Artificial Sequence: Synthetic polypeptide
  VL of XENP022747
DIQMTQSPSSVSASVGDRVTITCQASQDISRLLAWYQQKPGKAPKLLIYAASSLQSGVPSRFSGSGSGTDFTLTISSLQPEDFATYYCQQAESFPWTFGQGTKVEIK

SEQ ID NO: 26539 - protein, 11 aa, Artificial Sequence
  Description of Artificial Sequence: Synthetic peptide
  XENP022747 vlCDR1
QASQDISRLLA

SEQ ID NO: 26540 - protein, 7 aa, Artificial Sequence
  Description of Artificial Sequence: Synthetic peptide
  XENP022747 vlCDR2
AASSLQS

SEQ ID NO: 26541 - protein, 9 aa, Artificial Sequence
  Description of Artificial Sequence: Synthetic peptide
  XENP022747 vlCDR3
QQAESFPWT

SEQ ID NO: 26542 - protein, 454 aa, Artificial Sequence; identical to SEQ ID NO: 26442
  Description of Artificial Sequence: Synthetic polypeptide
  XENP022748 [ICOS]_H0_L0.38_Fab-1G6_L1.194_H1.279 Fab-Fc Heavy Chain

SEQ ID NO: 26543 - protein, 125 aa, Artificial Sequence; identical to SEQ ID NO: 26293
  Description of Artificial Sequence: Synthetic polypeptide
  VH of XENP022748

SEQ ID NO: 26544 - protein, 5 aa, Artificial Sequence
  Description of Artificial Sequence: Synthetic peptide
  XENP022748 vhCDR1
GYYMH

SEQ ID NO: 26545 - protein, 17 aa, Artificial Sequence
  Description of Artificial Sequence: Synthetic peptide
  XENP022748 vhCDR2
WINPHSGGTNYAQKFQG

SEQ ID NO: 26546 - protein, 16 aa, Artificial Sequence
  Description of Artificial Sequence: Synthetic peptide
  XENP022748 vhCDR3
TYYYDSSGYYHDAFDI

SEQ ID NO: 26547 - protein, 480 aa, Artificial Sequence; identical to SEQ ID NO: 2870
  Description of Artificial Sequence: Synthetic polypeptide
  XENP022748 [ICOS]_H0_L0.38_Fab-1G6_L1.194_H1.279 scFv-Fc Heavy Chain

SEQ ID NO: 26548 - protein, 107 aa, Artificial Sequence; identical to SEQ ID NO: 2871
  Description of Artificial Sequence: Synthetic polypeptide
  VH of XENP022748

SEQ ID NO: 26549 - protein, 122 aa, Artificial Sequence; identical to SEQ ID NO: 2872
  Description of Artificial Sequence: Synthetic polypeptide
  VL of XENP022748

SEQ ID NO: 26550 - protein, 231 aa, Artificial Sequence; identical to SEQ ID NO: 2397
  Description of Artificial Sequence: Synthetic polypeptide
  Fc chain of XENP022748

SEQ ID NO: 26551 - protein, 11 aa, Artificial Sequence
  Description of Artificial Sequence: Synthetic peptide
  XENP022748 vhCDR1
RASQSVGNDVA

SEQ ID NO: 26552 - protein, 7 aa, Artificial Sequence
  Description of Artificial Sequence: Synthetic peptide
  XENP022748 vhCDR2
YASHRYT

SEQ ID NO: 26553 - protein, 9 aa, Artificial Sequence
  Description of Artificial Sequence: Synthetic peptide
  XENP022748 vhCDR3
QQDFSSPRT

SEQ ID NO: 26554 - protein, 5 aa, Artificial Sequence
  Description of Artificial Sequence: Synthetic peptide
  XENP022748 vlCDR1
NYWMN

SEQ ID NO: 26555 - protein, 19 aa, Artificial Sequence
  Description of Artificial Sequence: Synthetic peptide
  XENP022748 vlCDR2
EIRLYSNNYATHYAESVKG

SEQ ID NO: 26556 - protein, 11 aa, Artificial Sequence
  Description of Artificial Sequence: Synthetic peptide
  XENP022748 vlCDR3
YYGNYGGYFDV

SEQ ID NO: 26557 - protein, 214 aa, Artificial Sequence
  Description of Artificial Sequence: Synthetic polypeptide
  XENP022748 [ICOS]_H0_L0.38_Fab-1G6_L1.194_H1.279 Light Chain
DIQMTQSPSSVSASVGDRVTITCQASQDISSLLAWYQQKPGKAPKLLIYAASSLQSGVPSRFSGSGSGTDFTLTISSLQPEDFATYYCQQAESFPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 26558 - protein, 107 aa, Artificial Sequence
  Description of Artificial Sequence: Synthetic polypeptide
  VL of XENP022748
DIQMTQSPSSVSASVGDRVTITCQASQDISSLLAWYQQKPGKAPKLLIYAASSLQSGVPSRFSGSGSGTDFTLTISSLQPEDFATYYCQQAESFPWTFGQGTKVEIK

SEQ ID NO: 26559 - protein, 11 aa, Artificial Sequence
  Description of Artificial Sequence: Synthetic peptide
  XENP022748 vlCDR1
QASQDISSLLA

SEQ ID NO: 26560 - protein, 7 aa, Artificial Sequence
  Description of Artificial Sequence: Synthetic peptide
  XENP022748 vlCDR2
AASSLQS

SEQ ID NO: 26561 - protein, 9 aa, Artificial Sequence
  Description of Artificial Sequence: Synthetic peptide
  XENP022748 vlCDR3
QQAESFPWT

SEQ ID NO: 26562 - protein, 454 aa, Artificial Sequence
  Description of Artificial Sequence: Synthetic polypeptide
  XENP023092 [ICOS]_H0.66_L0_Fab-1G6_L1.194_H1.279 Fab-Fc Heavy Chain
QVQLVQSGAEVKKPGASVKVSCKASGYTFTGYYMHWVRQAPGQGLEWMGWINPHSGETIYAQKFQGRVTMTRDTSISTAYMELSSLRSEDTAVYYCARTYYYDTSGYYHDAFDVWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 26563 - protein, 125 aa, Artificial Sequence
  Description of Artificial Sequence: Synthetic polypeptide
  VH of XENP023092
QVQLVQSGAEVKKPGASVKVSCKASGYTFTGYYMHWVRQAPGQGLEWMGWINPHSGETIYAQKFQGRVTMTRDTSISTAYMELSSLRSEDTAVYYCARTYYYDTSGYYHDAFDVWGQGTMVTVSS

SEQ ID NO: 26564 - protein, 5 aa, Artificial Sequence
  Description of Artificial Sequence: Synthetic peptide
  XENP023092 vhCDR1
GYYMH

SEQ ID NO: 26565 - protein, 17 aa, Artificial Sequence
  Description of Artificial Sequence: Synthetic peptide
  XENP023092 vhCDR2
WINPHSGETIYAQKFQG

SEQ ID NO: 26566 - protein, 16 aa, Artificial Sequence
  Description of Artificial Sequence: Synthetic peptide
  XENP023092 vhCDR3
TYYYDTSGYYHDAFDV

SEQ ID NO: 26567 - protein, 480 aa, Artificial Sequence; identical to SEQ ID NO: 2870
  Description of Artificial Sequence: Synthetic polypeptide
  XENP023092 [ICOS]_H0.66_L0_Fab-1G6_L1.194_H1.279 scFv-Fc Heavy Chain

SEQ ID NO: 26568 - protein, 107 aa, Artificial Sequence; identical to SEQ ID NO: 2871
  Description of Artificial Sequence: Synthetic polypeptide
  VH of XENP023092

SEQ ID NO: 26569 - protein, 122 aa, Artificial Sequence; identical to SEQ ID NO: 2872
  Description of Artificial Sequence: Synthetic polypeptide
  VL of XENP023092

SEQ ID NO: 26570 - protein, 231 aa, Artificial Sequence; identical to SEQ ID NO: 2397
  Description of Artificial Sequence: Synthetic polypeptide
  Fc chain of XENP023092

SEQ ID NO: 26571 - protein, 11 aa, Artificial Sequence
  Description of Artificial Sequence: Synthetic peptide
  XENP023092 vhCDR1
RASQSVGNDVA

SEQ ID NO: 26572 - protein, 7 aa, Artificial Sequence
  Description of Artificial Sequence: Synthetic peptide
  XENP023092 vhCDR2
YASHRYT

SEQ ID NO: 26573 - protein, 9 aa, Artificial Sequence
  Description of Artificial Sequence: Synthetic peptide
  XENP023092 vhCDR3
QQDFSSPRT

SEQ ID NO: 26574 - protein, 5 aa, Artificial Sequence
  Description of Artificial Sequence: Synthetic peptide
  XENP023092 vlCDR1
NYWMN

SEQ ID NO: 26575 - protein, 19 aa, Artificial Sequence
  Description of Artificial Sequence: Synthetic peptide
  XENP023092 vlCDR2
EIRLYSNNYATHYAESVKG

SEQ ID NO: 26576 - protein, 11 aa, Artificial Sequence
  Description of Artificial Sequence: Synthetic peptide
  XENP023092 vlCDR3
YYGNYGGYFDV

SEQ ID NO: 26577 - protein, 214 aa, Artificial Sequence; identical to SEQ ID NO: 26297
  Description of Artificial Sequence: Synthetic polypeptide
  XENP023092 [ICOS]_H0.66_L0_Fab-1G6_L1.194_H1.279 Light Chain

SEQ ID NO: 26578 - protein, 107 aa, Artificial Sequence; identical to SEQ ID NO: 26298
  Description of Artificial Sequence: Synthetic polypeptide
  VL of XENP023092

SEQ ID NO: 26579 - protein, 11 aa, Artificial Sequence
  Description of Artificial Sequence: Synthetic peptide
  XENP023092 vlCDR1
RASQGISRLLA

SEQ ID NO: 26580 - protein, 7 aa, Artificial Sequence
  Description of Artificial Sequence: Synthetic peptide
  XENP023092 vlCDR2
VASSLQS

SEQ ID NO: 26581 - protein, 9 aa, Artificial Sequence
  Description of Artificial Sequence: Synthetic peptide
  XENP023092 vlCDR3
QQANSFPWT

SEQ ID NO: 26582 - protein, 454 aa, Artificial Sequence; identical to SEQ ID NO: 26562
  Description of Artificial Sequence: Synthetic polypeptide
  XENP023410 [ICOS]_H0.66_L0.34_Fab-1G6_L1.194_H1.279 Fab-Fc Heavy Chain

SEQ ID NO: 26583 - protein, 125 aa, Artificial Sequence; identical to SEQ ID NO: 26563
  Description of Artificial Sequence: Synthetic polypeptide
  VH of XENP023410

SEQ ID NO: 26584 - protein, 5 aa, Artificial Sequence
  Description of Artificial Sequence: Synthetic peptide
  XENP023410 vhCDR1
GYYMH

SEQ ID NO: 26585 - protein, 17 aa, Artificial Sequence
  Description of Artificial Sequence: Synthetic peptide
  XENP023410 vhCDR2
WINPHSGETIYAQKFQG

SEQ ID NO: 26586 - protein, 16 aa, Artificial Sequence
  Description of Artificial Sequence: Synthetic peptide
  XENP023410 vhCDR3
TYYYDTSGYYHDAFDV

SEQ ID NO: 26587 - protein, 480 aa, Artificial Sequence; identical to SEQ ID NO: 2870
  Description of Artificial Sequence: Synthetic polypeptide
  XENP023410 [ICOS]_H0.66_L0.34_Fab-1G6_L1.194_H1.279 scFv-Fc Heavy Chain

SEQ ID NO: 26588 - protein, 107 aa, Artificial Sequence; identical to SEQ ID NO: 2871
  Description of Artificial Sequence: Synthetic polypeptide
  VH of XENP023410

SEQ ID NO: 26589 - protein, 122 aa, Artificial Sequence; identical to SEQ ID NO: 2872
  Description of Artificial Sequence: Synthetic polypeptide
  VL of XENP023410

SEQ ID NO: 26590 - protein, 231 aa, Artificial Sequence; identical to SEQ ID NO: 2397
  Description of Artificial Sequence: Synthetic polypeptide
  Fc chain of XENP023410

SEQ ID NO: 26591 - protein, 11 aa, Artificial Sequence
  Description of Artificial Sequence: Synthetic peptide
  XENP023410 vhCDR1
RASQSVGNDVA

SEQ ID NO: 26592 - protein, 7 aa, Artificial Sequence
  Description of Artificial Sequence: Synthetic peptide
  XENP023410 vhCDR2
YASHRYT

SEQ ID NO: 26593 - protein, 9 aa, Artificial Sequence
  Description of Artificial Sequence: Synthetic peptide
  XENP023410 vhCDR3
QQDFSSPRT

SEQ ID NO: 26594 - protein, 5 aa, Artificial Sequence
  Description of Artificial Sequence: Synthetic peptide
  XENP023410 vlCDR1
NYWMN

SEQ ID NO: 26595 - protein, 19 aa, Artificial Sequence
  Description of Artificial Sequence: Synthetic peptide
  XENP023410 vlCDR2
EIRLYSNNYATHYAESVKG

SEQ ID NO: 26596 - protein, 11 aa, Artificial Sequence
  Description of Artificial Sequence: Synthetic peptide
  XENP023410 vlCDR3
YYGNYGGYFDV

SEQ ID NO: 26597 - protein, 214 aa, Artificial Sequence; identical to SEQ ID NO: 26497
  Description of Artificial Sequence: Synthetic polypeptide
  XENP023410 [ICOS]_H0.66_L0.34_Fab-1G6_L1.194_H1.279 Light Chain

SEQ ID NO: 26598 - protein, 107 aa, Artificial Sequence; identical to SEQ ID NO: 26498
  Description of Artificial Sequence: Synthetic polypeptide
  VL of XENP023410

SEQ ID NO: 26599 - protein, 11 aa, Artificial Sequence
  Description of Artificial Sequence: Synthetic peptide
  XENP023410 vlCDR1
QASQDISRLLA

SEQ ID NO: 26600 - protein, 7 aa, Artificial Sequence
  Description of Artificial Sequence: Synthetic peptide
  XENP023410 vlCDR2
VASSLQS

SEQ ID NO: 26601 - protein, 9 aa, Artificial Sequence
  Description of Artificial Sequence: Synthetic peptide
  XENP023410 vlCDR3
QQAESFPWT

SEQ ID NO: 26602 - protein, 454 aa, Artificial Sequence; identical to SEQ ID NO: 26362
  Description of Artificial Sequence: Synthetic polypeptide
  XENP022730 [ICOS]_H0L0_Fab-1G6_L1.194_H1.279 Fab-Fc Heavy Chain

SEQ ID NO: 26603 - protein, 125 aa, Artificial Sequence; identical to SEQ ID NO: 26293
  Description of Artificial Sequence: Synthetic polypeptide
  VH of XENP022730

SEQ ID NO: 26604 - protein, 5 aa, Artificial Sequence
  Description of Artificial Sequence: Synthetic peptide
  XENP022730 vhCDR1
GYYMH

SEQ ID NO: 26605 - protein, 17 aa, Artificial Sequence
  Description of Artificial Sequence: Synthetic peptide
  XENP022730 vhCDR2
WINPHSGGTNYAQKFQG

SEQ ID NO: 26606 - protein, 16 aa, Artificial Sequence
  Description of Artificial Sequence: Synthetic peptide
  XENP022730 vhCDR3
TYYYDSSGYYHDAFDI

SEQ ID NO: 26607 - protein, 480 aa, Artificial Sequence; identical to SEQ ID NO: 2930
  Description of Artificial Sequence: Synthetic polypeptide
  XENP022730 [ICOS]_H0L0_Fab-1G6_L1.194_H1.279 scFv-Fc Heavy Chain

SEQ ID NO: 26608 - protein, 107 aa, Artificial Sequence; identical to SEQ ID NO: 2871
  Description of Artificial Sequence: Synthetic polypeptide
  VH of XENP022730

SEQ ID NO: 26609 - protein, 122 aa, Artificial Sequence; identical to SEQ ID NO: 2872
  Description of Artificial Sequence: Synthetic polypeptide
  VL of XENP022730

SEQ ID NO: 26610 - protein, 231 aa, Artificial Sequence; identical to SEQ ID NO: 2409
  Description of Artificial Sequence: Synthetic polypeptide
  Fc chain of XENP022730

SEQ ID NO: 26611 - protein, 11 aa, Artificial Sequence
  Description of Artificial Sequence: Synthetic peptide
  XENP022730 vhCDR1
RASQSVGNDVA

SEQ ID NO: 26612 - protein, 7 aa, Artificial Sequence
  Description of Artificial Sequence: Synthetic peptide
  XENP022730 vhCDR2
YASHRYT

SEQ ID NO: 26613 - protein, 9 aa, Artificial Sequence
  Description of Artificial Sequence: Synthetic peptide
  XENP022730 vhCDR3
QQDFSSPRT

SEQ ID NO: 26614 - protein, 5 aa, Artificial Sequence
  Description of Artificial Sequence: Synthetic peptide
  XENP022730 vlCDR1
NYWMN

SEQ ID NO: 26615 - protein, 19 aa, Artificial Sequence
  Description of Artificial Sequence: Synthetic peptide
  XENP022730 vlCDR2
EIRLYSNNYATHYAESVKG

SEQ ID NO: 26616 - protein, 11 aa, Artificial Sequence
  Description of Artificial Sequence: Synthetic peptide
  XENP022730 vlCDR3
YYGNYGGYFDV

SEQ ID NO: 26617 - protein, 214 aa, Artificial Sequence; identical to SEQ ID NO: 26297
  Description of Artificial Sequence: Synthetic polypeptide
  XENP022730 [ICOS]_H0L0_Fab-1G6_L1.194_H1.279 Light Chain

SEQ ID NO: 26618 - protein, 107 aa, Artificial Sequence; identical to SEQ ID NO: 26298
  Description of Artificial Sequence: Synthetic polypeptide
  VL of XENP022730

SEQ ID NO: 26619 - protein, 11 aa, Artificial Sequence
  Description of Artificial Sequence: Synthetic peptide
  XENP022730 vlCDR1
RASQGISRLLA

SEQ ID NO: 26620 - protein, 7 aa, Artificial Sequence
  Description of Artificial Sequence: Synthetic peptide
  XENP022730 vlCDR2
VASSLQS

SEQ ID NO: 26621 - protein, 9 aa, Artificial Sequence
  Description of Artificial Sequence: Synthetic peptide
  XENP022730 vlCDR3
QQANSFPWT

SEQ ID NO: 26622 - protein, 454 aa, Artificial Sequence; identical to SEQ ID NO: 26362
  Description of Artificial Sequence: Synthetic polypeptide
  XENP022974 [ICOS]_H0_L0.34_Fab-1G6_L1.194_H1.279 Fab-Fc Heavy Chain

SEQ ID NO: 26623 - protein, 125 aa, Artificial Sequence; identical to SEQ ID NO: 26293
  Description of Artificial Sequence: Synthetic polypeptide
  VH of XENP022974

SEQ ID NO: 26624 - protein, 5 aa, Artificial Sequence
  Description of Artificial Sequence: Synthetic peptide
  XENP022974 vhCDR1
GYYMH

SEQ ID NO: 26625 - protein, 17 aa, Artificial Sequence
  Description of Artificial Sequence: Synthetic peptide
  XENP022974 vhCDR2
WINPHSGGTNYAQKFQG

SEQ ID NO: 26626 - protein, 16 aa, Artificial Sequence
  Description of Artificial Sequence: Synthetic peptide
  XENP022974 vhCDR3
TYYYDSSGYYHDAFDI

SEQ ID NO: 26627 - protein, 480 aa, Artificial Sequence; identical to SEQ ID NO: 2930
  Description of Artificial Sequence: Synthetic polypeptide
  XENP022974 [ICOS]_H0_L0.34_Fab-1G6_L1.194_H1.279 scFv-Fc Heavy Chain

SEQ ID NO: 26628 - protein, 107 aa, Artificial Sequence; identical to SEQ ID NO: 2871
  Description of Artificial Sequence: Synthetic polypeptide
  VH of XENP022974

SEQ ID NO: 26629 - protein, 122 aa, Artificial Sequence; identical to SEQ ID NO: 2872
  Description of Artificial Sequence: Synthetic polypeptide
  VL of XENP022974

SEQ ID NO: 26630 - protein, 231 aa, Artificial Sequence; identical to SEQ ID NO: 2409
  Description of Artificial Sequence: Synthetic polypeptide
  Fc chain of XENP022974

SEQ ID NO: 26631 - protein, 11 aa, Artificial Sequence
  Description of Artificial Sequence: Synthetic peptide
  XENP022974 vhCDR1
RASQSVGNDVA

SEQ ID NO: 26632 - protein, 7 aa, Artificial Sequence
  Description of Artificial Sequence: Synthetic peptide
  XENP022974 vhCDR2
YASHRYT

SEQ ID NO: 26633 - protein, 9 aa, Artificial Sequence
  Description of Artificial Sequence: Synthetic peptide
  XENP022974 vhCDR3
QQDFSSPRT

SEQ ID NO: 26634 - protein, 5 aa, Artificial Sequence
  Description of Artificial Sequence: Synthetic peptide
  XENP022974 vlCDR1
NYWMN

SEQ ID NO: 26635 - protein, 19 aa, Artificial Sequence
  Description of Artificial Sequence: Synthetic peptide
  XENP022974 vlCDR2
EIRLYSNNYATHYAESVKG

SEQ ID NO: 26636 - protein, 11 aa, Artificial Sequence
  Description of Artificial Sequence: Synthetic peptide
  XENP022974 vlCDR3
YYGNYGGYFDV

SEQ ID NO: 26637 - protein, 214 aa, Artificial Sequence; identical to SEQ ID NO: 26497
  Description of Artificial Sequence: Synthetic polypeptide
  XENP022974 [ICOS]_H0_L0.34_Fab-1G6_L1.194_H1.279 Light Chain

SEQ ID NO: 26638 - protein, 107 aa, Artificial Sequence; identical to SEQ ID NO: 26498
  Description of Artificial Sequence: Synthetic polypeptide
  VL of XENP022974

SEQ ID NO: 26639 - protein, 11 aa, Artificial Sequence
  Description of Artificial Sequence: Synthetic peptide
  XENP022974 vlCDR1
QASQDISRLLA

SEQ ID NO: 26640 - protein, 7 aa, Artificial Sequence
  Description of Artificial Sequence: Synthetic peptide
  XENP022974 vlCDR2
VASSLQS

SEQ ID NO: 26641 - protein, 9 aa, Artificial Sequence
  Description of Artificial Sequence: Synthetic peptide
  XENP022974 vlCDR3
QQAESFPWT

SEQ ID NO: 26642 - protein, 454 aa, Artificial Sequence
  Description of Artificial Sequence: Synthetic polypeptide
  XENP023104 [ICOS]_H0.66_L0_Fab-1G6_L1.194_H1.279 Fab-Fc Heavy Chain
QVQLVQSGAEVKKPGASVKVSCKASGYTFTGYYMHWVRQAPGQGLEWMGWINPHSGETIYAQKFQGRVTMTRDTSISTAYMELSSLRSEDTAVYYCARTYYYDTSGYYHDAFDVWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVLHEALHSHYTQKSLSLSPGK

SEQ ID NO: 26643 - protein, 125 aa, Artificial Sequence; identical to SEQ ID NO: 26563
  Description of Artificial Sequence: Synthetic polypeptide
  VH of XENP023104

SEQ ID NO: 26644 - protein, 5 aa, Artificial Sequence
  Description of Artificial Sequence: Synthetic peptide
  XENP023104 vhCDR1
GYYMH

SEQ ID NO: 26645 - protein, 17 aa, Artificial Sequence
  Description of Artificial Sequence: Synthetic peptide
  XENP023104 vhCDR2
WINPHSGETIYAQKFQG

SEQ ID NO: 26646 - protein, 16 aa, Artificial Sequence
  Description of Artificial Sequence: Synthetic peptide
  XENP023104 vhCDR3
TYYYDTSGYYHDAFDV

SEQ ID NO: 26647 - protein, 480 aa, Artificial Sequence; identical to SEQ ID NO: 2930
  Description of Artificial Sequence: Synthetic polypeptide
  XENP023104 [ICOS]_H0.66_L0_Fab-1G6_L1.194_H1.279 scFv-Fc Heavy Chain

SEQ ID NO: 26648 - protein, 107 aa, Artificial Sequence; identical to SEQ ID NO: 2871
  Description of Artificial Sequence: Synthetic polypeptide
  VH of XENP023104

SEQ ID NO: 26649 - protein, 122 aa, Artificial Sequence; identical to SEQ ID NO: 2872
  Description of Artificial Sequence: Synthetic polypeptide
  VL of XENP023104

SEQ ID NO: 26650 - protein, 231 aa, Artificial Sequence; identical to SEQ ID NO: 2409
  Description of Artificial Sequence: Synthetic polypeptide
  Fc chain of XENP023104

SEQ ID NO: 26651 - protein, 11 aa, Artificial Sequence
  Description of Artificial Sequence: Synthetic peptide
  XENP023104 vhCDR1
RASQSVGNDVA

SEQ ID NO: 26652 - protein, 7 aa, Artificial Sequence
  Description of Artificial Sequence: Synthetic peptide
  XENP023104 vhCDR2
YASHRYT

SEQ ID NO: 26653 - protein, 9 aa, Artificial Sequence
  Description of Artificial Sequence: Synthetic peptide
  XENP023104 vhCDR3
QQDFSSPRT

SEQ ID NO: 26654 - protein, 5 aa, Artificial Sequence
  Description of Artificial Sequence: Synthetic peptide
  XENP023104 vlCDR1
NYWMN

SEQ ID NO: 26655 - protein, 19 aa, Artificial Sequence
  Description of Artificial Sequence: Synthetic peptide
  XENP023104 vlCDR2
EIRLYSNNYATHYAESVKG

SEQ ID NO: 26656 - protein, 11 aa, Artificial Sequence
  Description of Artificial Sequence: Synthetic peptide
  XENP023104 vlCDR3
YYGNYGGYFDV

SEQ ID NO: 26657 - protein, 214 aa, Artificial Sequence; identical to SEQ ID NO: 26297
  Description of Artificial Sequence: Synthetic polypeptide
  XENP023104 [ICOS]_H0.66_L0_Fab-1G6_L1.194_H1.279 Light Chain

SEQ ID NO: 26658 - protein, 107 aa, Artificial Sequence; identical to SEQ ID NO: 26298
  Description of Artificial Sequence: Synthetic polypeptide
  VL of XENP023104

SEQ ID NO: 26659 - protein, 11 aa, Artificial Sequence
  Description of Artificial Sequence: Synthetic peptide
  XENP023104 vlCDR1
RASQGISRLLA

SEQ ID NO: 26660 - protein, 7 aa, Artificial Sequence
  Description of Artificial Sequence: Synthetic peptide
  XENP023104 vlCDR2
VASSLQS

SEQ ID NO: 26661 - protein, 9 aa, Artificial Sequence
  Description of Artificial Sequence: Synthetic peptide
  XENP023104 vlCDR3
QQANSFPWT

SEQ ID NO: 26662 - protein, 454 aa, Artificial Sequence; identical to SEQ ID NO: 26642
  Description of Artificial Sequence: Synthetic polypeptide
  XENP023411 [ICOS]_H0.66_L0.34_Fab-1G6_L1.194_H1.279 Fab-Fc Heavy Chain

SEQ ID NO: 26663 - protein, 125 aa, Artificial Sequence; identical to SEQ ID NO: 26563
  Description of Artificial Sequence: Synthetic polypeptide
  VH of XENP023411

SEQ ID NO: 26664 - protein, 5 aa, Artificial Sequence
  Description of Artificial Sequence: Synthetic peptide
  XENP023411 vhCDR1
GYYMH

SEQ ID NO: 26665 - protein, 17 aa, Artificial Sequence
  Description of Artificial Sequence: Synthetic peptide
  XENP023411 vhCDR2
WINPHSGETIYAQKFQG

SEQ ID NO: 26666 - protein, 16 aa, Artificial Sequence
  Description of Artificial Sequence: Synthetic peptide
  XENP023411 vhCDR3
TYYYDTSGYYHDAFDV

SEQ ID NO: 26667 - protein, 480 aa, Artificial Sequence; identical to SEQ ID NO: 2930
  Description of Artificial Sequence: Synthetic polypeptide
  XENP023411 [ICOS]_H0.66_L0.34_Fab-1G6_L1.194_H1.279 scFv-Fc Heavy Chain

SEQ ID NO: 26668 - protein, 107 aa, Artificial Sequence; identical to SEQ ID NO: 2871
  Description of Artificial Sequence: Synthetic polypeptide
  VH of XENP023411

SEQ ID NO: 26669 - protein, 122 aa, Artificial Sequence; identical to SEQ ID NO: 2872
  Description of Artificial Sequence: Synthetic polypeptide
  VL of XENP023411

SEQ ID NO: 26670 - protein, 231 aa, Artificial Sequence; identical to SEQ ID NO: 2409
  Description of Artificial Sequence: Synthetic polypeptide
  Fc chain of XENP023411

SEQ ID NO: 26671 - protein, 11 aa, Artificial Sequence
  Description of Artificial Sequence: Synthetic peptide
  XENP023411 vhCDR1
RASQSVGNDVA

SEQ ID NO: 26672 - protein, 7 aa, Artificial Sequence
  Description of Artificial Sequence: Synthetic peptide
  XENP023411 vhCDR2
YASHRYT

SEQ ID NO: 26673 - protein, 9 aa, Artificial Sequence
  Description of Artificial Sequence: Synthetic peptide
  XENP023411 vhCDR3
QQDFSSPRT

SEQ ID NO: 26674 - protein, 5 aa, Artificial Sequence
  Description of Artificial Sequence: Synthetic peptide
  XENP023411 vlCDR1
NYWMN

SEQ ID NO: 26675 - protein, 19 aa, Artificial Sequence
  Description of Artificial Sequence: Synthetic peptide
  XENP023411 vlCDR2
EIRLYSNNYATHYAESVKG

SEQ ID NO: 26676 - protein, 11 aa, Artificial Sequence
  Description of Artificial Sequence: Synthetic peptide
  XENP023411 vlCDR3
YYGNYGGYFDV

SEQ ID NO: 26677 - protein, 214 aa, Artificial Sequence; identical to SEQ ID NO: 26497
  Description of Artificial Sequence: Synthetic polypeptide
  XENP023411 [ICOS]_H0.66_L0.34_Fab-1G6_L1.194_H1.279 Light Chain

SEQ ID NO: 26678 - protein, 107 aa, Artificial Sequence; identical to SEQ ID NO: 26498
  Description of Artificial Sequence: Synthetic polypeptide
  VL of XENP023411

SEQ ID NO: 26679 - protein, 11 aa, Artificial Sequence
  Description of Artificial Sequence: Synthetic peptide
  XENP023411 vlCDR1
QASQDISRLLA

SEQ ID NO: 26680 - protein, 7 aa, Artificial Sequence
  Description of Artificial Sequence: Synthetic peptide
  XENP023411 vlCDR2
VASSLQS

SEQ ID NO: 26681 - protein, 9 aa, Artificial Sequence
  Description of Artificial Sequence: Synthetic peptide
  XENP023411 vlCDR3
QQAESFPWT

SEQ ID NO: 26682 - protein, 452 aa, Artificial Sequence
  Description of Artificial Sequence: Synthetic polypeptide
  XENP021828 GSK_314.8[ICOS]_H0L0_Fab-1G6_L1.194_H1.279_scFv Fab-Fc Heavy Chain
QVQLQQPGTELMKPGASVKLSCKASGYTFTTYWMHWVKQRPGQGLEWIGEIDPSDSYVNYNQNFKGKATLTVDKSSSTAYIQLSSLTSEDSAVYFCARSPDYYGTSLAWFDYWGQGTLVTVSTASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 26683 - protein, 123 aa, Artificial Sequence; identical to SEQ ID NO: 26303
  Description of Artificial Sequence: Synthetic polypeptide
  VH of XENP021828

SEQ ID NO: 26684 - protein, 5 aa, Artificial Sequence
  Description of Artificial Sequence: Synthetic peptide
  XENP021828 vhCDR1
TYWMH

SEQ ID NO: 26685 - protein, 17 aa, Artificial Sequence
  Description of Artificial Sequence: Synthetic peptide
  XENP021828 vhCDR2
EIDPSDSYVNYNQNFKG

SEQ ID NO: 26686 - protein, 14 aa, Artificial Sequence
  Description of Artificial Sequence: Synthetic peptide
  XENP021828 vhCDR3
SPDYYGTSLAWFDY

SEQ ID NO: 26687 - protein, 480 aa, Artificial Sequence; identical to SEQ ID NO: 2870
  Description of Artificial Sequence: Synthetic polypeptide
  XENP021828 GSK_314.8[ICOS]_H0L0_Fab-1G6_L1.194_H1.279_scFv scFv-Fc Heavy Chain

SEQ ID NO: 26688 - protein, 107 aa, Artificial Sequence; identical to SEQ ID NO: 2871
  Description of Artificial Sequence: Synthetic polypeptide
  VH of XENP021828

SEQ ID NO: 26689 - protein, 122 aa, Artificial Sequence; identical to SEQ ID NO: 2872
  Description of Artificial Sequence: Synthetic polypeptide
  VL of XENP021828

SEQ ID NO: 26690 - protein, 231 aa, Artificial Sequence; identical to SEQ ID NO: 2397
  Description of Artificial Sequence: Synthetic polypeptide
  Fc chain of XENP021828

SEQ ID NO: 26691 - protein, 11 aa, Artificial Sequence
  Description of Artificial Sequence: Synthetic peptide
  XENP021828 vhCDR1
RASQSVGNDVA

SEQ ID NO: 26692 - protein, 7 aa, Artificial Sequence
  Description of Artificial Sequence: Synthetic peptide
  XENP021828 vhCDR2
YASHRYT

SEQ ID NO: 26693 - protein, 9 aa, Artificial Sequence
  Description of Artificial Sequence: Synthetic peptide
  XENP021828 vhCDR3
QQDFSSPRT

SEQ ID NO: 26694 - protein, 5 aa, Artificial Sequence
  Description of Artificial Sequence: Synthetic peptide
  XENP021828 vlCDR1
NYWMN

SEQ ID NO: 26695 - protein, 19 aa, Artificial Sequence
  Description of Artificial Sequence: Synthetic peptide
  XENP021828 vlCDR2
EIRLYSNNYATHYAESVKG

SEQ ID NO: 26696 - protein, 11 aa, Artificial Sequence
  Description of Artificial Sequence: Synthetic peptide
  XENP021828 vlCDR3
YYGNYGGYFDV

SEQ ID NO: 26697 - protein, 219 aa, Artificial Sequence; identical to SEQ ID NO: 26307
  Description of Artificial Sequence: Synthetic polypeptide
  XENP021828 GSK_314.8[ICOS]_H0L0_Fab-1G6_L1.194_H1.279_scFv Light Chain

SEQ ID NO: 26698 - protein, 112 aa, Artificial Sequence; identical to SEQ ID NO: 26308
  Description of Artificial Sequence: Synthetic polypeptide
  VL of XENP021828

SEQ ID NO: 26699 - protein, 16 aa, Artificial Sequence
  Description of Artificial Sequence: Synthetic peptide
  XENP021828 vlCDR1
RSSKSPLHSNGNIYLY

SEQ ID NO: 26700 - protein, 7 aa, Artificial Sequence
  Description of Artificial Sequence: Synthetic peptide
  XENP021828 vlCDR2
RMSNLAS

SEQ ID NO: 26701 - protein, 9 aa, Artificial Sequence
  Description of Artificial Sequence: Synthetic peptide
  XENP021828 vlCDR3
MQHLEYPYT

SEQ ID NO: 26702 - protein, 453 aa, Artificial Sequence
  Description of Artificial Sequence: Synthetic polypeptide
  XENP021829 GSK_88.2[ICOS]_H0L0_Fab-1G6_L1.194_H1.279_scFv Fab-Fc Heavy Chain
QVQLQQPGAELVRPGASVKLSCKASGYSFTSYWINWVKQRPGQGLEWIGNIYPSDSYTNYNQMFKDKATLTVDKSSNTAYMQLTSPTSEDSAVYYCTRWNLSYYFDNNYYLDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 26703 - protein, 124 aa, Artificial Sequence; identical to SEQ ID NO: 26313
  Description of Artificial Sequence: Synthetic polypeptide
  VH of XENP021829

SEQ ID NO: 26704 - protein, 5 aa, Artificial Sequence
  Description of Artificial Sequence: Synthetic peptide
  XENP021829 vhCDR1
SYWIN

SEQ ID NO: 26705 - protein, 17 aa, Artificial Sequence
  Description of Artificial Sequence: Synthetic peptide
  XENP021829 vhCDR2
NIYPSDSYTNYNQMFKD

SEQ ID NO: 26706 - protein, 15 aa, Artificial Sequence
  Description of Artificial Sequence: Synthetic peptide
  XENP021829 vhCDR3
WNLSYYFDNNYYLDY

SEQ ID NO: 26707 - protein, 480 aa, Artificial Sequence; identical to SEQ ID NO: 2870
  Description of Artificial Sequence: Synthetic polypeptide
  XENP021829 GSK_88.2[ICOS]_H0L0_Fab-1G6_L1.194_H1.279_scFv scFv-Fc Heavy Chain

SEQ ID NO: 26708 - protein, 107 aa, Artificial Sequence; identical to SEQ ID NO: 2871
  Description of Artificial Sequence: Synthetic polypeptide
  VH of XENP021829

SEQ ID NO: 26709 - protein, 122 aa, Artificial Sequence; identical to SEQ ID NO: 2872
  Description of Artificial Sequence: Synthetic polypeptide
  VL of XENP021829

SEQ ID NO: 26710 - protein, 231 aa, Artificial Sequence; identical to SEQ ID NO: 2397
  Description of Artificial Sequence: Synthetic polypeptide
  Fc chain of XENP021829

SEQ ID NO: 26711 - protein, 11 aa, Artificial Sequence
  Description of Artificial Sequence: Synthetic peptide
  XENP021829 vhCDR1
RASQSVGNDVA

SEQ ID NO: 26712 - protein, 7 aa, Artificial Sequence
  Description of Artificial Sequence: Synthetic peptide
  XENP021829 vhCDR2
YASHRYT

SEQ ID NO: 26713 - protein, 9 aa, Artificial Sequence
  Description of Artificial Sequence: Synthetic peptide
  XENP021829 vhCDR3
QQDFSSPRT

SEQ ID NO: 26714 - protein, 5 aa, Artificial Sequence
  Description of Artificial Sequence: Synthetic peptide
  XENP021829 vlCDR1
NYWMN

SEQ ID NO: 26715 - protein, 19 aa, Artificial Sequence
  Description of Artificial Sequence: Synthetic peptide
  XENP021829 vlCDR2
EIRLYSNNYATHYAESVKG

SEQ ID NO: 26716 - protein, 11 aa, Artificial Sequence
  Description of Artificial Sequence: Synthetic peptide
  XENP021829 vlCDR3
YYGNYGGYFDV

SEQ ID NO: 26717 - protein, 219 aa, Artificial Sequence; identical to SEQ ID NO: 26317
  Description of Artificial Sequence: Synthetic polypeptide
  XENP021829 GSK_88.2[ICOS]_H0L0_Fab-1G6_L1.194_H1.279_scFv Light Chain

SEQ ID NO: 26718 - protein, 112 aa, Artificial Sequence; identical to SEQ ID NO: 26318
  Description of Artificial Sequence: Synthetic polypeptide
  VL of XENP021829

SEQ ID NO: 26719 - protein, 16 aa, Artificial Sequence
  Description of Artificial Sequence: Synthetic peptide
  XENP021829 vlCDR1
RSSKSLLHSNGNTYLY

SEQ ID NO: 26720 - protein, 7 aa, Artificial Sequence
  Description of Artificial Sequence: Synthetic peptide
  XENP021829 vlCDR2
RMSNLAS

SEQ ID NO: 26721 - protein, 9 aa, Artificial Sequence
  Description of Artificial Sequence: Synthetic peptide
  XENP021829 vlCDR3
MQHLEYPWT

SEQ ID NO: 26722 - protein, 454 aa, Artificial Sequence
  Description of Artificial Sequence: Synthetic polypeptide
  XENP021830 jMab-138[ICOS]_H0L0_Fab-1G6_L1.194_H1.279_scFv Fab-Fc Heavy Chain
EVQLVESGGGLVQPGGSLRLSCAASGFTFSSYDMHWVRQATGKGLEWVSAIGTAGDTYYPGSVKGRFTISRENAKNSLYLQMNSLRAGDTAVYYCVRDNRKVTHEHYYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 26723 - protein, 125 aa, Artificial Sequence; identical to SEQ ID NO: 26323
  Description of Artificial Sequence: Synthetic polypeptide
  VH of XENP021830

SEQ ID NO: 26724 - protein, 5 aa, Artificial Sequence
  Description of Artificial Sequence: Synthetic peptide
  XENP021830 vhCDR1
SYDMH

SEQ ID NO: 26725 - protein, 16 aa, Artificial Sequence
  Description of Artificial Sequence: Synthetic peptide
  XENP021830 vhCDR2
AIGTAGDTYYPGSVKG

SEQ ID NO: 26726 - protein, 17 aa, Artificial Sequence
  Description of Artificial Sequence: Synthetic peptide
  XENP021830 vhCDR3
DNRKVTHEHYYYYGMDV

SEQ ID NO: 26727 - protein, 480 aa, Artificial Sequence; identical to SEQ ID NO: 2870
  Description of Artificial Sequence: Synthetic polypeptide
  XENP021830 jMab-138[ICOS]_H0L0_Fab-1G6_L1.194_H1.279_scFv scFv-Fc Heavy Chain

SEQ ID NO: 26728 - protein, 107 aa, Artificial Sequence; identical to SEQ ID NO: 2871
  Description of Artificial Sequence: Synthetic polypeptide
  VH of XENP021830

SEQ ID NO: 26729 - protein, 122 aa, Artificial Sequence; identical to SEQ ID NO: 2872
  Description of Artificial Sequence: Synthetic polypeptide
  VL of XENP021830

SEQ ID NO: 26730 - protein, 231 aa, Artificial Sequence; identical to SEQ ID NO: 2397
  Description of Artificial Sequence: Synthetic polypeptide
  Fc chain of XENP021830

SEQ ID NO: 26731 - protein, 11 aa, Artificial Sequence
  Description of Artificial Sequence: Synthetic peptide
  XENP021830 vhCDR1
RASQSVGNDVA

SEQ ID NO: 26732 - protein, 7 aa, Artificial Sequence
  Description of Artificial Sequence: Synthetic peptide
  XENP021830 vhCDR2
YASHRYT

SEQ ID NO: 26733 - protein, 9 aa, Artificial Sequence
  Description of Artificial Sequence: Synthetic peptide
  XENP021830 vhCDR3
QQDFSSPRT

SEQ ID NO: 26734 - protein, 5 aa, Artificial Sequence
  Description of Artificial Sequence: Synthetic peptide
  XENP021830 vlCDR1
NYWMN

SEQ ID NO: 26735 - protein, 19 aa, Artificial Sequence
  Description of Artificial Sequence: Synthetic peptide
  XENP021830 vlCDR2
EIRLYSNNYATHYAESVKG

SEQ ID NO: 26736 - protein, 11 aa, Artificial Sequence
  Description of Artificial Sequence: Synthetic peptide
  XENP021830 vlCDR3
YYGNYGGYFDV

SEQ ID NO: 26737 - protein, 216 aa, Artificial Sequence; identical to SEQ ID NO: 26327
  Description of Artificial Sequence: Synthetic polypeptide
  XENP021830 jMab-138[ICOS]_H0L0_Fab-1G6_L1.194_H1.279_scFv Light Chain

SEQ ID NO: 26738 - protein, 109 aa, Artificial Sequence; identical to SEQ ID NO: 26328
  Description of Artificial Sequence: Synthetic polypeptide
  VL of XENP021830

SEQ ID NO: 26739 - protein, 12 aa, Artificial Sequence
  Description of Artificial Sequence: Synthetic peptide
  XENP021830 vlCDR1
RASQNIRSSYLA

SEQ ID NO: 26740 - protein, 7 aa, Artificial Sequence
  Description of Artificial Sequence: Synthetic peptide
  XENP021830 vlCDR2
GASSRAT

SEQ ID NO: 26741 - protein, 10 aa, Artificial Sequence
  Description of Artificial Sequence: Synthetic peptide
  XENP021830 vlCDR3
QQFGSSPMCS

SEQ ID NO: 26742 - protein, 454 aa, Artificial Sequence
  Description of Artificial Sequence: Synthetic polypeptide
  XENP021831 jMab-139[ICOS]_H0L0_Fab-1G6_L1.194_H1.279_scFv Fab-Fc Heavy Chain
EVQLVESGGGLVQPGGSLRLSCAASGFTFSSYDMHWVRQATGKGLEWVSAIGTAGDTYYPGSVKGRFTISRENAKNSLYLQMNSLRAGDTAVYYCVRDKRTVTHEHYYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 26743 - protein, 125 aa, Artificial Sequence; identical to SEQ ID NO: 26333
  Description of Artificial Sequence: Synthetic polypeptide
  VH of XENP021831

SEQ ID NO: 26744 - protein, 5 aa, Artificial Sequence
  Description of Artificial Sequence: Synthetic peptide
  XENP021831 vhCDR1
SYDMH

SEQ ID NO: 26745 - protein, 16 aa, Artificial Sequence
  Description of Artificial Sequence: Synthetic peptide
  XENP021831 vhCDR2
AIGTAGDTYYPGSVKG

SEQ ID NO: 26746 - protein, 17 aa, Artificial Sequence
  Description of Artificial Sequence: Synthetic peptide
  XENP021831 vhCDR3
DKRTVTHEHYYYYGMDV

SEQ ID NO: 26747 - protein, 480 aa, Artificial Sequence; identical to SEQ ID NO: 2870
  Description of Artificial Sequence: Synthetic polypeptide
  XENP021831 jMab-139[ICOS]_H0L0_Fab-1G6_L1.194_H1.279_scFv scFv-Fc Heavy Chain

SEQ ID NO: 26748 - protein, 107 aa, Artificial Sequence; identical to SEQ ID NO: 2871
  Description of Artificial Sequence: Synthetic polypeptide
  VH of XENP021831

SEQ ID NO: 26749 - protein, 122 aa, Artificial Sequence; identical to SEQ ID NO: 2872
  Description of Artificial Sequence: Synthetic polypeptide
  VL of XENP021831

SEQ ID NO: 26750 - protein, 231 aa, Artificial Sequence; identical to SEQ ID NO: 2397
  Description of Artificial Sequence: Synthetic polypeptide
  Fc chain of XENP021831

SEQ ID NO: 26751 - protein, 11 aa, Artificial Sequence
  Description of Artificial Sequence: Synthetic peptide
  XENP021831 vhCDR1
RASQSVGNDVA

SEQ ID NO: 26752 - protein, 7 aa, Artificial Sequence
  Description of Artificial Sequence: Synthetic peptide
  XENP021831 vhCDR2
YASHRYT

SEQ ID NO: 26753 - protein, 9 aa, Artificial Sequence
  Description of Artificial Sequence: Synthetic peptide
  XENP021831 vhCDR3
QQDFSSPRT

SEQ ID NO: 26754 - protein, 5 aa, Artificial Sequence
  Description of Artificial Sequence: Synthetic peptide
  XENP021831 vlCDR1
NYWMN

SEQ ID NO: 26755 - protein, 19 aa, Artificial Sequence
  Description of Artificial Sequence: Synthetic peptide
  XENP021831 vlCDR2
EIRLYSNNYATHYAESVKG

SEQ ID NO: 26756 - protein, 11 aa, Artificial Sequence
  Description of Artificial Sequence: Synthetic peptide
  XENP021831 vlCDR3
YYGNYGGYFDV

SEQ ID NO: 26757 - protein, 216 aa, Artificial Sequence; identical to SEQ ID NO: 26337
  Description of Artificial Sequence: Synthetic polypeptide
  XENP021831 jMab-139[ICOS]_H0L0_Fab-1G6_L1.194_H1.279_scFv Light Chain

SEQ ID NO: 26758 - protein, 109 aa, Artificial Sequence; identical to SEQ ID NO: 26338
  Description of Artificial Sequence: Synthetic polypeptide
  VL of XENP021831

SEQ ID NO: 26759 - protein, 12 aa, Artificial Sequence
  Description of Artificial Sequence: Synthetic peptide
  XENP021831 vlCDR1
RASQSISSSSLA

SEQ ID NO: 26760 - protein, 7 aa, Artificial Sequence
  Description of Artificial Sequence: Synthetic peptide
  XENP021831 vlCDR2
GASSRAT

SEQ ID NO: 26761 - protein, 10 aa, Artificial Sequence
  Description of Artificial Sequence: Synthetic peptide
  XENP021831 vlCDR3
QQFGSSPMCS

SEQ ID NO: 26762 - protein, 450 aa, Artificial Sequence
  Description of Artificial Sequence: Synthetic polypeptide
  XENP022348 WO2016059602_GSK_H0L0_Fab-1G6_L1.194_H1.279_scFv Fab-Fc Heavy Chain
QVQLVQSGAEVKKPGSSVKVSCKASGYTFTDYAMHWVRQAPGQGLEWMGLISIYSDHTNYNQKFQGRVTITADKSTSTAYMELSSLRSEDTAVYYCGRNNYGNYGWYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 26763 - protein, 121 aa, Artificial Sequence; identical to SEQ ID NO: 26343
  Description of Artificial Sequence: Synthetic polypeptide
  VH of XENP022348

SEQ ID NO: 26764 - protein, 5 aa, Artificial Sequence
  Description of Artificial Sequence: Synthetic peptide
  XENP022348 vhCDR1
DYAMH

SEQ ID NO: 26765 - protein, 17 aa, Artificial Sequence
  Description of Artificial Sequence: Synthetic peptide
  XENP022348 vhCDR2
LISIYSDHTNYNQKFQG

SEQ ID NO: 26766 - protein, 12 aa, Artificial Sequence
  Description of Artificial Sequence: Synthetic peptide
  XENP022348 vhCDR3
NNYGNYGWYFDV

SEQ ID NO: 26767 - protein, 480 aa, Artificial Sequence; identical to SEQ ID NO: 2870
  Description of Artificial Sequence: Synthetic polypeptide
  XENP022348 WO2016059602_GSK_H0L0_Fab-1G6_L1.194_H1.279_scFv scFv-Fc Heavy Chain

SEQ ID NO: 26768 - protein, 107 aa, Artificial Sequence; identical to SEQ ID NO: 2871
  Description of Artificial Sequence: Synthetic polypeptide
  VH of XENP022348

SEQ ID NO: 26769 - protein, 122 aa, Artificial Sequence; identical to SEQ ID NO: 2872
  Description of Artificial Sequence: Synthetic polypeptide
  VL of XENP022348

SEQ ID NO: 26770 - protein, 231 aa, Artificial Sequence; identical to SEQ ID NO: 2397
  Description of Artificial Sequence: Synthetic polypeptide
  Fc chain of XENP022348

SEQ ID NO: 26771 - protein, 11 aa, Artificial Sequence
  Description of Artificial Sequence: Synthetic peptide
  XENP022348 vhCDR1
RASQSVGNDVA

SEQ ID NO: 26772 - protein, 7 aa, Artificial Sequence
  Description of Artificial Sequence: Synthetic peptide
  XENP022348 vhCDR2
YASHRYT

SEQ ID NO: 26773 - protein, 9 aa, Artificial Sequence
  Description of Artificial Sequence: Synthetic peptide
  XENP022348 vhCDR3
QQDFSSPRT

SEQ ID NO: 26774 - protein, 5 aa, Artificial Sequence
  Description of Artificial Sequence: Synthetic peptide
  XENP022348 vlCDR1
NYWMN

SEQ ID NO: 26775 - protein, 19 aa, Artificial Sequence
  Description of Artificial Sequence: Synthetic peptide
  XENP022348 vlCDR2
EIRLYSNNYATHYAESVKG

SEQ ID NO: 26776 - protein, 11 aa, Artificial Sequence
  Description of Artificial Sequence: Synthetic peptide
  XENP022348 vlCDR3
YYGNYGGYFDV

SEQ ID NO: 26777 - protein, 213 aa, Artificial Sequence; identical to SEQ ID NO: 26347
  Description of Artificial Sequence: Synthetic polypeptide
  XENP022348 WO2016059602_GSK_H0L0_Fab-1G6_L1.194_H1.279_scFv Light Chain

SEQ ID NO: 26778 - protein, 106 aa, Artificial Sequence; identical to SEQ ID NO: 26348
  Description of Artificial Sequence: Synthetic polypeptide
  VL of XENP022348

SEQ ID NO: 26779 - protein, 10 aa, Artificial Sequence
  Description of Artificial Sequence: Synthetic peptide
  XENP022348 vlCDR1
SASSSVSYMH

SEQ ID NO: 26780 - protein, 7 aa, Artificial Sequence
  Description of Artificial Sequence: Synthetic peptide
  XENP022348 vlCDR2
DTSKLAS

SEQ ID NO: 26781 - protein, 9 aa, Artificial Sequence
  Description of Artificial Sequence: Synthetic peptide
  XENP022348 vlCDR3
FQGSGYPYT

SEQ ID NO: 26782 - protein, 446 aa, Artificial Sequence
  Description of Artificial Sequence: Synthetic polypeptide
  XENP023059 Jounce_37A10S713[ICOS]_H0L0_Fab-1G6_[PD-1]_L1.194 _H1.279_scFv Fab-Fc Heavy Chain
EVQLVESGGGLVQPGGSLRLSCAASGFTFSDYWMDWVRQAPGKGLVWVSNIDEDGSITEYSPFVKGRFTISRDNAKNTLYLQMNSLRAEDTAVYYCTRWGRFGFDSWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 26783 - protein, 117 aa, Artificial Sequence; identical to SEQ ID NO: 26353
  Description of Artificial Sequence: Synthetic polypeptide
  VH of XENP023059

SEQ ID NO: 26784 - protein, 5 aa, Artificial Sequence
  Description of Artificial Sequence: Synthetic peptide
  XENP023059 vhCDR1
DYWMD

SEQ ID NO: 26785 - protein, 17 aa, Artificial Sequence
  Description of Artificial Sequence: Synthetic peptide
  XENP023059 vhCDR2
NIDEDGSITEYSPFVKG

SEQ ID NO: 26786 - protein, 8 aa, Artificial Sequence
  Description of Artificial Sequence: Synthetic peptide
  XENP023059 vhCDR3
WGRFGFDS

SEQ ID NO: 26787 - protein, 480 aa, Artificial Sequence; identical to SEQ ID NO: 2870
  Description of Artificial Sequence: Synthetic polypeptide
  XENP023059 Jounce_37A10S713[ICOS]_H0L0_Fab-1G6_[PD-1]_L1.194 _H1.279_scFv scFv-Fc Heavy Chain

SEQ ID NO: 26788 - protein, 107 aa, Artificial Sequence; identical to SEQ ID NO: 2871
  Description of Artificial Sequence: Synthetic polypeptide
  VH of XENP023059

SEQ ID NO: 26789 - protein, 122 aa, Artificial Sequence; identical to SEQ ID NO: 2872
  Description of Artificial Sequence: Synthetic polypeptide
  VL of XENP023059

SEQ ID NO: 26790 - protein, 231 aa, Artificial Sequence; identical to SEQ ID NO: 2397
  Description of Artificial Sequence: Synthetic polypeptide
  Fc chain of XENP023059

SEQ ID NO: 26791 - protein, 11 aa, Artificial Sequence
  Description of Artificial Sequence: Synthetic peptide
  XENP023059 vhCDR1
RASQSVGNDVA

SEQ ID NO: 26792 - protein, 7 aa, Artificial Sequence
  Description of Artificial Sequence: Synthetic peptide
  XENP023059 vhCDR2
YASHRYT

SEQ ID NO: 26793 - protein, 9 aa, Artificial Sequence
  Description of Artificial Sequence: Synthetic peptide
  XENP023059 vhCDR3
QQDFSSPRT

SEQ ID NO: 26794 - protein, 5 aa, Artificial Sequence
  Description of Artificial Sequence: Synthetic peptide
  XENP023059 vlCDR1
NYWMN

SEQ ID NO: 26795 - protein, 19 aa, Artificial Sequence
  Description of Artificial Sequence: Synthetic peptide
  XENP023059 vlCDR2
EIRLYSNNYATHYAESVKG

SEQ ID NO: 26796 - protein, 11 aa, Artificial Sequence
  Description of Artificial Sequence: Synthetic peptide
  XENP023059 vlCDR3
YYGNYGGYFDV

SEQ ID NO: 26797 - protein, 218 aa, Artificial Sequence; identical to SEQ ID NO: 26357
  Description of Artificial Sequence: Synthetic polypeptide
  XENP023059 Jounce_37A10S713[ICOS]_H0L0_Fab-1G6_[PD-1]_L1.194 _H1.279_scFv Light Chain

SEQ ID NO: 26798 - protein, 111 aa, Artificial Sequence; identical to SEQ ID NO: 26358
  Description of Artificial Sequence: Synthetic polypeptide
  VL of XENP023059

SEQ ID NO: 26799 - protein, 15 aa, Artificial Sequence
  Description of Artificial Sequence: Synthetic peptide
  XENP023059 vlCDR1
KSSQSLLSGSFNYLT

SEQ ID NO: 26800 - protein, 7 aa, Artificial Sequence
  Description of Artificial Sequence: Synthetic peptide
  XENP023059 vlCDR2
YASTRHT

SEQ ID NO: 26801 - protein, 9 aa, Artificial Sequence
  Description of Artificial Sequence: Synthetic peptide
  XENP023059 vlCDR3
HHHYNAPPT

SEQ ID NO: 26802 - protein, 442 aa, Artificial Sequence
  Description of Artificial Sequence: Synthetic polypeptide
  XENP018920 nivolumab[PD-1]_H0L0_Fab-[anti-ICOS]_H0L0 _scFv Fab-Fc Heavy Chain
QVQLVESGGGVVQPGRSLRLDCKASGITFSNSGMHWVRQAPGKGLEWVAVIWYDGSKRYYADSVKGRFTISRDNSKNTLFLQMNSLRAEDTAVYYCATNDDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 26803 - protein, 113 aa, Artificial Sequence [sequence omitted]

SEQ ID NO: 26804 - protein, 5 aa, Artificial Sequence
  Description of Artificial Sequence: Synthetic peptide
  XENP018920 vhCDR1
NSGMH

SEQ ID NO: 26805 - protein, 17 aa, Artificial Sequence
  Description of Artificial Sequence: Synthetic peptide
  XENP018920 vhCDR2
VIWYDGSKRYYADSVKG

SEQ ID NO: 26806 - protein, 4 aa, Artificial Sequence
  Description of Artificial Sequence: Synthetic peptide
  XENP018920 vhCDR3
NDDY

SEQ ID NO: 26807 - protein, 471 aa, Artificial Sequence
  Description of Artificial Sequence: Synthetic polypeptide
  XENP018920 nivolumab[PD-1]_H0L0_Fab-[anti-ICOS]_H0L0 _scFv scFv-Fc Heavy Chain
QVQLVESGGGVVQPGRSLRLSCKASGITFSNSGMHWVRQAPGKGLEWVAVIWYDGSKRYYADSVKGRFTISRDNSKNTLFLQMNSLRAEDTAVYYCATNDDYWGQGTLVTVSSGKPGSGKPGSGKPGSGKPGSEIVLTQSPATLSLSPGERATLSCRASQSVSSYLAWYQQKPGQAPRLLIYDASNRATGIPARFSGSGSGTDFTLTISSLEPEDFAVYYCQQSSNWPRTFGQGTKVEIKEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 26808 - protein, 113 aa, Artificial Sequence; identical to SEQ ID NO: 10886
  Description of Artificial Sequence: Synthetic polypeptide
  VH of XENP018920

SEQ ID NO: 26809 - protein, 107 aa, Artificial Sequence [sequence omitted]

SEQ ID NO: 26810 - protein, 231 aa, Artificial Sequence; identical to SEQ ID NO: 2397
  Description of Artificial Sequence: Synthetic polypeptide
  Fc chain of XENP018920

SEQ ID NO: 26811 - protein, 5 aa, Artificial Sequence
  Description of Artificial Sequence: Synthetic peptide
  XENP018920 vhCDR1
NSGMH

SEQ ID NO: 26812 - protein, 17 aa, Artificial Sequence
  Description of Artificial Sequence: Synthetic peptide
  XENP018920 vhCDR2
VIWYDGSKRYYADSVKG

SEQ ID NO: 26813 - protein, 4 aa, Artificial Sequence
  Description of Artificial Sequence: Synthetic peptide
  XENP018920 vhCDR3
NDDY

SEQ ID NO: 26814 - protein, 11 aa, Artificial Sequence
  Description of Artificial Sequence: Synthetic peptide
  XENP018920 vlCDR1
RASQSVSSYLA

SEQ ID NO: 26815 - protein, 7 aa, Artificial Sequence
  Description of Artificial Sequence: Synthetic peptide
  XENP018920 vlCDR2
DASNRAT

SEQ ID NO: 26816 - protein, 9 aa, Artificial Sequence
  Description of Artificial Sequence: Synthetic peptide
  XENP018920 vlCDR3
QQSSNWPRT

SEQ ID NO: 26817 - protein, 214 aa, Artificial Sequence; identical to SEQ ID NO: 16146
  Description of Artificial Sequence: Synthetic polypeptide
  XENP018920 nivolumab[PD-1]_H0L0_Fab-[anti-ICOS]_H0L0 _scFv Light Chain

SEQ ID NO: 26818 - protein, 107 aa, Artificial Sequence [sequence omitted]

SEQ ID NO: 26819 - protein, 11 aa, Artificial Sequence
  Description of Artificial Sequence: Synthetic peptide
  XENP018920 vlCDR1
RASQSVSSYLA

SEQ ID NO: 26820 - protein, 7 aa, Artificial Sequence
  Description of Artificial Sequence: Synthetic peptide
  XENP018920 vlCDR2
DASNRAT

SEQ ID NO: 26821 - protein, 9 aa, Artificial Sequence
  Description of Artificial Sequence: Synthetic peptide
  XENP018920 vlCDR3
QQSSNWPRT

SEQ ID NO: 26822 - protein, 456 aa, Artificial Sequence
  Description of Artificial Sequence: Synthetic polypeptide
  XENP024130 LOPD180[PD-1]_H1L1_Fab-[anti-ICOS]_H0L0 _scFv Fab-Fc Heavy Chain
QVQLQESGPGLVKPSQTLSLTCTVSGGSISSGAYYWSWIRQHPGKGLEWIGYIYYNGNTYYNPSLRSRVTISVDTSKNQFSLKLSSVTAADTAVYYCVRASDYVWGGYHYFDAFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 26823 - protein, 127 aa, Artificial Sequence
  Description of Artificial Sequence: Synthetic polypeptide
  VH of XENP024130
QVQLQESGPGLVKPSQTLSLTCTVSGGSISSGAYYWSWIRQHPGKGLEWIGYIYYNGNTYYNPSLRSRVTISVDTSKNQFSLKLSSVTAADTAVYYCVRASDYVWGGYHYFDAFDLWGRGTLVTVSS

SEQ ID NO: 26824 - protein, 7 aa, Artificial Sequence
  Description of Artificial Sequence: Synthetic peptide
  XENP024130 vhCDR1
SGAYYWS

SEQ ID NO: 26825 - protein, 16 aa, Artificial Sequence
  Description of Artificial Sequence: Synthetic peptide
  XENP024130 vhCDR2
YIYYNGNTYYNPSLRS

SEQ ID NO: 26826 - protein, 17 aa, Artificial Sequence
  Description of Artificial Sequence: Synthetic peptide
  XENP024130 vhCDR3
ASDYVWGGYHYFDAFDL

SEQ ID NO: 26827 - protein, 483 aa, Artificial Sequence
  Description of Artificial Sequence: Synthetic polypeptide
  XENP024130 LOPD180[PD-1]_H1L1_Fab-[anti-ICOS]_H0L0 _scFv scFv-Fc Heavy Chain
QVQLVQSGAEVKKPGASVKVSCKASGYTFTGYYMHWVRQAPGQGLEWMGWINPHSGGTNYAQKFQGRVTMTRDTSISTAYMELSRLRSDDTAVYYCARTYYYDSSGYYHDAFDIWGQGTMVTVSSGKPGSGKPGSGKPGSGKPGSDIQMTQSPSSVSASVGDRVTITCRASQGISRLLAWYQQKPGKAPKLLIYVASSLQSGVPSRFSGSGSGTDFTLTISSLQPEDFATYYCQQANSFPWTFGQGTKVEIKEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 26828 - protein, 125 aa, Artificial Sequence; identical to SEQ ID NO: 26293
  Description of Artificial Sequence: Synthetic polypeptide
  VH of XENP024130

SEQ ID NO: 26829 - protein, 107 aa, Artificial Sequence; identical to SEQ ID NO: 26298
  Description of Artificial Sequence: Synthetic polypeptide
  VL of XENP024130

SEQ ID NO: 26830 - protein, 231 aa, Artificial Sequence; identical to SEQ ID NO: 2397
  Description of Artificial Sequence: Synthetic polypeptide
  Fc chain of XENP024130

SEQ ID NO: 26831 - protein, 5 aa, Artificial Sequence
  Description of Artificial Sequence: Synthetic peptide
  XENP024130 vhCDR1
GYYMH

SEQ ID NO: 26832 - protein, 17 aa, Artificial Sequence
  Description of Artificial Sequence: Synthetic peptide
  XENP024130 vhCDR2
WINPHSGGTNYAQKFQG

SEQ ID NO: 26833 - protein, 16 aa, Artificial Sequence
  Description of Artificial Sequence: Synthetic peptide
  XENP024130 vhCDR3
TYYYDSSGYYHDAFDI

SEQ ID NO: 26834 - protein, 11 aa, Artificial Sequence
  Description of Artificial Sequence: Synthetic peptide
  XENP024130 vlCDR1
RASQGISRLLA

SEQ ID NO: 26835 - protein, 7 aa, Artificial Sequence
  Description of Artificial Sequence: Synthetic peptide
  XENP024130 vlCDR2
VASSLQS

SEQ ID NO: 26836 - protein, 9 aa, Artificial Sequence
  Description of Artificial Sequence: Synthetic peptide
  XENP024130 vlCDR3
QQANSFPWT

SEQ ID NO: 26837 - protein, 216 aa, Artificial Sequence
  Description of Artificial Sequence: Synthetic polypeptide
  XENP024130 LOPD180[PD-1]_H1L1_Fab-[anti-ICOS]_H0L0 _scFv Light Chain
QSVLTQPPSASGTPGQRVTISCSGSNSNIGSNSVNWYQQLPGTAPKLLIYGNNQRPSGVPDRFSGSKSGTSASLAISGLQSEDEADYYCAAWDDSLNGPVFGGGTKVTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 26838 - protein, 110 aa, Artificial Sequence
  Description of Artificial Sequence: Synthetic polypeptide
  VL of XENP024130
QSVLTQPPSASGTPGQRVTISCSGSNSNIGSNSVNWYQQLPGTAPKLLIYGNNQRPSGVPDRFSGSKSGTSASLAISGLQSEDEADYYCAAWDDSLNGPVFGGGTKVTVL

SEQ ID NO: 26839 - protein, 13 aa, Artificial Sequence
  Description of Artificial Sequence: Synthetic peptide
  XENP024130 vlCDR1
SGSNSNIGSNSVN

SEQ ID NO: 26840 - protein, 7 aa, Artificial Sequence
  Description of Artificial Sequence: Synthetic peptide
  XENP024130 vlCDR2
GNNQRPS

SEQ ID NO: 26841 - protein, 11 aa, Artificial Sequence
  Description of Artificial Sequence: Synthetic peptide
  XENP024130 vlCDR3
AAWDDSLNGPV

SEQ ID NO: 26842 - protein, 454 aa, Artificial Sequence; identical to SEQ ID NO: 26442
  Description of Artificial Sequence: Synthetic polypeptide
  XENP023406 [anti-ICOS]_H0L0_Fab-[anti-ICOS]_H0L0 _Fab_1G6_L1.194_H1.279_scFv Fab-Fc Heavy Chain

SEQ ID NO: 26843 - protein, 125 aa, Artificial Sequence; identical to SEQ ID NO: 26293
  Description of Artificial Sequence: Synthetic polypeptide
  VH of XENP023406

SEQ ID NO: 26844 - protein, 5 aa, Artificial Sequence
  Description of Artificial Sequence: Synthetic peptide
  XENP023406 vhCDR1
GYYMH

SEQ ID NO: 26845 - protein, 17 aa, Artificial Sequence
  Description of Artificial Sequence: Synthetic peptide
  XENP023406 vhCDR2
WINPHSGGTNYAQKFQG

SEQ ID NO: 26846 - protein, 16 aa, Artificial Sequence
  Description of Artificial Sequence: Synthetic peptide
  XENP023406 vhCDR3
TYYYDSSGYYHDAFDI

SEQ ID NO: 26847 - protein, 722 aa, Artificial Sequence
  Description of Artificial Sequence: Synthetic polypeptide
  XENP023406 [anti-ICOS]_H0L0_Fab-[anti-ICOS]_H0L0 _Fab_1G6_L1.194_H1.279_scFv Fab-scFv-Fc Heavy Chain
QVQLVQSGAEVKKPGASVKVSCKASGYTFTGYYMHWVRQAPGQGLEWMGWINPHSGGTNYAQKFQGRVTMTRDTSISTAYMELSRLRSDDTAVYYCARTYYYDSSGYYHDAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGKPGSGKPGSEIVLTQSPATLSASPGERVTLTCRASQSVGNDVAWYQQKPGQAPRLLINYASHRYTGVPDRFTGSGYGTEFTLTISSVQSEDFGVYYCQQDFSSPRTFGGGTKVEIKGKPGSGKPGSGKPGSGKPGSEVQLVESGGGLVKPGGSLRLSCVASGFTFSNYWMNWVRQAPGKGLEWVAEIRLYSNNYATHYAESVKGRFTISRDDSKSTLYLQMNNLKTEDTGVYYCTRYYGNYGGYFDVWGRGTLVTVSSGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 26848 - protein, 125 aa, Artificial Sequence; identical to SEQ ID NO: 26293
  Description of Artificial Sequence: Synthetic polypeptide
  VH of XENP023406

SEQ ID NO: 26849 - protein, 113 aa, Artificial Sequence
  Description of Artificial Sequence: Synthetic polypeptide
  Fc chain of XENP023406
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGKPGSGKPGS

SEQ ID NO: 26850 - protein, 107 aa, Artificial Sequence; identical to SEQ ID NO: 2871
  Description of Artificial Sequence: Synthetic polypeptide
  VL of XENP023406

SEQ ID NO: 26851 - protein, 225 aa, Artificial Sequence
  Description of Artificial Sequence: Synthetic polypeptide
  Fc chain of XENP023406
KTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 26852 - protein, 5 aa, Artificial Sequence
  Description of Artificial Sequence: Synthetic peptide
  XENP023406 vhCDR1
GYYMH

SEQ ID NO: 26853 - protein, 17 aa, Artificial Sequence
  Description of Artificial Sequence: Synthetic peptide
  XENP023406 vhCDR2
WINPHSGGTNYAQKFQG

SEQ ID NO: 26854 - protein, 16 aa, Artificial Sequence
  Description of Artificial Sequence: Synthetic peptide
  XENP023406 vhCDR3
TYYYDSSGYYHDAFDI

SEQ ID NO: 26855 - protein, 11 aa, Artificial Sequence
  Description of Artificial Sequence: Synthetic peptide
  XENP023406 vlCDR1
RASQSVGNDVA

SEQ ID NO: 26856 - protein, 7 aa, Artificial Sequence
  Description of Artificial Sequence: Synthetic peptide
  XENP023406 vlCDR2
YASHRYT

SEQ ID NO: 26857 - protein, 9 aa, Artificial Sequence
  Description of Artificial Sequence: Synthetic peptide
  XENP023406 vlCDR3
QQDFSSPRT

SEQ ID NO: 26858 - protein, 214 aa, Artificial Sequence; identical to SEQ ID NO: 26297
  Description of Artificial Sequence: Synthetic polypeptide
  XENP023406 [anti-ICOS]_H0L0_Fab-[anti-ICOS]_H0L0 _Fab_1G6_L1.194_H1.279_scFv Light Chain

SEQ ID NO: 26859 - protein, 107 aa, Artificial Sequence; identical to SEQ ID NO: 26298
  Description of Artificial Sequence: Synthetic polypeptide
  VL of XENP023406

SEQ ID NO: 26860 - protein, 11 aa, Artificial Sequence
  Description of Artificial Sequence: Synthetic peptide
  XENP023406 vlCDR1
RASQGISRLLA

SEQ ID NO: 26861 - protein, 7 aa, Artificial Sequence
  Description of Artificial Sequence: Synthetic peptide
  XENP023406 vlCDR2
VASSLQS

SEQ ID NO: 26862 - protein, 9 aa, Artificial Sequence
  Description of Artificial Sequence: Synthetic peptide
  XENP023406 vlCDR3
QQANSFPWT

SEQ ID NO: 26863 - protein, 455 aa, Artificial Sequence
  Description of Artificial Sequence: Synthetic polypeptide
  XENP023407 [anti-ICOS]_H0L0_Fab-[anti-ICOS]_H0L0 _Fab_1G6_L1.194_H1.279_scFv Fab-Fc Heavy Chain
QVQLVQSGAEVKKPGASVKVSCKASGYTFTGYYMHWVRQAPGQGLEWMGWINPHSGGTNYAQKFQGRVTMTRDTSISTAYMELSRLRSDDTAVYYCARTYYYDSSGYYHDAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPELLGGPSVFLFPPKPKDTLMISRTPEVTCVVVDVEHEDPEVKFNWYVDGVEVHNAKTKPREEEYNSTYRVVSVLTVLHQDWLNGKEYKCKVSNKAFPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 26864 - protein, 125 aa, Artificial Sequence; identical to SEQ ID NO: 26293
  Description of Artificial Sequence: Synthetic polypeptide
  VH of XENP023407

SEQ ID NO: 26865 - protein, 5 aa, Artificial Sequence
  Description of Artificial Sequence: Synthetic peptide
  XENP023407 vhCDR1
GYYMH

SEQ ID NO: 26866 - protein, 17 aa, Artificial Sequence
  Description of Artificial Sequence: Synthetic peptide
  XENP023407 vhCDR2
WINPHSGGTNYAQKFQG

SEQ ID NO: 26867 - protein, 16 aa, Artificial Sequence
  Description of Artificial Sequence: Synthetic peptide
  XENP023407 vhCDR3
TYYYDSSGYYHDAFDI

SEQ ID NO: 26868 - protein, 723 aa, Artificial Sequence
  Description of Artificial Sequence: Synthetic polypeptide
  XENP023407 [anti-ICOS]_H0L0_Fab-[anti-ICOS]_H0L0 _Fab_1G6_L1.194_H1.279_scFv Fab-scFv-Fc Heavy Chain
QVQLVQSGAEVKKPGASVKVSCKASGYTFTGYYMHWVRQAPGQGLEWMGWINPHSGGTNYAQKFQGRVTMTRDTSISTAYMELSRLRSDDTAVYYCARTYYYDSSGYYHDAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGKPGSGKPGSEIVLTQSPATLSASPGERVTLTCRASQSVGNDVAWYQQKPGQAPRLLINYASHRYTGVPDRFTGSGYGTEFTLTISSVQSEDFGVYYCQQDFSSPRTFGGGTKVEIKGKPGSGKPGSGKPGSGKPGSEVQLVESGGGLVKPGGSLRLSCVASGFTFSNYWMNWVRQAPGKGLEWVAEIRLYSNNYATHYAESVKGRFTISRDDSKSTLYLQMNNLKTEDTGVYYCTRYYGNYGGYFDVWGRGTLVTVSSGGGGSGGGGSKTHTCPPCPAPELLGGPSVFLFPPKPKDTLMISRTPEVTCVVVDVEHEDPEVKFNWYVDGVEVHNAKTKPREEQYNSTYRVVSVLTVLHQDWLNGKEYKCKVSNKAFPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 26869 - protein, 125 aa, Artificial Sequence; identical to SEQ ID NO: 26293
  Description of Artificial Sequence: Synthetic polypeptide
  VH of XENP023407

SEQ ID NO: 26870 - protein, 113 aa, Artificial Sequence; identical to SEQ ID NO: 26849
  Description of Artificial Sequence: Synthetic polypeptide
  Fc chain of XENP023407

SEQ ID NO: 26871 - protein, 107 aa, Artificial Sequence; identical to SEQ ID NO: 2871
  Description of Artificial Sequence: Synthetic polypeptide
  VL of XENP023407

SEQ ID NO: 26872 - protein, 226 aa, Artificial Sequence
  Description of Artificial Sequence: Synthetic polypeptide
  Fc chain of XENP023407
KTHTCPPCPAPELLGGPSVFLFPPKPKDTLMISRTPEVTCVVVDVEHEDPEVKFNWYVDGVEVHNAKTKPREEQYNSTYRVVSVLTVLHQDWLNGKEYKCKVSNKAFPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 26873 - protein, 5 aa, Artificial Sequence
  Description of Artificial Sequence: Synthetic peptide
  XENP023407 vhCDR1
GYYMH

SEQ ID NO: 26874 - protein, 17 aa, Artificial Sequence
  Description of Artificial Sequence: Synthetic peptide
  XENP023407 vhCDR2
WINPHSGGTNYAQKFQG

SEQ ID NO: 26875 - protein, 16 aa, Artificial Sequence
  Description of Artificial Sequence: Synthetic peptide
  XENP023407 vhCDR3
TYYYDSSGYYHDAFDI

SEQ ID NO: 26876 - protein, 11 aa, Artificial Sequence
  Description of Artificial Sequence: Synthetic peptide
  XENP023407 vlCDR1
RASQSVGNDVA

SEQ ID NO: 26877 - protein, 7 aa, Artificial Sequence
  Description of Artificial Sequence: Synthetic peptide
  XENP023407 vlCDR2
YASHRYT

SEQ ID NO: 26878 - protein, 9 aa, Artificial Sequence
  Description of Artificial Sequence: Synthetic peptide
  XENP023407 vlCDR3
QQDFSSPRT

SEQ ID NO: 26879 - protein, 214 aa, Artificial Sequence; identical to SEQ ID NO: 26297
  Description of Artificial Sequence: Synthetic polypeptide
  XENP023407 [anti-ICOS]_H0L0_Fab-[anti-ICOS]_H0L0 _Fab_1G6_L1.194_H1.279_scFv Light Chain

SEQ ID NO: 26880 - protein, 107 aa, Artificial Sequence; identical to SEQ ID NO: 26298
  Description of Artificial Sequence: Synthetic polypeptide
  VL of XENP023407

SEQ ID NO: 26881 - protein, 11 aa, Artificial Sequence
  Description of Artificial Sequence: Synthetic peptide
  XENP023407 vlCDR1
RASQGISRLLA

SEQ ID NO: 26882 - protein, 7 aa, Artificial Sequence
  Description of Artificial Sequence: Synthetic peptide
  XENP023407 vlCDR2
VASSLQS

SEQ ID NO: 26883 - protein, 9 aa, Artificial Sequence
  Description of Artificial Sequence: Synthetic peptide
  XENP023407 vlCDR3
QQANSFPWT

SEQ ID NO: 26884 - protein, 451 aa, Artificial Sequence
  Description of Artificial Sequence: Synthetic polypeptide
  XENP024128 1G6_L1.194_H1.279_Fab-1G6_L1.194_H1.279 _Fab_[anti-ICOS]_H0L0_scFv Fab-Fc Heavy Chain
EVQLVESGGGLVKPGGSLRLSCVASGFTFSNYWMNWVRQAPGKGLEWVAEIRLYSNNYATHYAESVKGRFTISRDDSKSTLYLQMNNLKTEDTGVYYCTRYYGNYGGYFDVWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 26885 - protein, 122 aa, Artificial Sequence; identical to SEQ ID NO: 2872
  Description of Artificial Sequence: Synthetic polypeptide
  VH of XENP024128

SEQ ID NO: 26886 - protein, 5 aa, Artificial Sequence
  Description of Artificial Sequence: Synthetic peptide
  XENP024128 vhCDR1
NYWMN

SEQ ID NO: 26887 - protein, 19 aa, Artificial Sequence
  Description of Artificial Sequence: Synthetic peptide
  XENP024128 vhCDR2
EIRLYSNNYATHYAESVKG

SEQ ID NO: 26888 - protein, 11 aa, Artificial Sequence
  Description of Artificial Sequence: Synthetic peptide
  XENP024128 vhCDR3
YYGNYGGYFDV

SEQ ID NO: 26889 - protein, 722 aa, Artificial Sequence
  Description of Artificial Sequence: Synthetic polypeptide
  XENP024128 1G6_L1.194_H1.279_Fab-1G6_L1.194_H1.279_Fab_[anti-ICOS] _H0L0_scFv Fab-scFv-Fc Heavy Chain
EVQLVESGGGLVKPGGSLRLSCVASGFTFSNYWMNWVRQAPGKGLEWVAEIRLYSNNYATHYAESVKGRFTISRDDSKSTLYLQMNNLKTEDTGVYYCTRYYGNYGGYFDVWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGKPGSGKPGSQVQLVQSGAEVKKPGASVKVSCKASGYTFTGYYMHWVRQAPGQGLEWMGWINPHSGGTNYAQKFQGRVTMTRDTSISTAYMELSRLRSDDTAVYYCARTYYYDSSGYYHDAFDIWGQGTMVTVSSGKPGSGKPGSGKPGSGKPGSDIQMTQSPSSVSASVGDRVTITCRASQGISRLLAWYQQKPGKAPKLLIYVASSLQSGVPSRFSGSGSGTDFTLTISSLQPEDFATYYCQQANSFPWTFGQGTKVEIKGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 26890 - protein, 122 aa, Artificial Sequence; identical to SEQ ID NO: 2872
  Description of Artificial Sequence: Synthetic polypeptide
  VH of XENP024128

SEQ ID NO: 26891 - protein, 113 aa, Artificial Sequence; identical to SEQ ID NO: 26849
  Description of Artificial Sequence: Synthetic polypeptide
  Fc chain of XENP024128

SEQ ID NO: 26892 - protein, 125 aa, Artificial Sequence; identical to SEQ ID NO: 26293
  Description of Artificial Sequence: Synthetic polypeptide
  VL of XENP024128

SEQ ID NO: 26893 - protein, 225 aa, Artificial Sequence; identical to SEQ ID NO: 26851
  Description of Artificial Sequence: Synthetic polypeptide
  Fc chain of XENP024128

SEQ ID NO: 26894 - protein, 5 aa, Artificial Sequence
  Description of Artificial Sequence: Synthetic peptide
  XENP024128 vhCDR1
NYWMN

SEQ ID NO: 26895 - protein, 19 aa, Artificial Sequence
  Description of Artificial Sequence: Synthetic peptide
  XENP024128 vhCDR2
EIRLYSNNYATHYAESVKG

SEQ ID NO: 26896 - protein, 11 aa, Artificial Sequence
  Description of Artificial Sequence: Synthetic peptide
  XENP024128 vhCDR3
YYGNYGGYFDV

SEQ ID NO: 26897 - protein, 5 aa, Artificial Sequence
  Description of Artificial Sequence: Synthetic peptide
  XENP024128 vlCDR1
GYYMH

SEQ ID NO: 26898 - protein, 17 aa, Artificial Sequence
  Description of Artificial Sequence: Synthetic peptide
  XENP024128 vlCDR2
WINPHSGGTNYAQKFQG

SEQ ID NO: 26899 - protein, 16 aa, Artificial Sequence
  Description of Artificial Sequence: Synthetic peptide
  XENP024128 vlCDR3
TYYYDSSGYYHDAFDI

SEQ ID NO: 26900 - protein, 214 aa, Artificial Sequence; identical to SEQ ID NO: 21486
  Description of Artificial Sequence: Synthetic polypeptide
  XENP024128 1G6_L1.194_H1.279_Fab-1G6_L1.194_H1.279_Fab_[anti-ICOS] _H0L0_scFv Light Chain

SEQ ID NO: 26901 - protein, 107 aa, Artificial Sequence; identical to SEQ ID NO: 2871
  Description of Artificial Sequence: Synthetic polypeptide
  VL of XENP024128

SEQ ID NO: 26902 - protein, 11 aa, Artificial Sequence
  Description of Artificial Sequence: Synthetic peptide
  XENP024128 vlCDR1
RASQSVGNDVA

SEQ ID NO: 26903 - protein, 7 aa, Artificial Sequence
  Description of Artificial Sequence: Synthetic peptide
  XENP024128 vlCDR2
YASHRYT

SEQ ID NO: 26904 - protein, 9 aa, Artificial Sequence
  Description of Artificial Sequence: Synthetic peptide
  XENP024128 vlCDR3
QQDFSSPRT

SEQ ID NO: 26905 - protein, 722 aa, Artificial Sequence
  Description of Artificial Sequence: Synthetic polypeptide
  XENP024123 1G6_H1.279_L1.194_Fab_(G4S)2_[anti-ICOS]_H0L0_scFv20 _Fc_IgG1 Heavy Chain
EVQLVESGGGLVKPGGSLRLSCVASGFTFSNYWMNWVRQAPGKGLEWVAEIRLYSNNYATHYAESVKGRFTISRDDSKSTLYLQMNNLKTEDTGVYYCTRYYGNYGGYFDVWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGGGGSGGGGSQVQLVQSGAEVKKPGASVKVSCKASGYTFTGYYMHWVRQAPGQGLEWMGWINPHSGGTNYAQKFQGRVTMTRDTSISTAYMELSRLRSDDTAVYYCARTYYYDSSGYYHDAFDIWGQGTMVTVSSGGGGSGGGGSGGGGSGGGGSDIQMTQSPSSVSASVGDRVTITCRASQGISRLLAWYQQKPGKAPKLLIYVASSLQSGVPSRFSGSGSGTDFTLTISSLQPEDFATYYCQQANSFPWTFGQGTKVEIKGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 26906 - protein, 122 aa, Artificial Sequence; identical to SEQ ID NO: 2872
  Description of Artificial Sequence: Synthetic polypeptide
  VH of XENP024123

SEQ ID NO: 26907 - protein, 113 aa, Artificial Sequence
  Description of Artificial Sequence: Synthetic polypeptide
  Fc chain of XENP024123
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGGGGSGGGGS

SEQ ID NO: 26908 - protein, 125 aa, Artificial Sequence; identical to SEQ ID NO: 26293
  Description of Artificial Sequence: Synthetic polypeptide
  VL of XENP024123

SEQ ID NO: 26909 - protein, 225 aa, Artificial Sequence
  Description of Artificial Sequence: Synthetic polypeptide
  Fc chain of XENP024123
KTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 26910 - protein, 5 aa, Artificial Sequence
  Description of Artificial Sequence: Synthetic peptide
  XENP024123 vhCDR1
NYWMN

SEQ ID NO: 26911 - protein, 19 aa, Artificial Sequence
  Description of Artificial Sequence: Synthetic peptide
  XENP024123 vhCDR2
EIRLYSNNYATHYAESVKG

SEQ ID NO: 26912 - protein, 11 aa, Artificial Sequence
  Description of Artificial Sequence: Synthetic peptide
  XENP024123 vhCDR3
YYGNYGGYFDV

SEQ ID NO: 26913 - protein, 5 aa, Artificial Sequence
  Description of Artificial Sequence: Synthetic peptide
  XENP024123 vlCDR1
GYYMH

SEQ ID NO: 26914 - protein, 17 aa, Artificial Sequence
  Description of Artificial Sequence: Synthetic peptide
  XENP024123 vlCDR2
WINPHSGGTNYAQKFQG

SEQ ID NO: 26915 - protein, 16 aa, Artificial Sequence
  Description of Artificial Sequence: Synthetic peptide
  XENP024123 vlCDR3
TYYYDSSGYYHDAFDI

SEQ ID NO: 26916 - protein, 214 aa, Artificial Sequence; identical to SEQ ID NO: 21486
  Description of Artificial Sequence: Synthetic polypeptide
  XENP024123 1G6_H1.279_L1.194_Fab_(G4S)2_[anti-ICOS]_H0L0 _scFv20_Fc_IgG1 Light Chain

SEQ ID NO: 26917 - protein, 107 aa, Artificial Sequence; identical to SEQ ID NO: 2871
  Description of Artificial Sequence: Synthetic polypeptide
  VL of XENP024123

SEQ ID NO: 26918 - protein, 11 aa, Artificial Sequence
  Description of Artificial Sequence: Synthetic peptide
  XENP024123 vlCDR1
RASQSVGNDVA

SEQ ID NO: 26919 - protein, 7 aa, Artificial Sequence
  Description of Artificial Sequence: Synthetic peptide
  XENP024123 vlCDR2
YASHRYT

SEQ ID NO: 26920 - protein, 9 aa, Artificial Sequence
  Description of Artificial Sequence: Synthetic peptide
  XENP024123 vlCDR3
QQDFSSPRT

SEQ ID NO: 26921 - protein, 727 aa, Artificial Sequence
  Description of Artificial Sequence: Synthetic polypeptide
  XENP024125 LOPD180[PD-1]_H1L1_Fab_(G4S)2_[anti-ICOS]_H0L0 _scFv20_Fc_IgG1 Heavy Chain
QVQLQESGPGLVKPSQTLSLTCTVSGGSISSGAYYWSWIRQHPGKGLEWIGYIYYNGNTYYNPSLRSRVTISVDTSKNQFSLKLSSVTAADTAVYYCVRASDYVWGGYHYFDAFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGGGGSGGGGSQVQLVQSGAEVKKPGASVKVSCKASGYTFTGYYMHWVRQAPGQGLEWMGWINPHSGGTNYAQKFQGRVTMTRDTSISTAYMELSRLRSDDTAVYYCARTYYYDSSGYYHDAFDIWGQGTMVTVSSGGGGSGGGGSGGGGSGGGGSDIQMTQSPSSVSASVGDRVTITCRASQGISRLLAWYQQKPGKAPKLLIYVASSLQSGVPSRFSGSGSGTDFTLTISSLQPEDFATYYCQQANSFPWTFGQGTKVEIKGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 26922 - protein, 127 aa, Artificial Sequence; identical to SEQ ID NO: 26823
  Description of Artificial Sequence: Synthetic polypeptide
  VH of XENP024125

SEQ ID NO: 26923 - protein, 113 aa, Artificial Sequence; identical to SEQ ID NO: 26907
  Description of Artificial Sequence: Synthetic polypeptide
  Fc chain of XENP024125

SEQ ID NO: 26924 - protein, 125 aa, Artificial Sequence; identical to SEQ ID NO: 26293
  Description of Artificial Sequence: Synthetic polypeptide
  VL of XENP024125

SEQ ID NO: 26925 - protein, 225 aa, Artificial Sequence; identical to SEQ ID NO: 26909
  Description of Artificial Sequence: Synthetic polypeptide
  Fc chain of XENP024125

SEQ ID NO: 26926 - protein, 7 aa, Artificial Sequence
  Description of Artificial Sequence: Synthetic peptide
  XENP024125 vhCDR1
SGAYYWS

SEQ ID NO: 26927 - protein, 16 aa, Artificial Sequence
  Description of Artificial Sequence: Synthetic peptide
  XENP024125 vhCDR2
YIYYNGNTYYNPSLRS

SEQ ID NO: 26928 - protein, 17 aa, Artificial Sequence
  Description of Artificial Sequence: Synthetic peptide
  XENP024125 vhCDR3
ASDYVWGGYHYFDAFDL

SEQ ID NO: 26929 - protein, 5 aa, Artificial Sequence
  Description of Artificial Sequence: Synthetic peptide
  XENP024125 vlCDR1
GYYMH

SEQ ID NO: 26930 - protein, 17 aa, Artificial Sequence
  Description of Artificial Sequence: Synthetic peptide
  XENP024125 vlCDR2
WINPHSGGTNYAQKFQG

SEQ ID NO: 26931 - protein, 16 aa, Artificial Sequence
  Description of Artificial Sequence: Synthetic peptide
  XENP024125 vlCDR3
TYYYDSSGYYHDAFDI

SEQ ID NO: 26932 - protein, 216 aa, Artificial Sequence; identical to SEQ ID NO: 26837
  Description of Artificial Sequence: Synthetic polypeptide
  XENP024125 LOPD180[PD-1]_H1L1_Fab_(G4S)2_[anti-ICOS]_H0L0 _scFv20_Fc_IgG1 Light Chain

SEQ ID NO: 26933 - protein, 110 aa, Artificial Sequence; identical to SEQ ID NO: 26838
  Description of Artificial Sequence: Synthetic polypeptide
  VL of XENP024125

SEQ ID NO: 26934 - protein, 13 aa, Artificial Sequence
  Description of Artificial Sequence: Synthetic peptide
  XENP024125 vlCDR1
SGSNSNIGSNSVN

SEQ ID NO: 26935 - protein, 7 aa, Artificial Sequence
  Description of Artificial Sequence: Synthetic peptide
  XENP024125 vlCDR2
GNNQRPS

SEQ ID NO: 26936 - protein, 11 aa, Artificial Sequence
  Description of Artificial Sequence: Synthetic peptide
  XENP024125 vlCDR3
AAWDDSLNGPV

SEQ ID NO: 26937 - protein, 451 aa, Artificial Sequence; identical to SEQ ID NO: 26884
  Description of Artificial Sequence: Synthetic polypeptide
  XENP024134 1G6_H1.279_L1.194_Fab-[anti-ICOS]_H0L0 _Fab-IgG1 Heavy Chain 1

SEQ ID NO: 26938 - protein, 122 aa, Artificial Sequence; identical to SEQ ID NO: 2872
  Description of Artificial Sequence: Synthetic polypeptide
  VH of XENP024134

SEQ ID NO: 26939 - protein, 5 aa, Artificial Sequence
  Description of Artificial Sequence: Synthetic peptide
  XENP024134 vhCDR1
NYWMN

SEQ ID NO: 26940 - protein, 19 aa, Artificial Sequence
  Description of Artificial Sequence: Synthetic peptide
  XENP024134 vhCDR2
EIRLYSNNYATHYAESVKG

SEQ ID NO: 26941 - protein, 11 aa, Artificial Sequence
  Description of Artificial Sequence: Synthetic peptide
  XENP024134 vhCDR3
YYGNYGGYFDV

SEQ ID NO: 26942 - protein, 454 aa, Artificial Sequence
  Description of Artificial Sequence: Synthetic polypeptide
  XENP024134 1G6_H1.279_L1.194_Fab-[anti-ICOS]_H0L0 _Fab-IgG1 Heavy Chain 2
QVQLVQSGAEVKKPGASVKVSCKASGYTFTGYYMHWVRQAPGQGLEWMGWINPHSGGTNYAQKFQGRVTMTRDTSISTAYMELSRLRSDDTAVYYCARTYYYDSSGYYHDAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTKTYTCNVNHKPSNTKVDKKVERKSCDKTHTCPRCPAPPVAGPSVFLFPPKPKDTLMISRTPEVTCVVVDVKHEDPEVKFKWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 26943 - protein, 125 aa, Artificial Sequence; identical to SEQ ID NO: 26293
  Description of Artificial Sequence: Synthetic polypeptide
  VH of XENP024134

SEQ ID NO: 26944 - protein, 5 aa, Artificial Sequence
  Description of Artificial Sequence: Synthetic peptide
  XENP024134 vhCDR1
GYYMH

SEQ ID NO: 26945 - protein, 17 aa, Artificial Sequence
  Description of Artificial Sequence: Synthetic peptide
  XENP024134 vhCDR2
WINPHSGGTNYAQKFQG

SEQ ID NO: 26946 - protein, 16 aa, Artificial Sequence
  Description of Artificial Sequence: Synthetic peptide
  XENP024134 vhCDR3
TYYYDSSGYYHDAFDI

SEQ ID NO: 26947 - protein, 214 aa, Artificial Sequence; identical to SEQ ID NO: 21486
  Description of Artificial Sequence: Synthetic polypeptide
  XENP024134 1G6_H1.279_L1.194_Fab-[anti-ICOS]_H0L0 _Fab-IgG1 Light Chain 1

SEQ ID NO: 26948 - protein, 107 aa, Artificial Sequence; identical to SEQ ID NO: 2871
  Description of Artificial Sequence: Synthetic polypeptide
  VL of XENP024134

SEQ ID NO: 26949 - protein, 11 aa, Artificial Sequence
  Description of Artificial Sequence: Synthetic peptide
  XENP024134 vlCDR1
RASQSVGNDVA

SEQ ID NO: 26950 - protein, 7 aa, Artificial Sequence
  Description of Artificial Sequence: Synthetic peptide
  XENP024134 vlCDR2
YASHRYT

SEQ ID NO: 26951 - protein, 9 aa, Artificial Sequence
  Description of Artificial Sequence: Synthetic peptide
  XENP024134 vlCDR3
QQDFSSPRT

SEQ ID NO: 26952 - protein, 214 aa, Artificial Sequence; identical to SEQ ID NO: 26297
  Description of Artificial Sequence: Synthetic polypeptide
  XENP024134 1G6_H1.279_L1.194_Fab-[anti-ICOS]_H0L0 _Fab-IgG1 Light Chain 2

SEQ ID NO: 26953 - protein, 107 aa, Artificial Sequence; identical to SEQ ID NO: 26298
  Description of Artificial Sequence: Synthetic polypeptide
  VL of XENP024134

SEQ ID NO: 26954 - protein, 11 aa, Artificial Sequence
  Description of Artificial Sequence: Synthetic peptide
  XENP024134 vlCDR1
RASQGISRLLA

SEQ ID NO: 26955 - protein, 7 aa, Artificial Sequence
  Description of Artificial Sequence: Synthetic peptide
  XENP024134 vlCDR2
VASSLQS

SEQ ID NO: 26956 - protein, 9 aa, Artificial Sequence
  Description of Artificial Sequence: Synthetic peptide
  XENP024134 vlCDR3
QQANSFPWT

SEQ ID NO: 26957 - protein, 589 aa, Artificial Sequence
  Description of Artificial Sequence: Synthetic polypeptide
  XENP024122 1G6_H1.279_L1.194_[anti-ICOS]_H0L0_IgG1 Heavy Chain
EVQLVESGGGLVKPGGSLRLSCVASGFTFSNYWMNWVRQAPGKGLEWVAEIRLYSNNYATHYAESVKGRFTISRDDSKSTLYLQMNNLKTEDTGVYYCTRYYGNYGGYFDVWGRGTLVTVSSASTKGPSVFPLAPQVQLVQSGAEVKKPGASVKVSCKASGYTFTGYYMHWVRQAPGQGLEWMGWINPHSGGTNYAQKFQGRVTMTRDTSISTAYMELSRLRSDDTAVYYCARTYYYDSSGYYHDAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 26958 - protein, 122 aa, Artificial Sequence; identical to SEQ ID NO: 2872
  Description of Artificial Sequence: Synthetic polypeptide
  VH of XENP024122

SEQ ID NO: 26959 - protein, 125 aa, Artificial Sequence; identical to SEQ ID NO: 26293
  Description of Artificial Sequence: Synthetic polypeptide
  VL of XENP024122

SEQ ID NO: 26960 - protein, 329 aa, Artificial Sequence
  Description of Artificial Sequence: Synthetic polypeptide
  Fc chain of XENP024122
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 26961 - protein, 5 aa, Artificial Sequence
  Description of Artificial Sequence: Synthetic peptide
  XENP024122 vhCDR1
NYWMN

SEQ ID NO: 26962 - protein, 19 aa, Artificial Sequence
  Description of Artificial Sequence: Synthetic peptide
  XENP024122 vhCDR2
EIRLYSNNYATHYAESVKG

SEQ ID NO: 26963 - protein, 11 aa, Artificial Sequence
  Description of Artificial Sequence: Synthetic peptide
  XENP024122 vhCDR3
YYGNYGGYFDV

SEQ ID NO: 26964 - protein, 5 aa, Artificial Sequence
  Description of Artificial Sequence: Synthetic peptide
  XENP024122 vlCDR1
GYYMH

SEQ ID NO: 26965 - protein, 17 aa, Artificial Sequence
  Description of Artificial Sequence: Synthetic peptide
  XENP024122 vlCDR2
WINPHSGGTNYAQKFQG

SEQ ID NO: 26966 - protein, 16 aa, Artificial Sequence
  Description of Artificial Sequence: Synthetic peptide
  XENP024122 vlCDR3
TYYYDSSGYYHDAFDI

SEQ ID NO: 26967 - protein, 334 aa, Artificial Sequence
  Description of Artificial Sequence: Synthetic polypeptide
  XENP024122 1G6_H1.279_L1.194_[anti-ICOS]_H0L0_IgG1 Light Chain
EIVLTQSPATLSASPGERVTLTCRASQSVGNDVAWYQQKPGQAPRLLINYASHRYTGVPDRFTGSGYGTEFTLTISSVQSEDFGVYYCQQDFSSPRTFGGGTKVEIKRTVAAPSVFIFPPDIQMTQSPSSVSASVGDRVTITCRASQGISRLLAWYQQKPGKAPKLLIYVASSLQSGVPSRFSGSGSGTDFTLTISSLQPEDFATYYCQQANSFPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 26968 - protein, 107 aa, Artificial Sequence; identical to SEQ ID NO: 2871
  Description of Artificial Sequence: Synthetic polypeptide
  VH of XENP024122

SEQ ID NO: 26969 - protein, 107 aa, Artificial Sequence; identical to SEQ ID NO: 26298
  Description of Artificial Sequence: Synthetic polypeptide
  VL of XENP024122

SEQ ID NO: 26970 - protein, 107 aa, Artificial Sequence [sequence omitted]

SEQ ID NO: 26971 - protein, 11 aa, Artificial Sequence
  Description of Artificial Sequence: Synthetic peptide
  XENP024122 vhCDR1
RASQSVGNDVA

SEQ ID NO: 26972 - protein, 7 aa, Artificial Sequence
  Description of Artificial Sequence: Synthetic peptide
  XENP024122 vhCDR2
YASHRYT

SEQ ID NO: 26973 - protein, 9 aa, Artificial Sequence
  Description of Artificial Sequence: Synthetic peptide
  XENP024122 vhCDR3
QQDFSSPRT

SEQ ID NO: 26974 - protein, 11 aa, Artificial Sequence
  Description of Artificial Sequence: Synthetic peptide
  XENP024122 vlCDR1
RASQGISRLLA

SEQ ID NO: 26975 - protein, 7 aa, Artificial Sequence
  Description of Artificial Sequence: Synthetic peptide
  XENP024122 vlCDR2
VASSLQS

SEQ ID NO: 26976 - protein, 9 aa, Artificial Sequence
  Description of Artificial Sequence: Synthetic peptide
  XENP024122 vlCDR3
QQANSFPWT

SEQ ID NO: 26977 - protein, 502 aa, Artificial Sequence
  Description of Artificial Sequence: Synthetic polypeptide
  XENP024132 1G6_L1.194_1G6_H1.279_DART-[anti-ICOS]_H0L0 _Fab-Fc_IgG1 Heavy Chain
EIVLTQSPATLSASPGERVTLTCRASQSVGNDVAWYQQKPGQAPRLLINYASHRYTGVPDRFTGSGYGTEFTLTISSVQSEDFGVYYCQQDFSSPRTFGGGTKVEIKGGGSGGGGEVQLVESGGGLVKPGGSLRLSCVASGFTFSNYWMNWVRQAPGKGLEWVAEIRLYSNNYATHYAESVKGRFTISRDDSKSTLYLQMNNLKTEDTGVYYCTRYYGNYGGYFDVWGRGTLVTVSSGGCGGGEVAACEKEVAALEKEVAALEKEVAALEKEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 26978 - protein, 107 aa, Artificial Sequence; identical to SEQ ID NO: 2871
  Description of Artificial Sequence: Synthetic polypeptide
  VH of XENP024132

SEQ ID NO: 26979 - protein, 122 aa, Artificial Sequence; identical to SEQ ID NO: 2872
  Description of Artificial Sequence: Synthetic polypeptide
  VL of XENP024132

SEQ ID NO: 26980 - protein, 265 aa, Artificial Sequence
  Description of Artificial Sequence: Synthetic polypeptide
  Fc chain of XENP024132
GGCGGGEVAACEKEVAALEKEVAALEKEVAALEKEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 26981 - protein, 11 aa, Artificial Sequence
  Description of Artificial Sequence: Synthetic peptide
  XENP024132 vhCDR1
RASQSVGNDVA

SEQ ID NO: 26982 - protein, 7 aa, Artificial Sequence
  Description of Artificial Sequence: Synthetic peptide
  XENP024132 vhCDR2
YASHRYT

SEQ ID NO: 26983 - protein, 9 aa, Artificial Sequence
  Description of Artificial Sequence: Synthetic peptide
  XENP024132 vhCDR3
QQDFSSPRT

SEQ ID NO: 26984 - protein, 5 aa, Artificial Sequence
  Description of Artificial Sequence: Synthetic peptide
  XENP024132 vlCDR1
NYWMN

SEQ ID NO: 26985 - protein, 19 aa, Artificial Sequence
  Description of Artificial Sequence: Synthetic peptide
  XENP024132 vlCDR2
EIRLYSNNYATHYAESVKG

SEQ ID NO: 26986 - protein, 11 aa, Artificial Sequence
  Description of Artificial Sequence: Synthetic peptide
  XENP024132 vlCDR3
YYGNYGGYFDV

SEQ ID NO: 26987 - protein, 454 aa, Artificial Sequence; identical to SEQ ID NO: 26942
  Description of Artificial Sequence: Synthetic polypeptide
  XENP024132 1G6_L1.194_1G6_H1.279_DART-[anti-ICOS]_H0L0 _Fab-Fc_IgG1 Heavy Chain

SEQ ID NO: 26988 - protein, 125 aa, Artificial Sequence; identical to SEQ ID NO: 26293
  Description of Artificial Sequence: Synthetic polypeptide
  VH of XENP024132

SEQ ID NO: 26989 - protein, 5 aa, Artificial Sequence
  Description of Artificial Sequence: Synthetic peptide
  XENP024132 vhCDR1
GYYMH

SEQ ID NO: 26990 - protein, 17 aa, Artificial Sequence
  Description of Artificial Sequence: Synthetic peptide
  XENP024132 vhCDR2
WINPHSGGTNYAQKFQG

SEQ ID NO: 26991 - protein, 16 aa, Artificial Sequence
  Description of Artificial Sequence: Synthetic peptide
  XENP024132 vhCDR3
TYYYDSSGYYHDAFDI

SEQ ID NO: 26992 - protein, 281 aa, Artificial Sequence
  Description of Artificial Sequence: Synthetic polypeptide
  XENP024132 1G6_L1.194_1G6_H1.279_DART-[anti-ICOS]_H0L0 _Fab-Fc_IgG1 Light Chain 1
EIVLTQSPATLSASPGERVTLTCRASQSVGNDVAWYQQKPGQAPRLLINYASHRYTGVPDRFTGSGYGTEFTLTISSVQSEDFGVYYCQQDFSSPRTFGGGTKVEIKGGGSGGGGEVQLVESGGGLVKPGGSLRLSCVASGFLRLSCVASGFTFSNYWMNWVRQAPGKGLEWVAEIRLYSNNYATHYAESVKGRFTISRDDSKSTLYLQMNNLKTEDTGVYYCTRYYGNYGGYFDVWGRGTLVTVSSGGCGGGKVAACKEKVAALKEKVAALKEKVAALKE

SEQ ID NO: 26993 - protein, 107 aa, Artificial Sequence; identical to SEQ ID NO: 2871
  Description of Artificial Sequence: Synthetic polypeptide
  VH of XENP024132

SEQ ID NO: 26994 - protein, 132 aa, Artificial Sequence
  Description of Artificial Sequence: Synthetic polypeptide
  VL of XENP024132
EVQLVESGGGLVKPGGSLRLSCVASGFLRLSCVASGFTFSNYWMNWVRQAPGKGLEWVAEIRLYSNNYATHYAESVKGRFTISRDDSKSTLYLQMNNLKTEDTGVYYCTRYYGNYGGYFDVWGRGTLVTVSS

SEQ ID NO: 26995 - protein, 34 aa, Artificial Sequence
  Description of Artificial Sequence: Synthetic polypeptide
  Fc chain of XENP024132
GGCGGGKVAACKEKVAALKEKVAALKEKVAALKE

SEQ ID NO: 26996 - protein, 11 aa, Artificial Sequence
  Description of Artificial Sequence: Synthetic peptide
  XENP024132 vhCDR1
RASQSVGNDVA

SEQ ID NO: 26997 - protein, 7 aa, Artificial Sequence
  Description of Artificial Sequence: Synthetic peptide
  XENP024132 vhCDR2
YASHRYT

SEQ ID NO: 26998 - protein, 9 aa, Artificial Sequence
  Description of Artificial Sequence: Synthetic peptide
  XENP024132 vhCDR3
QQDFSSPRT

SEQ ID NO: 26999 - protein, 15 aa, Artificial Sequence
  Description of Artificial Sequence: Synthetic peptide
  XENP024132 vlCDR1
SCVASGFTFSNYWMN

SEQ ID NO: 27000 - protein, 19 aa, Artificial Sequence
  Description of Artificial Sequence: Synthetic peptide
  XENP024132 vlCDR2
EIRLYSNNYATHYAESVKG

SEQ ID NO: 27001 - protein, 11 aa, Artificial Sequence
  Description of Artificial Sequence: Synthetic peptide
  XENP024132 vlCDR3
YYGNYGGYFDV

SEQ ID NO: 27002 - protein, 214 aa, Artificial Sequence; identical to SEQ ID NO: 26297
  Description of Artificial Sequence: Synthetic polypeptide
  XENP024132 1G6_L1.194_1G6_H1.279_DART-[anti-ICOS]_H0L0 _Fab-Fc_IgG1 Light Chain 2

SEQ ID NO: 27003 - protein, 107 aa, Artificial Sequence; identical to SEQ ID NO: 26298
  Description of Artificial Sequence: Synthetic polypeptide
  VL of XENP024132

SEQ ID NO: 27004 - protein, 11 aa, Artificial Sequence
  Description of Artificial Sequence: Synthetic peptide
  XENP024132 vlCDR1
RASQGISRLLA

SEQ ID NO: 27005 - protein, 7 aa, Artificial Sequence
  Description of Artificial Sequence: Synthetic peptide
  XENP024132 vlCDR2
VASSLQS

SEQ ID NO: 27006 - protein, 9 aa, Artificial Sequence
  Description of Artificial Sequence: Synthetic peptide
  XENP024132 vlCDR3
QQANSFPWT

SEQ ID NO: 27007 - protein, 503 aa, Artificial Sequence
  Description of Artificial Sequence: Synthetic polypeptide
  XENP024133 mAb7(1.2)[PD-1]_L1_mAb7(1.2)[PD-1]_H1 _DART-[anti-ICOS]_H0L0_Fab-Fc_IgG1 Heavy Chain 1
EIVLTQSPATLSLSPGERATLSCRASESVDNYGMSFMNWFQQKPGQPPKLLIHAASNQGSGVPSRFSGSGSGTDFTLTISSLEPEDFAVYFCQQSKEVPYTFGGGTKVEIKGGGSGGGGQVQLVQSGAEVKKPGASVKVSCKASGYSFTSYWMNWVRQAPGQGLEWIGVIHPSDSETWLDQKFKDRVTITVDKSTSTAYMELSSLRSEDTAVYYCAREHYGTSPFAYWGQGTLVTVSSGGCGGGEVAACEKEVAALEKEVAALEKEVAALEKEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 27008 - protein, 111 aa, Artificial Sequence
  Description of Artificial Sequence: Synthetic polypeptide
  VH of XENP024133
EIVLTQSPATLSLSPGERATLSCRASESVDNYGMSFMNWFQQKPGQPPKLLIHAASNQGSGVPSRFSGSGSGTDFTLTISSLEPEDFAVYFCQQSKEVPYTFGGGTKVEIK

SEQ ID NO: 27009 - protein, 119 aa, Artificial Sequence
  Description of Artificial Sequence: Synthetic polypeptide
  VL of XENP024133
QVQLVQSGAEVKKPGASVKVSCKASGYSFTSYWMNWVRQAPGQGLEWIGVIHPSDSETWLDQKFKDRVTITVDKSTSTAYMELSSLRSEDTAVYYCAREHYGTSPFAYWGQGTLVTVSS

SEQ ID NO: 27010 - protein, 265 aa, Artificial Sequence; identical to SEQ ID NO: 26980
  Description of Artificial Sequence: Synthetic polypeptide
  Fc chain of XENP024133

SEQ ID NO: 27011 - protein, 15 aa, Artificial Sequence
  Description of Artificial Sequence: Synthetic peptide
  XENP024133 vhCDR1
RASESVDNYGMSFMN

SEQ ID NO: 27012 - protein, 7 aa, Artificial Sequence
  Description of Artificial Sequence: Synthetic peptide
  XENP024133 vhCDR2
AASNQGS

SEQ ID NO: 27013 - protein, 9 aa, Artificial Sequence
  Description of Artificial Sequence: Synthetic peptide
  XENP024133 vhCDR3
QQSKEVPYT

SEQ ID NO: 27014 - protein, 5 aa, Artificial Sequence
  Description of Artificial Sequence: Synthetic peptide
  XENP024133 vlCDR1
SYWMN

SEQ ID NO: 27015 - protein, 17 aa, Artificial Sequence
  Description of Artificial Sequence: Synthetic peptide
  XENP024133 vlCDR2
VIHPSDSETWLDQKFKD

SEQ ID NO: 27016 - protein, 10 aa, Artificial Sequence
  Description of Artificial Sequence: Synthetic peptide
  XENP024133 vlCDR3
EHYGTSPFAY

SEQ ID NO: 27017 - protein, 454 aa, Artificial Sequence; identical to SEQ ID NO: 26942
  Description of Artificial Sequence: Synthetic polypeptide
  XENP024133 mAb7(1.2)[PD-1]_L1_mAb7(1.2)[PD-1]_H1 _DART-[anti-ICOS]_H0L0_Fab-Fc_IgG1 Heavy Chain 2

SEQ ID NO: 27018 - protein, 125 aa, Artificial Sequence; identical to SEQ ID NO: 26293
  Description of Artificial Sequence: Synthetic polypeptide
  VH of XENP024133

SEQ ID NO: 27019 - protein, 5 aa, Artificial Sequence
  Description of Artificial Sequence: Synthetic peptide
  XENP024133 vhCDR1
GYYMH

SEQ ID NO: 27020 - protein, 17 aa, Artificial Sequence
  Description of Artificial Sequence: Synthetic peptide
  XENP024133 vhCDR2
WINPHSGGTNYAQKFQG

SEQ ID NO: 27021 - protein, 16 aa, Artificial Sequence
  Description of Artificial Sequence: Synthetic peptide
  XENP024133 vhCDR3
TYYYDSSGYYHDAFDI

SEQ ID NO: 27022 - protein, 282 aa, Artificial Sequence
  Description of Artificial Sequence: Synthetic polypeptide
  XENP024133 mAb7(1.2)[PD-1]_L1_mAb7(1.2)[PD-1]_H1 _DART-[anti-ICOS]_H0L0_Fab-Fc_IgG1 Light Chain 1
EIVLTQSPATLSLSPGERATLSCRASESVDNYGMSFMNWFQQKPGQPPKLLIHAASNQGSGVPSRFSGSGSGTDFTLTISSLEPEDFAVYFCQQSKEVPYTFGGGTKVEIKGGGSGGGGQVQLVQSGAEVKKPGASVKVSCKAGASVKVSCKASGYSFTSYWMNWVRQAPGQGLEWIGVIHPSDSETWLDQKFKDRVTITVDKSTSTAYMELSSLRSEDTAVYYCAREHYGTSPFAYWGQGTLVTVSSGGCGGGKVAACKEKVAALKEKVAALKEKVAALKE

SEQ ID NO: 27023 - protein, 111 aa, Artificial Sequence; identical to SEQ ID NO: 27008
  Description of Artificial Sequence: Synthetic polypeptide
  VH of XENP024133

SEQ ID NO: 27024 - protein, 129 aa, Artificial Sequence
  Description of Artificial Sequence: Synthetic polypeptide
  VL of XENP024133
QVQLVQSGAEVKKPGASVKVSCKAGASVKVSCKASGYSFTSYWMNWVRQAPGQGLEWIGVIHPSDSETWLDQKFKDRVTITVDKSTSTAYMELSSLRSEDTAVYYCAREHYGTSPFAYWGQGTLVTVSS

SEQ ID NO: 27025 - protein, 34 aa, Artificial Sequence; identical to SEQ ID NO: 26995
  Description of Artificial Sequence: Synthetic polypeptide
  Fc chain of XENP024133

SEQ ID NO: 27026 - protein, 15 aa, Artificial Sequence
  Description of Artificial Sequence: Synthetic peptide
  XENP024133 vhCDR1
RASESVDNYGMSFMN

SEQ ID NO: 27027 - protein, 7 aa, Artificial Sequence
  Description of Artificial Sequence: Synthetic peptide
  XENP024133 vhCDR2
AASNQGS

SEQ ID NO: 27028 - protein, 9 aa, Artificial Sequence
  Description of Artificial Sequence: Synthetic peptide
  XENP024133 vhCDR3
QQSKEVPYT

SEQ ID NO: 27029 - protein, 5 aa, Artificial Sequence
  Description of Artificial Sequence: Synthetic peptide
  XENP024133 vlCDR1
SYWMN

SEQ ID NO: 27030 - protein, 17 aa, Artificial Sequence
  Description of Artificial Sequence: Synthetic peptide
  XENP024133 vlCDR2
VIHPSDSETWLDQKFKD

SEQ ID NO: 27031 - protein, 10 aa, Artificial Sequence
  Description of Artificial Sequence: Synthetic peptide
  XENP024133 vlCDR3
EHYGTSPFAY

SEQ ID NO: 27032 - protein, 214 aa, Artificial Sequence; identical to SEQ ID NO: 26297
  Description of Artificial Sequence: Synthetic polypeptide
  XENP024133 mAb7(1.2)[PD-1]_L1_mAb7(1.2)[PD-1]_H1 _DART-[anti-ICOS]_H0L0_Fab-Fc_IgG1 Light Chain 2

SEQ ID NO: 27033 - protein, 107 aa, Artificial Sequence; identical to SEQ ID NO: 26298
  Description of Artificial Sequence: Synthetic polypeptide
  VL of XENP024133

SEQ ID NO: 27034 - protein, 11 aa, Artificial Sequence
  Description of Artificial Sequence: Synthetic peptide
  XENP024133 vlCDR1
RASQGISRLLA

SEQ ID NO: 27035 - protein, 7 aa, Artificial Sequence
  Description of Artificial Sequence: Synthetic peptide
  XENP024133 vlCDR2
VASSLQS

SEQ ID NO: 27036 - protein, 9 aa, Artificial Sequence
  Description of Artificial Sequence: Synthetic peptide
  XENP024133 vlCDR3
QQANSFPWT

SEQ ID NO: 27037 - protein, 454 aa, Artificial Sequence; identical to SEQ ID NO: 26442
  Description of Artificial Sequence: Synthetic polypeptide
  XENP021749 [anti-ICOS]_H0L0_Fab-[anti-CTLA-4]_H3.23 _L0.129_scFv Fab-Fc Heavy Chain

SEQ ID NO: 27038 - protein, 125 aa, Artificial Sequence; identical to SEQ ID NO: 26293
  Description of Artificial Sequence: Synthetic polypeptide
  VH of XENP021749

SEQ ID NO: 27039 - protein, 5 aa, Artificial Sequence
  Description of Artificial Sequence: Synthetic peptide
  XENP021749 vhCDR1
GYYMH

SEQ ID NO: 27040 - protein, 17 aa, Artificial Sequence
  Description of Artificial Sequence: Synthetic peptide
  XENP021749 vhCDR2
WINPHSGGTNYAQKFQG

SEQ ID NO: 27041 - protein, 16 aa, Artificial Sequence
  Description of Artificial Sequence: Synthetic peptide
  XENP021749 vhCDR3
TYYYDSSGYYHDAFDI

SEQ ID NO: 27042 - protein, 477 aa, Artificial Sequence; identical to SEQ ID NO: 2394
  Description of Artificial Sequence: Synthetic polypeptide
  XENP021749 [anti-ICOS]_H0L0_Fab-[anti-CTLA-4]_H3.23 _L0.129_scFv scFv-Fc Heavy Chain

SEQ ID NO: 27043 - protein, 118 aa, Artificial Sequence; identical to SEQ ID NO: 2395
  Description of Artificial Sequence: Synthetic polypeptide
  VH of XENP021749

SEQ ID NO: 27044 - protein, 108 aa, Artificial Sequence; identical to SEQ ID NO: 2396
  Description of Artificial Sequence: Synthetic polypeptide
  VL of XENP021749

SEQ ID NO: 27045 - protein, 231 aa, Artificial Sequence; identical to SEQ ID NO: 2397
  Description of Artificial Sequence: Synthetic polypeptide
  Fc chain of XENP021749

SEQ ID NO: 27046 - protein, 5 aa, Artificial Sequence
  Description of Artificial Sequence: Synthetic peptide
  XENP021749 vhCDR1
SYTMH

SEQ ID NO: 27047 - protein, 17 aa, Artificial Sequence
  Description of Artificial Sequence: Synthetic peptide
  XENP021749 vhCDR2
FISYDGNYKYYADSVKG

SEQ ID NO: 27048 - protein, 9 aa, Artificial Sequence
  Description of Artificial Sequence: Synthetic peptide
  XENP021749 vhCDR3
GGHLGPFDL

SEQ ID NO: 27049 - protein, 12 aa, Artificial Sequence
  Description of Artificial Sequence: Synthetic peptide
  XENP021749 vlCDR1
RASQSVGSSYLA

SEQ ID NO: 27050 - protein, 7 aa, Artificial Sequence
  Description of Artificial Sequence: Synthetic peptide
  XENP021749 vlCDR2
GASSRAT

SEQ ID NO: 27051 - protein, 9 aa, Artificial Sequence
  Description of Artificial Sequence: Synthetic peptide
  XENP021749 vlCDR3
QQYGSSPWT

SEQ ID NO: 27052 - protein, 214 aa, Artificial Sequence; identical to SEQ ID NO: 26297
  Description of Artificial Sequence: Synthetic polypeptide
  XENP021749 [anti-ICOS]_H0L0_Fab-[anti-CTLA-4]_H3.23 _L0.129_scFv Light Chain

SEQ ID NO: 27053 - protein, 107 aa, Artificial Sequence; identical to SEQ ID NO: 26298
  Description of Artificial Sequence: Synthetic polypeptide
  VL of XENP021749

SEQ ID NO: 27054 - protein, 11 aa, Artificial Sequence
  Description of Artificial Sequence: Synthetic peptide
  XENP021749 vlCDR1
RASQGISRLLA

SEQ ID NO: 27055 - protein, 7 aa, Artificial Sequence
  Description of Artificial Sequence: Synthetic peptide
  XENP021749 vlCDR2
VASSLQS

SEQ ID NO: 27056 - protein, 9 aa, Artificial Sequence
  Description of Artificial Sequence: Synthetic peptide
  XENP021749 vlCDR3
QQANSFPWT

SEQ ID NO: 27057 - protein, 450 aa, Artificial Sequence; identical to SEQ ID NO: 2785
  Description of Artificial Sequence: Synthetic polypeptide
  XENP024359 7G8_H3.30_L1.34_Fab-[anti-ICOS]_H0L0_Fab Heavy Chain 1

SEQ ID NO: 27058 - protein, 121 aa, Artificial Sequence; identical to SEQ ID NO: 2516
  Description of Artificial Sequence: Synthetic polypeptide
  VH of XENP024359

SEQ ID NO: 27059 - protein, 5 aa, Artificial Sequence
  Description of Artificial Sequence: Synthetic peptide
  XENP024359 vhCDR1
DAWMS

SEQ ID NO: 27060 - protein, 19 aa, Artificial Sequence
  Description of Artificial Sequence: Synthetic peptide
  XENP024359 vhCDR2
EISTKANNHATYYAESVKG

SEQ ID NO: 27061 - protein, 10 aa, Artificial Sequence
  Description of Artificial Sequence: Synthetic peptide
  XENP024359 vhCDR3
LATWDWYFDV

SEQ ID NO: 27062 - protein, 454 aa, Artificial Sequence; identical to SEQ ID NO: 26942
  Description of Artificial Sequence: Synthetic polypeptide
  XENP024359 7G8_H3.30_L1.34_Fab-[anti-ICOS]_H0L0_Fab Heavy Chain 2

SEQ ID NO: 27063 - protein, 125 aa, Artificial Sequence; identical to SEQ ID NO: 26293
  Description of Artificial Sequence: Synthetic polypeptide
  VH of XENP024359

SEQ ID NO: 27064 - protein, 5 aa, Artificial Sequence
  Description of Artificial Sequence: Synthetic peptide
  XENP024359 vhCDR1
GYYMH

SEQ ID NO: 27065 - protein, 17 aa, Artificial Sequence
  Description of Artificial Sequence: Synthetic peptide
  XENP024359 vhCDR2
WINPHSGGTNYAQKFQG

SEQ ID NO: 27066 - protein, 16 aa, Artificial Sequence
  Description of Artificial Sequence: Synthetic peptide
  XENP024359 vhCDR3
TYYYDSSGYYHDAFDI

SEQ ID NO: 27067 - protein, 218 aa, Artificial Sequence; identical to SEQ ID NO: 2420
  Description of Artificial Sequence: Synthetic polypeptide
  XENP024359 7G8_H3.30_L1.34_Fab-[anti-ICOS]_H0L0_Fab Light Chain 1

SEQ ID NO: 27068 - protein, 111 aa, Artificial Sequence; identical to SEQ ID NO: 2421
  Description of Artificial Sequence: Synthetic polypeptide
  VL of XENP024359

SEQ ID NO: 27069 - protein, 15 aa, Artificial Sequence
  Description of Artificial Sequence: Synthetic peptide
  XENP024359 vlCDR1
RASQSVDYDGDSYMN

SEQ ID NO: 27070 - protein, 7 aa, Artificial Sequence
  Description of Artificial Sequence: Synthetic peptide
  XENP024359 vlCDR2
AASELES

SEQ ID NO: 27071 - protein, 9 aa, Artificial Sequence
  Description of Artificial Sequence: Synthetic peptide
  XENP024359 vlCDR3
QQSNEDPFT

SEQ ID NO: 27072 - protein, 214 aa, Artificial Sequence; identical to SEQ ID NO: 26297
  Description of Artificial Sequence: Synthetic polypeptide
  XENP024359 7G8_H3.30_L1.34_Fab-[anti-ICOS]_H0L0_Fab Light Chain 2

SEQ ID NO: 27073 - protein, 107 aa, Artificial Sequence; identical to SEQ ID NO: 26298
  Description of Artificial Sequence: Synthetic polypeptide
  VL of XENP024359

SEQ ID NO: 27074 - protein, 11 aa, Artificial Sequence
  Description of Artificial Sequence: Synthetic peptide
  XENP024359 vlCDR1
RASQGISRLLA

SEQ ID NO: 27075 - protein, 7 aa, Artificial Sequence
  Description of Artificial Sequence: Synthetic peptide
  XENP024359 vlCDR2
VASSLQS

SEQ ID NO: 27076 - protein, 9 aa, Artificial Sequence
  Description of Artificial Sequence: Synthetic peptide
  XENP024359 vlCDR3
QQANSFPWT

SEQ ID NO: 27077 - protein, 447 aa, Artificial Sequence; identical to SEQ ID NO: 2865
  Description of Artificial Sequence: Synthetic polypeptide
  XENP024360 2A11_H1.144_L2.142_Fab-[anti-ICOS]_H0L0_Fab Heavy Chain 1

SEQ ID NO: 27078 - protein, 118 aa, Artificial Sequence; identical to SEQ ID NO: 2646
  Description of Artificial Sequence: Synthetic polypeptide
  VH of XENP024360

SEQ ID NO: 27079 - protein, 5 aa, Artificial Sequence
  Description of Artificial Sequence: Synthetic peptide
  XENP024360 vhCDR1
DYFMH

SEQ ID NO: 27080 - protein, 17 aa, Artificial Sequence
  Description of Artificial Sequence: Synthetic peptide
  XENP024360 vhCDR2
WIDPELGDTEYAPKFQG

SEQ ID NO: 27081 - protein, 9 aa, Artificial Sequence
  Description of Artificial Sequence: Synthetic peptide
  XENP024360 vhCDR3
RGVYQALDY

SEQ ID NO: 27082 - protein, 454 aa, Artificial Sequence; identical to SEQ ID NO: 26942
  Description of Artificial Sequence: Synthetic polypeptide
  XENP024360 2A11_H1.144_L2.142_Fab-[anti-ICOS]_H0L0_Fab Heavy Chain 2

SEQ ID NO: 27083 - protein, 125 aa, Artificial Sequence; identical to SEQ ID NO: 26293
  Description of Artificial Sequence: Synthetic polypeptide
  VH of XENP024360

SEQ ID NO: 27084 - protein, 5 aa, Artificial Sequence
  Description of Artificial Sequence: Synthetic peptide
  XENP024360 vhCDR1
GYYMH

SEQ ID NO: 27085 - protein, 17 aa, Artificial Sequence
  Description of Artificial Sequence: Synthetic peptide
  XENP024360 vhCDR2
WINPHSGGTNYAQKFQG

SEQ ID NO: 27086 - protein, 16 aa, Artificial Sequence
  Description of Artificial Sequence: Synthetic peptide
  XENP024360 vhCDR3
TYYYDSSGYYHDAFDI

SEQ ID NO: 27087 - protein, 214 aa, Artificial Sequence; identical to SEQ ID NO: 2660
  Description of Artificial Sequence: Synthetic polypeptide
  XENP024360 2A11_H1.144_L2.142_Fab-[anti-ICOS]_H0L0_Fab Light Chain 1

SEQ ID NO: 27088 - protein, 107 aa, Artificial Sequence; identical to SEQ ID NO: 2661
  Description of Artificial Sequence: Synthetic polypeptide
  VL of XENP024360

SEQ ID NO: 27089 - protein, 11 aa, Artificial Sequence
  Description of Artificial Sequence: Synthetic peptide
  XENP024360 vlCDR1
QASQDIGNYLN

SEQ ID NO: 27090 - protein, 7 aa, Artificial Sequence
  Description of Artificial Sequence: Synthetic peptide
  XENP024360 vlCDR2
FTSYLHS

SEQ ID NO: 27091 - protein, 9 aa, Artificial Sequence
  Description of Artificial Sequence: Synthetic peptide
  XENP024360 vlCDR3
QQGNTLPYT

SEQ ID NO: 27092 - protein, 214 aa, Artificial Sequence; identical to SEQ ID NO: 26297
  Description of Artificial Sequence: Synthetic polypeptide
  XENP024360 2A11_H1.144_L2.142_Fab-[anti-ICOS]_H0L0_Fab Light Chain 2

SEQ ID NO: 27093 - protein, 107 aa, Artificial Sequence; identical to SEQ ID NO: 26298
  Description of Artificial Sequence: Synthetic polypeptide
  VL of XENP024360

SEQ ID NO: 27094 - protein, 11 aa, Artificial Sequence
  Description of Artificial Sequence: Synthetic peptide
  XENP024360 vlCDR1
RASQGISRLLA

SEQ ID NO: 27095 - protein, 7 aa, Artificial Sequence
  Description of Artificial Sequence: Synthetic peptide
  XENP024360 vlCDR2
VASSLQS

SEQ ID NO: 27096 - protein, 9 aa, Artificial Sequence
  Description of Artificial Sequence: Synthetic peptide
  XENP024360 vlCDR3
QQANSFPWT

SEQ ID NO: 27097 - protein, 446 aa, Artificial Sequence
  Description of Artificial Sequence: Synthetic polypeptide
  XENP024361 3H3_H1_L2.1_Fab-[anti-ICOS]_H0L0_Fab Heavy Chain 1
QVTLKESGPVLVKPTETLTLTCTVSGFSLNGYGVNWVRQPPGKGLEWLAMIWGDGSTDYNSALKSRLTISKDNSKSQVVLTMTNMDPVDTATYYCARSYYTSDEDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 27098 - protein, 117 aa, Artificial Sequence; identical to SEQ ID NO: 3366
  Description of Artificial Sequence: Synthetic polypeptide
  VH of XENP024361

SEQ ID NO: 27099 - protein, 5 aa, Artificial Sequence
  Description of Artificial Sequence: Synthetic peptide
  XENP024361 vhCDR1
GYGVN

SEQ ID NO: 27100 - protein, 16 aa, Artificial Sequence
  Description of Artificial Sequence: Synthetic peptide
  XENP024361 vhCDR2
MIWGDGSTDYNSALKS

SEQ ID NO: 27101 - protein, 9 aa, Artificial Sequence
  Description of Artificial Sequence: Synthetic peptide
  XENP024361 vhCDR3
SYYTSDEDY

SEQ ID NO: 27102 - protein, 454 aa, Artificial Sequence; identical to SEQ ID NO: 26942
  Description of Artificial Sequence: Synthetic polypeptide
  XENP024361 3H3_H1_L2.1_Fab-[anti-ICOS]_H0L0_Fab Heavy Chain 2

SEQ ID NO: 27103 - protein, 125 aa, Artificial Sequence; identical to SEQ ID NO: 26293
  Description of Artificial Sequence: Synthetic polypeptide
  VH of XENP024361

SEQ ID NO: 27104 - protein, 5 aa, Artificial Sequence
  Description of Artificial Sequence: Synthetic peptide
  XENP024361 vhCDR1
GYYMH

SEQ ID NO: 27105 - protein, 17 aa, Artificial Sequence
  Description of Artificial Sequence: Synthetic peptide
  XENP024361 vhCDR2
WINPHSGGTNYAQKFQG

SEQ ID NO: 27106 - protein, 16 aa, Artificial Sequence
  Description of Artificial Sequence: Synthetic peptide
  XENP024361 vhCDR3
TYYYDSSGYYHDAFDI

SEQ ID NO: 27107 - protein, 219 aa, Artificial Sequence; identical to SEQ ID NO: 3510
  Description of Artificial Sequence: Synthetic polypeptide
  XENP024361 3H3_H1_L2.1_Fab-[anti-ICOS]_H0L0_Fab Light Chain 1

SEQ ID NO: 27108 - protein, 112 aa, Artificial Sequence; identical to SEQ ID NO: 3511
  Description of Artificial Sequence: Synthetic polypeptide
  VL of XENP024361

SEQ ID NO: 27109 - protein, 17 aa, Artificial Sequence
  Description of Artificial Sequence: Synthetic peptide
  XENP024361 vlCDR1
KSSQSLLNSRTRKNYLA

SEQ ID NO: 27110 - protein, 7 aa, Artificial Sequence
  Description of Artificial Sequence: Synthetic peptide
  XENP024361 vlCDR2
WASTRES

SEQ ID NO: 27111 - protein, 8 aa, Artificial Sequence
  Description of Artificial Sequence: Synthetic peptide
  XENP024361 vlCDR3
KQSYSLRT

SEQ ID NO: 27112 - protein, 214 aa, Artificial Sequence; identical to SEQ ID NO: 26297
  Description of Artificial Sequence: Synthetic polypeptide
  XENP024361 3H3_H1_L2.1_Fab-[anti-ICOS]_H0L0_Fab Light Chain 2

SEQ ID NO: 27113 - protein, 107 aa, Artificial Sequence; identical to SEQ ID NO: 26298
  Description of Artificial Sequence: Synthetic polypeptide
  VL of XENP024361

SEQ ID NO: 27114 - protein, 11 aa, Artificial Sequence
  Description of Artificial Sequence: Synthetic peptide
  XENP024361 vlCDR1
RASQGISRLLA

SEQ ID NO: 27115 - protein, 7 aa, Artificial Sequence
  Description of Artificial Sequence: Synthetic peptide
  XENP024361 vlCDR2
VASSLQS

SEQ ID NO: 27116 - protein, 9 aa, Artificial Sequence
  Description of Artificial Sequence: Synthetic peptide
  XENP024361 vlCDR3
QQANSFPWT

SEQ ID NO: 27117 - protein, 447 aa, Artificial Sequence
  Description of Artificial Sequence: Synthetic polypeptide
  XENP021748 YW243.55.S70[PD-L1]_H0L0_Fab-[anti-ICOS]_H0L0 _scFv Fab-Fc Heavy Chain
EVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 27118 - protein, 118 aa, Artificial Sequence [sequence omitted]

SEQ ID NO: 27119 - protein, 5 aa, Artificial Sequence
  Description of Artificial Sequence: Synthetic peptide
  XENP021748 vhCDR1
DSWIH

SEQ ID NO: 27120 - protein, 17 aa, Artificial Sequence
  Description of Artificial Sequence: Synthetic peptide
  XENP021748 vhCDR2
WISPYGGSTYYADSVKG

SEQ ID NO: 27121 - protein, 9 aa, Artificial Sequence
  Description of Artificial Sequence: Synthetic peptide
  XENP021748 vhCDR3
RHWPGGFDY

SEQ ID NO: 27122 - protein, 483 aa, Artificial Sequence; identical to SEQ ID NO: 26827
  Description of Artificial Sequence: Synthetic polypeptide
  XENP021748 YW243.55.S70[PD-L1]_H0L0_Fab-[anti-ICOS]_H0L0 _scFv scFv-Fc Heavy Chain

SEQ ID NO: 27123 - protein, 125 aa, Artificial Sequence; identical to SEQ ID NO: 26293
  Description of Artificial Sequence: Synthetic polypeptide
  VH of XENP021748

SEQ ID NO: 27124 - protein, 107 aa, Artificial Sequence; identical to SEQ ID NO: 26298
  Description of Artificial Sequence: Synthetic polypeptide
  VL of XENP021748

SEQ ID NO: 27125 - protein, 231 aa, Artificial Sequence; identical to SEQ ID NO: 2397
  Description of Artificial Sequence: Synthetic polypeptide
  Fc chain of XENP021748

SEQ ID NO: 27126 - protein, 5 aa, Artificial Sequence
  Description of Artificial Sequence: Synthetic peptide
  XENP021748 vhCDR1
GYYMH

SEQ ID NO: 27127 - protein, 17 aa, Artificial Sequence
  Description of Artificial Sequence: Synthetic peptide
  XENP021748 vhCDR2
WINPHSGGTNYAQKFQG

SEQ ID NO: 27128 - protein, 16 aa, Artificial Sequence
  Description of Artificial Sequence: Synthetic peptide
  XENP021748 vhCDR3
TYYYDSSGYYHDAFDI

SEQ ID NO: 27129 - protein, 11 aa, Artificial Sequence
  Description of Artificial Sequence: Synthetic peptide
  XENP021748 vlCDR1
RASQGISRLLA

SEQ ID NO: 27130 - protein, 7 aa, Artificial Sequence
  Description of Artificial Sequence: Synthetic peptide
  XENP021748 vlCDR2
VASSLQS

SEQ ID NO: 27131 - protein, 9 aa, Artificial Sequence
  Description of Artificial Sequence: Synthetic peptide
  XENP021748 vlCDR3
QQANSFPWT

SEQ ID NO: 27132 - protein, 214 aa, Artificial Sequence
  Description of Artificial Sequence: Synthetic polypeptide
  XENP021748 YW243.55.S70[PD-L1]_H0L0_Fab-[anti-ICOS]_H0L0 _scFv Light Chain
DIQMTQSPSSLSASVGDRVTITCRASQDVSTAVAWYQQKPGKAPKLLIYSASFLYSGVPSRFSGSGSGTDFTLTISSLQPEDFATYYCQQYLYHPATFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 27133 - protein, 107 aa, Artificial Sequence [sequence omitted]

SEQ ID NO: 27134 - protein, 11 aa, Artificial Sequence
  Description of Artificial Sequence: Synthetic peptide
  XENP021748 vlCDR1
RASQDVSTAVA

SEQ ID NO: 27135 - protein, 7 aa, Artificial Sequence
  Description of Artificial Sequence: Synthetic peptide
  XENP021748 vlCDR2
SASFLYS

SEQ ID NO: 27136 - protein, 9 aa, Artificial Sequence
  Description of Artificial Sequence: Synthetic peptide
  XENP021748 vlCDR3
QQYLYHPAT

SEQ ID NO: 27137 - protein, 450 aa, Artificial Sequence
  Description of Artificial Sequence: Synthetic polypeptide
  XENP024129 durvalumab[PD-L1]_H1L1_Fab-[anti-ICOS]_H0L0 _scFv Fab-Fc Heavy Chain
EVQLVESGGGLVQPGGSLRLSCAASGFTFSRYWMSWVRQAPGKGLEWVANIKQDGSEKYYVDSVKGRFTISRDNAKNSLYLQMNSLRAEDTAVYYCAREGGWFGELAFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 27138 - protein, 121 aa, Artificial Sequence; identical to SEQ ID NO: 3961
  Description of Artificial Sequence: Synthetic polypeptide
  VH of XENP024129

SEQ ID NO: 27139 - protein, 5 aa, Artificial Sequence
  Description of Artificial Sequence: Synthetic peptide
  XENP024129 vhCDR1
RYWMS

SEQ ID NO: 27140 - protein, 17 aa, Artificial Sequence
  Description of Artificial Sequence: Synthetic peptide
  XENP024129 vhCDR2
NIKQDGSEKYYVDSVKG

SEQ ID NO: 27141 - protein, 12 aa, Artificial Sequence
  Description of Artificial Sequence: Synthetic peptide
  XENP024129 vhCDR3
EGGWFGELAFDY

SEQ ID NO: 27142 - protein, 483 aa, Artificial Sequence; identical to SEQ ID NO: 26827
  Description of Artificial Sequence: Synthetic polypeptide
  XENP024129 durvalumab[PD-L1]_H1L1_Fab-[anti-ICOS]_H0L0 _scFv scFv-Fc Heavy Chain

SEQ ID NO: 27143 - protein, 125 aa, Artificial Sequence; identical to SEQ ID NO: 26293
  Description of Artificial Sequence: Synthetic polypeptide
  VH of XENP024129

SEQ ID NO: 27144 - protein, 107 aa, Artificial Sequence; identical to SEQ ID NO: 26298
  Description of Artificial Sequence: Synthetic polypeptide
  VL of XENP024129

SEQ ID NO: 27145 - protein, 231 aa, Artificial Sequence; identical to SEQ ID NO: 2397
  Description of Artificial Sequence: Synthetic polypeptide
  Fc chain of XENP024129

SEQ ID NO: 27146 - protein, 5 aa, Artificial Sequence
  Description of Artificial Sequence: Synthetic peptide
  XENP024129 vhCDR1
GYYMH

SEQ ID NO: 27147 - protein, 17 aa, Artificial Sequence
  Description of Artificial Sequence: Synthetic peptide
  XENP024129 vhCDR2
WINPHSGGTNYAQKFQG

SEQ ID NO: 27148 - protein, 16 aa, Artificial Sequence
  Description of Artificial Sequence: Synthetic peptide
  XENP024129 vhCDR3
TYYYDSSGYYHDAFDI

SEQ ID NO: 27149 - protein, 11 aa, Artificial Sequence
  Description of Artificial Sequence: Synthetic peptide
  XENP024129 vlCDR1
RASQGISRLLA

SEQ ID NO: 27150 - protein, 7 aa, Artificial Sequence
  Description of Artificial Sequence: Synthetic peptide
  XENP024129 vlCDR2
VASSLQS

SEQ ID NO: 27151 - protein, 9 aa, Artificial Sequence
  Description of Artificial Sequence: Synthetic peptide
  XENP024129 vlCDR3
QQANSFPWT

SEQ ID NO: 27152 - protein, 215 aa, Artificial Sequence
  Description of Artificial Sequence: Synthetic polypeptide
  XENP024129 durvalumab[PD-L1]_H1L1_Fab-[anti-ICOS]_H0L0 _scFv Light Chain
EIVLTQSPGTLSLSPGERATLSCRASQRVSSSYLAWYQQKPGQAPRLLIYDASSRATGIPDRFSGSGSGTDFTLTISRLEPEDFAVYYCQQYGSLPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 27153 - protein, 108 aa, Artificial Sequence; identical to SEQ ID NO: 3965
  Description of Artificial Sequence: Synthetic polypeptide
  VL of XENP024129

SEQ ID NO: 27154 - protein, 12 aa, Artificial Sequence
  Description of Artificial Sequence: Synthetic peptide
  XENP024129 vlCDR1
RASQRVSSSYLA

SEQ ID NO: 27155 - protein, 7 aa, Artificial Sequence
  Description of Artificial Sequence: Synthetic peptide
  XENP024129 vlCDR2
DASSRAT

SEQ ID NO: 27156 - protein, 9 aa, Artificial Sequence
  Description of Artificial Sequence: Synthetic peptide
  XENP024129 vlCDR3
QQYGSLPWT

SEQ ID NO: 27157 - protein, 449 aa, Artificial Sequence
  Description of Artificial Sequence: Synthetic polypeptide
  XENP024131 avelumab[PD-L1]_H1L1_Fab-[anti-ICOS]_H0L0 _scFv Fab-Fc Heavy Chain
EVQLLESGGGLVQPGGSLRLSCAASGFTFSSYIMMWVRQAPGKGLEWVSSIYPSGGITFYADTVKGRFTISRDNSKNTLYLQMNSLRAEDTAVYYCARIKLGTVTTVDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 27158 - protein, 120 aa, Artificial Sequence; identical to SEQ ID NO: 3977
  Description of Artificial Sequence: Synthetic polypeptide
  VH of XENP024131

SEQ ID NO: 27159 - protein, 5 aa, Artificial Sequence
  Description of Artificial Sequence: Synthetic peptide
  XENP024131 vhCDR1
SYIMM

SEQ ID NO: 27160 - protein, 17 aa, Artificial Sequence
  Description of Artificial Sequence: Synthetic peptide
  XENP024131 vhCDR2
SIYPSGGITFYADTVKG

SEQ ID NO: 27161 - protein, 11 aa, Artificial Sequence
  Description of Artificial Sequence: Synthetic peptide
  XENP024131 vhCDR3
IKLGTVTTVDY

SEQ ID NO: 27162 - protein, 483 aa, Artificial Sequence; identical to SEQ ID NO: 26827
  Description of Artificial Sequence: Synthetic polypeptide
  XENP024131 avelumab[PD-L1]_H1L1_Fab-[anti-ICOS]_H0L0 _scFv scFv-Fc Heavy Chain

SEQ ID NO: 27163 - protein, 125 aa, Artificial Sequence; identical to SEQ ID NO: 26293
  Description of Artificial Sequence: Synthetic polypeptide
  VH of XENP024131

SEQ ID NO: 27164 - protein, 107 aa, Artificial Sequence; identical to SEQ ID NO: 26298
  Description of Artificial Sequence: Synthetic polypeptide
  VL of XENP024131

SEQ ID NO: 27165 - protein, 231 aa, Artificial Sequence; identical to SEQ ID NO: 2397
  Description of Artificial Sequence: Synthetic polypeptide
  Fc chain of XENP024131

SEQ ID NO: 27166 - protein, 5 aa, Artificial Sequence
  Description of Artificial Sequence: Synthetic peptide
  XENP024131 vhCDR1
GYYMH

SEQ ID NO: 27167 - protein, 17 aa, Artificial Sequence
  Description of Artificial Sequence: Synthetic peptide
  XENP024131 vhCDR2
WINPHSGGTNYAQKFQG

SEQ ID NO: 27168 - protein, 16 aa, Artificial Sequence
  Description of Artificial Sequence: Synthetic peptide
  XENP024131 vhCDR3
TYYYDSSGYYHDAFDI

SEQ ID NO: 27169 - protein, 11 aa, Artificial Sequence
  Description of Artificial Sequence: Synthetic peptide
  XENP024131 vlCDR1
RASQGISRLLA

SEQ ID NO: 27170 - protein, 7 aa, Artificial Sequence
  Description of Artificial Sequence: Synthetic peptide
  XENP024131 vlCDR2
VASSLQS

SEQ ID NO: 27171 - protein, 9 aa, Artificial Sequence
  Description of Artificial Sequence: Synthetic peptide
  XENP024131 vlCDR3
QQANSFPWT

SEQ ID NO: 27172 - protein, 216 aa, Artificial Sequence
  Description of Artificial Sequence: Synthetic polypeptide
  XENP024131 avelumab[PD-L1]_H1L1_Fab-[anti-ICOS]_H0L0 _scFv Light Chain
QSALTQPASVSGSPGQSITISCTGTSSDVGGYNYVSWYQQHPGKAPKLMIYDVSNRPSGVSNRFSGSKSGNTASLTISGLQAEDEADYYCSSYTSSSTRVFGTGTKVTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 27173 - protein, 110 aa, Artificial Sequence; identical to SEQ ID NO: 3981
  Description of Artificial Sequence: Synthetic polypeptide
  VL of XENP024131

SEQ ID NO: 27174 - protein, 14 aa, Artificial Sequence
  Description of Artificial Sequence: Synthetic peptide
  XENP024131 vlCDR1
TGTSSDVGGYNYVS

SEQ ID NO: 27175 - protein, 7 aa, Artificial Sequence
  Description of Artificial Sequence: Synthetic peptide
  XENP024131 vlCDR2
DVSNRPS

SEQ ID NO: 27176 - protein, 10 aa, Artificial Sequence
  Description of Artificial Sequence: Synthetic peptide
  XENP024131 vlCDR3
SSYTSSSTRV

SEQ ID NO: 27177 - protein, 721 aa, Artificial Sequence
  Description of Artificial Sequence: Synthetic polypeptide
  XENP024124 durvalumab[PD-L1]_H1L1_Fab_(G4S)2_[anti-ICOS]_H0L0 _scFv20_Fc_IgG1 Heavy Chain
EVQLVESGGGLVQPGGSLRLSCAASGFTFSRYWMSWVRQAPGKGLEWVANIKQDGSEKYYVDSVKGRFTISRDNAKNSLYLQMNSLRAEDTAVYYCAREGGWFGELAFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGGGGSGGGGSQVQLVQSGAEVKKPGASVKVSCKASGYTFTGYYMHWVRQAPGQGLEWMGWINPHSGGTNYAQKFQGRVTMTRDTSISTAYMELSRLRSDDTAVYYCARTYYYDSSGYYHDAFDIWGQGTMVTVSSGGGGSGGGGSGGGGSGGGGSDIQMTQSPSSVSASVGDRVTITCRASQGISRLLAWYQQKPGKAPKLLIYVASSLQSGVPSRFSGSGSGTDFTLTISSLQPEDFATYYCQQANSFPWTFGQGTKVEIKGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 27178 - protein, 121 aa, Artificial Sequence; identical to SEQ ID NO: 3961
  Description of Artificial Sequence: Synthetic polypeptide
  VH of XENP024124

SEQ ID NO: 27179 - protein, 113 aa, Artificial Sequence; identical to SEQ ID NO: 26907
  Description of Artificial Sequence: Synthetic polypeptide
  Fc chain of XENP024124

SEQ ID NO: 27180 - protein, 125 aa, Artificial Sequence; identical to SEQ ID NO: 26293
  Description of Artificial Sequence: Synthetic polypeptide
  VL of XENP024124

SEQ ID NO: 27181 - protein, 225 aa, Artificial Sequence; identical to SEQ ID NO: 26909
  Description of Artificial Sequence: Synthetic polypeptide
  Fc chain of XENP024124

SEQ ID NO: 27182 - protein, 5 aa, Artificial Sequence
  Description of Artificial Sequence: Synthetic peptide
  XENP024124 vhCDR1
RYWMS

SEQ ID NO: 27183 - protein, 17 aa, Artificial Sequence
  Description of Artificial Sequence: Synthetic peptide
  XENP024124 vhCDR2
NIKQDGSEKYYVDSVKG

SEQ ID NO: 27184 - protein, 12 aa, Artificial Sequence
  Description of Artificial Sequence: Synthetic peptide
  XENP024124 vhCDR3
EGGWFGELAFDY

SEQ ID NO: 27185 - protein, 5 aa, Artificial Sequence
  Description of Artificial Sequence: Synthetic peptide
  XENP024124 vlCDR1
GYYMH

SEQ ID NO: 27186 - protein, 17 aa, Artificial Sequence
  Description of Artificial Sequence: Synthetic peptide
  XENP024124 vlCDR2
WINPHSGGTNYAQKFQG

SEQ ID NO: 27187 - protein, 16 aa, Artificial Sequence
  Description of Artificial Sequence: Synthetic peptide
  XENP024124 vlCDR3
TYYYDSSGYYHDAFDI

SEQ ID NO: 27188 - protein, 215 aa, Artificial Sequence; identical to SEQ ID NO: 27152
  Description of Artificial Sequence: Synthetic polypeptide
  XENP024124 durvalumab[PD-L1]_H1L1_Fab_(G4S)2_[anti-ICOS]_H0L0 _scFv20_Fc_IgG1 Light Chain

SEQ ID NO: 27189 - protein, 108 aa, Artificial Sequence; identical to SEQ ID NO: 3965
  Description of Artificial Sequence: Synthetic polypeptide
  VL of XENP024124

SEQ ID NO: 27190 - protein, 12 aa, Artificial Sequence
  Description of Artificial Sequence: Synthetic peptide
  XENP024124 vlCDR1
RASQRVSSSYLA

SEQ ID NO: 27191 - protein, 7 aa, Artificial Sequence
  Description of Artificial Sequence: Synthetic peptide
  XENP024124 vlCDR2
DASSRAT

SEQ ID NO: 27192 - protein, 9 aa, Artificial Sequence
  Description of Artificial Sequence: Synthetic peptide
  XENP024124 vlCDR3
QQYGSLPWT

SEQ ID NO: 27193 - protein, 454 aa, Artificial Sequence; identical to SEQ ID NO: 26442
  Description of Artificial Sequence: Synthetic polypeptide
  XENP020266 [ICOS]_H0L0 one-arm mAb Fab-Fc Heavy Chain

SEQ ID NO: 27194 - protein, 125 aa, Artificial Sequence; identical to SEQ ID NO: 26293
  Description of Artificial Sequence: Synthetic polypeptide
  VH of XENP020266

SEQ ID NO: 27195 - protein, 5 aa, Artificial Sequence
  Description of Artificial Sequence: Synthetic peptide
  XENP020266 vhCDR1
GYYMH

SEQ ID NO: 27196 - protein, 17 aa, Artificial Sequence
  Description of Artificial Sequence: Synthetic peptide
  XENP020266 vhCDR2
WINPHSGGTNYAQKFQG

SEQ ID NO: 27197 - protein, 16 aa, Artificial Sequence
  Description of Artificial Sequence: Synthetic peptide
  XENP020266 vhCDR3
TYYYDSSGYYHDAFDI

SEQ ID NO: 27198 - protein, 231 aa, Artificial Sequence
  Description of Artificial Sequence: Synthetic polypeptide
  XENP020266 [ICOS]_H0L0 one-arm mAb Fc-only Heavy Chain
ERKSSDKTHTCPRCPAPPVAGPSVFLFPPKPKDTLMISRTPEVTCVVVDVKHEDPEVKFKWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 27199 - protein, 214 aa, Artificial Sequence; identical to SEQ ID NO: 26297
  Description of Artificial Sequence: Synthetic polypeptide
  XENP020266 [ICOS]_H0L0 one-arm mAb Light Chain

SEQ ID NO: 27200 - protein, 107 aa, Artificial Sequence; identical to SEQ ID NO: 26298
  Description of Artificial Sequence: Synthetic polypeptide
  VL of XENP020266

SEQ ID NO: 27201 - protein, 11 aa, Artificial Sequence
  Description of Artificial Sequence: Synthetic peptide
  XENP020266 vlCDR1
RASQGISRLLA

SEQ ID NO: 27202 - protein, 7 aa, Artificial Sequence
  Description of Artificial Sequence: Synthetic peptide
  XENP020266 vlCDR2
VASSLQS

SEQ ID NO: 27203 - protein, 9 aa, Artificial Sequence
  Description of Artificial Sequence: Synthetic peptide
  XENP020266 vlCDR3
QQANSFPWT

SEQ ID NO: 27204 - protein, 452 aa, Artificial Sequence; identical to SEQ ID NO: 26682
  Description of Artificial Sequence: Synthetic polypeptide
  XENP021861 GSK_314.8[ICOS]_H0L0 one-arm mAb Fab-Fc Heavy Chain

SEQ ID NO: 27205 - protein, 123 aa, Artificial Sequence; identical to SEQ ID NO: 26303
  Description of Artificial Sequence: Synthetic polypeptide
  VH of XENP021861

SEQ ID NO: 27206 - protein, 5 aa, Artificial Sequence
  Description of Artificial Sequence: Synthetic peptide
  XENP021861 vhCDR1
TYWMH

SEQ ID NO: 27207 - protein, 17 aa, Artificial Sequence
  Description of Artificial Sequence: Synthetic peptide
  XENP021861 vhCDR2
EIDPSDSYVNYNQNFKG

SEQ ID NO: 27208 - protein, 14 aa, Artificial Sequence
  Description of Artificial Sequence: Synthetic peptide
  XENP021861 vhCDR3
SPDYYGTSLAWFDY

SEQ ID NO: 27209 - protein, 231 aa, Artificial Sequence; identical to SEQ ID NO: 27198
  Description of Artificial Sequence: Synthetic polypeptide
  XENP021861 GSK_314.8[ICOS]_H0L0 one-arm mAb Fc-only Heavy Chain

SEQ ID NO: 27210 - protein, 219 aa, Artificial Sequence; identical to SEQ ID NO: 26307
  Description of Artificial Sequence: Synthetic polypeptide
  XENP021861 GSK_314.8[ICOS]_H0L0 one-arm mAb Light Chain

SEQ ID NO: 27211 - protein, 112 aa, Artificial Sequence; identical to SEQ ID NO: 26308
  Description of Artificial Sequence: Synthetic polypeptide
  VL of XENP021861

SEQ ID NO: 27212 - protein, 16 aa, Artificial Sequence
  Description of Artificial Sequence: Synthetic peptide
  XENP021861 vlCDR1
RSSKSPLHSNGNIYLY

SEQ ID NO: 27213 - protein, 7 aa, Artificial Sequence
  Description of Artificial Sequence: Synthetic peptide
  XENP021861 vlCDR2
RMSNLAS

SEQ ID NO: 27214 - protein, 9 aa, Artificial Sequence
  Description of Artificial Sequence: Synthetic peptide
  XENP021861 vlCDR3
MQHLEYPYT

SEQ ID NO: 27215 - protein, 454 aa, Artificial Sequence; identical to SEQ ID NO: 26722
  Description of Artificial Sequence: Synthetic polypeptide
  XENP021863 jMab-138[ICOS]_H0L0 one-arm mAb Fab-Fc Heavy Chain

SEQ ID NO: 27216 - protein, 125 aa, Artificial Sequence; identical to SEQ ID NO: 26323
  Description of Artificial Sequence: Synthetic polypeptide
  VH of XENP021863

SEQ ID NO: 27217 - protein, 5 aa, Artificial Sequence
  Description of Artificial Sequence: Synthetic peptide
  XENP021863 vhCDR1
SYDMH

SEQ ID NO: 27218 - protein, 16 aa, Artificial Sequence
  Description of Artificial Sequence: Synthetic peptide
  XENP021863 vhCDR2
AIGTAGDTYYPGSVKG

SEQ ID NO: 27219 - protein, 17 aa, Artificial Sequence
  Description of Artificial Sequence: Synthetic peptide
  XENP021863 vhCDR3
DNRKVTHEHYYYYGMDV

SEQ ID NO: 27220 - protein, 231 aa, Artificial Sequence; identical to SEQ ID NO: 27198
  Description of Artificial Sequence: Synthetic polypeptide
  XENP021863 jMab-138[ICOS]_H0L0 one-arm mAb Fc-only Heavy Chain

SEQ ID NO: 27221 - protein, 216 aa, Artificial Sequence; identical to SEQ ID NO: 26327
  Description of Artificial Sequence: Synthetic polypeptide
  XENP021863 jMab-138[ICOS]_H0L0 one-arm mAb Light Chain

SEQ ID NO: 27222 - protein, 109 aa, Artificial Sequence; identical to SEQ ID NO: 26328
  Description of Artificial Sequence: Synthetic polypeptide
  VL of XENP021863

SEQ ID NO: 27223 - protein, 12 aa, Artificial Sequence
  Description of Artificial Sequence: Synthetic peptide
  XENP021863 vlCDR1
RASQNIRSSYLA

SEQ ID NO: 27224 - protein, 7 aa, Artificial Sequence
  Description of Artificial Sequence: Synthetic peptide
  XENP021863 vlCDR2
GASSRAT

SEQ ID NO: 27225 - protein, 10 aa, Artificial Sequence
  Description of Artificial Sequence: Synthetic peptide
  XENP021863 vlCDR3
QQFGSSPMCS

SEQ ID NO: 27226 - protein, 450 aa, Artificial Sequence; identical to SEQ ID NO: 26762
  Description of Artificial Sequence: Synthetic polypeptide
  XENP022349 WO2016059602[ICOS]_GSK_H0L0 one-arm mAb Fab-Fc Heavy Chain

SEQ ID NO: 27227 - protein, 121 aa, Artificial Sequence; identical to SEQ ID NO: 26343
  Description of Artificial Sequence: Synthetic polypeptide
  VH of XENP022349

SEQ ID NO: 27228 - protein, 5 aa, Artificial Sequence
  Description of Artificial Sequence: Synthetic peptide
  XENP022349 vhCDR1
DYAMH

SEQ ID NO: 27229 - protein, 17 aa, Artificial Sequence
  Description of Artificial Sequence: Synthetic peptide
  XENP022349 vhCDR2
LISIYSDHTNYNQKFQG

SEQ ID NO: 27230 - protein, 12 aa, Artificial Sequence
  Description of Artificial Sequence: Synthetic peptide
  XENP022349 vhCDR3
NNYGNYGWYFDV

SEQ ID NO: 27231 - protein, 231 aa, Artificial Sequence; identical to SEQ ID NO: 27198
  Description of Artificial Sequence: Synthetic polypeptide
  XENP022349 WO2016059602[ICOS]_GSK_H0L0 one-arm mAb Fc-only Heavy Chain

SEQ ID NO: 27232 - protein, 213 aa, Artificial Sequence; identical to SEQ ID NO: 26347
  Description of Artificial Sequence: Synthetic polypeptide
  XENP022349 WO2016059602[ICOS]_GSK_H0L0 one-arm mAb Light Chain

SEQ ID NO: 27233 - protein, 106 aa, Artificial Sequence; identical to SEQ ID NO: 26348
  Description of Artificial Sequence: Synthetic polypeptide
  VL of XENP022349

SEQ ID NO: 27234 - protein, 10 aa, Artificial Sequence
  Description of Artificial Sequence: Synthetic peptide
  XENP022349 vlCDR1
SASSSVSYMH

SEQ ID NO: 27235 - protein, 7 aa, Artificial Sequence
  Description of Artificial Sequence: Synthetic peptide
  XENP022349 vlCDR2
DTSKLAS

SEQ ID NO: 27236 - protein, 9 aa, Artificial Sequence
  Description of Artificial Sequence: Synthetic peptide
  XENP022349 vlCDR3
FQGSGYPYT

SEQ ID NO: 27237 - protein, 454 aa, Artificial Sequence; identical to SEQ ID NO: 26442
  Description of Artificial Sequence: Synthetic polypeptide
  XENP022439 [ICOS]_H0_L0.5 one-arm mAb Fab-Fc Heavy Chain

SEQ ID NO: 27238 - protein, 125 aa, Artificial Sequence; identical to SEQ ID NO: 26293
  Description of Artificial Sequence: Synthetic polypeptide
  VH of XENP022439

SEQ ID NO: 27239 - protein, 5 aa, Artificial Sequence
  Description of Artificial Sequence: Synthetic peptide
  XENP022439 vhCDR1
GYYMH

SEQ ID NO: 27240 - protein, 17 aa, Artificial Sequence
  Description of Artificial Sequence: Synthetic peptide
  XENP022439 vhCDR2
WINPHSGGTNYAQKFQG

SEQ ID NO: 27241 - protein, 16 aa, Artificial Sequence
  Description of Artificial Sequence: Synthetic peptide
  XENP022439 vhCDR3
TYYYDSSGYYHDAFDI

SEQ ID NO: 27242 - protein, 231 aa, Artificial Sequence; identical to SEQ ID NO: 27198
  Description of Artificial Sequence: Synthetic polypeptide
  XENP022439 [ICOS]_H0_L0.5 one-arm mAb Fc-only Heavy Chain

SEQ ID NO: 27243 - protein, 214 aa, Artificial Sequence
  Description of Artificial Sequence: Synthetic polypeptide
  XENP022439 [ICOS]_H0_L0.5 one-arm mAb Light Chain
DIQMTQSPSSVSASVGDRVTITCRASQGISSLLAWYQQKPGKAPKLLIYVASSLQSGVPSRFSGSGSGTDFTLTISSLQPEDFATYYCQQANSFPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 27244 - protein, 107 aa, Artificial Sequence
  Description of Artificial Sequence: Synthetic polypeptide
  VL of XENP022439
DIQMTQSPSSVSASVGDRVTITCRASQGISSLLAWYQQKPGKAPKLLIYVASSLQSGVPSRFSGSGSGTDFTLTISSLQPEDFATYYCQQANSFPWTFGQGTKVEIK

SEQ ID NO: 27245 - protein, 11 aa, Artificial Sequence
  Description of Artificial Sequence: Synthetic peptide
  XENP022439 vlCDR1
RASQGISSLLA

SEQ ID NO: 27246 - protein, 7 aa, Artificial Sequence
  Description of Artificial Sequence: Synthetic peptide
  XENP022439 vlCDR2
VASSLQS

SEQ ID NO: 27247 - protein, 9 aa, Artificial Sequence
  Description of Artificial Sequence: Synthetic peptide
  XENP022439 vlCDR3
QQANSFPWT

SEQ ID NO: 27248 - protein, 454 aa, Artificial Sequence; identical to SEQ ID NO: 26442
  Description of Artificial Sequence: Synthetic polypeptide
  XENP022440 [ICOS]_H0_L0.7 one-arm mAb Fab-Fc Heavy Chain

SEQ ID NO: 27249 - protein, 125 aa, Artificial Sequence; identical to SEQ ID NO: 26293
  Description of Artificial Sequence: Synthetic polypeptide
  VH of XENP022440

SEQ ID NO: 27250 - protein, 5 aa, Artificial Sequence
  Description of Artificial Sequence: Synthetic peptide
  XENP022440 vhCDR1
GYYMH

SEQ ID NO: 27251 - protein, 17 aa, Artificial Sequence
  Description of Artificial Sequence: Synthetic peptide
  XENP022440 vhCDR2
WINPHSGGTNYAQKFQG

SEQ ID NO: 27252 - protein, 16 aa, Artificial Sequence
  Description of Artificial Sequence: Synthetic peptide
  XENP022440 vhCDR3
TYYYDSSGYYHDAFDI

SEQ ID NO: 27253 - protein, 231 aa, Artificial Sequence; identical to SEQ ID NO: 27198
  Description of Artificial Sequence: Synthetic polypeptide
  XENP022440 [ICOS]_H0_L0.7 one-arm mAb Fc-only Heavy Chain

SEQ ID NO: 27254 - protein, 214 aa, Artificial Sequence; identical to SEQ ID NO: 26477
  Description of Artificial Sequence: Synthetic polypeptide
  XENP022440 [ICOS]_H0_L0.7 one-arm mAb Light Chain

SEQ ID NO: 27255 - protein, 107 aa, Artificial Sequence; identical to SEQ ID NO: 26478
  Description of Artificial Sequence: Synthetic polypeptide
  VL of XENP022440

SEQ ID NO: 27256 - protein, 11 aa, Artificial Sequence
  Description of Artificial Sequence: Synthetic peptide
  XENP022440 vlCDR1
RASQGISSYLA

SEQ ID NO: 27257 - protein, 7 aa, Artificial Sequence
  Description of Artificial Sequence: Synthetic peptide
  XENP022440 vlCDR2
VASSLQS

SEQ ID NO: 27258 - protein, 9 aa, Artificial Sequence
  Description of Artificial Sequence: Synthetic peptide
  XENP022440 vlCDR3
QQANSFPWT

SEQ ID NO: 27259 - protein, 454 aa, Artificial Sequence; identical to SEQ ID NO: 26442
  Description of Artificial Sequence: Synthetic polypeptide
  XENP022441 [ICOS]_H0_L0.9 one-arm mAb Fab-Fc Heavy Chain

SEQ ID NO: 27260 - protein, 125 aa, Artificial Sequence; identical to SEQ ID NO: 26293
  Description of Artificial Sequence: Synthetic polypeptide
  VH of XENP022441

SEQ ID NO: 27261 - protein, 5 aa, Artificial Sequence
  Description of Artificial Sequence: Synthetic peptide
  XENP022441 vhCDR1
GYYMH

SEQ ID NO: 27262 - protein, 17 aa, Artificial Sequence
  Description of Artificial Sequence: Synthetic peptide
  XENP022441 vhCDR2
WINPHSGGTNYAQKFQG

SEQ ID NO: 27263 - protein, 16 aa, Artificial Sequence
  Description of Artificial Sequence: Synthetic peptide
  XENP022441 vhCDR3
TYYYDSSGYYHDAFDI

SEQ ID NO: 27264 - protein, 231 aa, Artificial Sequence; identical to SEQ ID NO: 27198
  Description of Artificial Sequence: Synthetic polypeptide
  XENP022441 [ICOS]_H0_L0.9 one-arm mAb Fc-only Heavy Chain

SEQ ID NO: 27265 - protein, 214 aa, Artificial Sequence
  Description of Artificial Sequence: Synthetic polypeptide
  XENP022441 [ICOS]_H0_L0.9 one-arm mAb Light Chain
DIQMTQSPSSVSASVGDRVTITCRASQGISRYLAWYQQKPGKAPKLLIYVASSLQSGVPSRFSGSGSGTDFTLTISSLQPEDFATYYCQQANSFPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 27266 - protein, 107 aa, Artificial Sequence
  Description of Artificial Sequence: Synthetic polypeptide
  VL of XENP022441
DIQMTQSPSSVSASVGDRVTITCRASQGISRYLAWYQQKPGKAPKLLIYVASSLQSGVPSRFSGSGSGTDFTLTISSLQPEDFATYYCQQANSFPWTFGQGTKVEIK

SEQ ID NO: 27267 - protein, 11 aa, Artificial Sequence
  Description of Artificial Sequence: Synthetic peptide
  XENP022441 vlCDR1
RASQGISRYLA

SEQ ID NO: 27268 - protein, 7 aa, Artificial Sequence
  Description of Artificial Sequence: Synthetic peptide
  XENP022441 vlCDR2
VASSLQS

SEQ ID NO: 27269 - protein, 9 aa, Artificial Sequence
  Description of Artificial Sequence: Synthetic peptide
  XENP022441 vlCDR3
QQANSFPWT

SEQ ID NO: 27270 - protein, 454 aa, Artificial Sequence; identical to SEQ ID NO: 26442
  Description of Artificial Sequence: Synthetic polypeptide
  XENP022442 [ICOS]_H0_L0.10 one-arm mAb Fab-Fc Heavy Chain

SEQ ID NO: 27271 - protein, 125 aa, Artificial Sequence; identical to SEQ ID NO: 26293
  Description of Artificial Sequence: Synthetic polypeptide
  VH of XENP022442

SEQ ID NO: 27272 - protein, 5 aa, Artificial Sequence
  Description of Artificial Sequence: Synthetic peptide
  XENP022442 vhCDR1
GYYMH

SEQ ID NO: 27273 - protein, 17 aa, Artificial Sequence
  Description of Artificial Sequence: Synthetic peptide
  XENP022442 vhCDR2
WINPHSGGTNYAQKFQG

SEQ ID NO: 27274 - protein, 16 aa, Artificial Sequence
  Description of Artificial Sequence: Synthetic peptide
  XENP022442 vhCDR3
TYYYDSSGYYHDAFDI

SEQ ID NO: 27275 - protein, 231 aa, Artificial Sequence; identical to SEQ ID NO: 27198
  Description of Artificial Sequence: Synthetic polypeptide
  XENP022442 [ICOS]_H0_L0.10 one-arm mAb Fc-only Heavy Chain

SEQ ID NO: 27276 - protein, 214 aa, Artificial Sequence
  Description of Artificial Sequence: Synthetic polypeptide
  XENP022442 [ICOS]_H0_L0.10 one-arm mAb Light Chain
DIQMTQSPSSVSASVGDRVTITCRASQGISRLLAWYQQKPGKAPKLLIYAASSLQSGVPSRFSGSGSGTDFTLTISSLQPEDFATYYCQQANSFPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 27277 - protein, 107 aa, Artificial Sequence
  Description of Artificial Sequence: Synthetic polypeptide
  VL of XENP022442
DIQMTQSPSSVSASVGDRVTITCRASQGISRLLAWYQQKPGKAPKLLIYAASSLQSGVPSRFSGSGSGTDFTLTISSLQPEDFATYYCQQANSFPWTFGQGTKVEIK

SEQ ID NO: 27278 - protein, 11 aa, Artificial Sequence
  Description of Artificial Sequence: Synthetic peptide
  XENP022442 vlCDR1
RASQGISRLLA

SEQ ID NO: 27279 - protein, 7 aa, Artificial Sequence
  Description of Artificial Sequence: Synthetic peptide
  XENP022442 vlCDR2
AASSLQS

SEQ ID NO: 27280 - protein, 9 aa, Artificial Sequence
  Description of Artificial Sequence: Synthetic peptide
  XENP022442 vlCDR3
QQANSFPWT

SEQ ID NO: 27281 - protein, 454 aa, Artificial Sequence; identical to SEQ ID NO: 26442
  Description of Artificial Sequence: Synthetic polypeptide
  XENP022443 [ICOS]_H0_L0.14 one-arm mAb Fab-Fc Heavy Chain

SEQ ID NO: 27282 - protein, 125 aa, Artificial Sequence; identical to SEQ ID NO: 26293
  Description of Artificial Sequence: Synthetic polypeptide
  VH of XENP022443

SEQ ID NO: 27283 - protein, 5 aa, Artificial Sequence
  Description of Artificial Sequence: Synthetic peptide
  XENP022443 vhCDR1
GYYMH

SEQ ID NO: 27284 - protein, 17 aa, Artificial Sequence
  Description of Artificial Sequence: Synthetic peptide
  XENP022443 vhCDR2
WINPHSGGTNYAQKFQG

SEQ ID NO: 27285 - protein, 16 aa, Artificial Sequence
  Description of Artificial Sequence: Synthetic peptide
  XENP022443 vhCDR3
TYYYDSSGYYHDAFDI

SEQ ID NO: 27286 - protein, 231 aa, Artificial Sequence; identical to SEQ ID NO: 27198
  Description of Artificial Sequence: Synthetic polypeptide
  XENP022443 [ICOS]_H0_L0.14 one-arm mAb Fc-only Heavy Chain

SEQ ID NO: 27287 - protein, 214 aa, Artificial Sequence
  Description of Artificial Sequence: Synthetic polypeptide
  XENP022443 [ICOS]_H0_L0.14 one-arm mAb Light Chain
DIQMTQSPSSVSASVGDRVTITCRASQGISRLLAWYQQKPGKAPKLLIYVASSLQSGVPSRFSGSGSGTDFTLTISSLQPEDFATYYCQQSNSFPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 27288 - protein, 107 aa, Artificial Sequence
  Description of Artificial Sequence: Synthetic polypeptide
  VL of XENP022443
DIQMTQSPSSVSASVGDRVTITCRASQGISRLLAWYQQKPGKAPKLLIYVASSLQSGVPSRFSGSGSGTDFTLTISSLQPEDFATYYCQQSNSFPWTFGQGTKVEIK

SEQ ID NO: 27289 - protein, 11 aa, Artificial Sequence
  Description of Artificial Sequence: Synthetic peptide
  XENP022443 vlCDR1
RASQGISRLLA

SEQ ID NO: 27290 - protein, 7 aa, Artificial Sequence
  Description of Artificial Sequence: Synthetic peptide
  XENP022443 vlCDR2
VASSLQS

SEQ ID NO: 27291 - protein, 9 aa, Artificial Sequence
  Description of Artificial Sequence: Synthetic peptide
  XENP022443 vlCDR3
QQSNSFPWT

SEQ ID NO: 27292 - protein, 454 aa, Artificial Sequence; identical to SEQ ID NO: 26442
  Description of Artificial Sequence: Synthetic polypeptide
  XENP022444 [ICOS]_H0_L0.15 one-arm mAb Fab-Fc Heavy Chain

SEQ ID NO: 27293 - protein, 125 aa, Artificial Sequence; identical to SEQ ID NO: 26293
  Description of Artificial Sequence: Synthetic polypeptide
  VH of XENP022444

SEQ ID NO: 27294 - protein, 5 aa, Artificial Sequence
  Description of Artificial Sequence: Synthetic peptide
  XENP022444 vhCDR1
GYYMH

SEQ ID NO: 27295 - protein, 17 aa, Artificial Sequence
  Description of Artificial Sequence: Synthetic peptide
  XENP022444 vhCDR2
WINPHSGGTNYAQKFQG

SEQ ID NO: 27296 - protein, 16 aa, Artificial Sequence
  Description of Artificial Sequence: Synthetic peptide
  XENP022444 vhCDR3
TYYYDSSGYYHDAFDI

SEQ ID NO: 27297 - protein, 231 aa, Artificial Sequence; identical to SEQ ID NO: 27198
  Description of Artificial Sequence: Synthetic polypeptide
  XENP022444 [ICOS]_H0_L0.15 one-arm mAb Fc-only Heavy Chain

SEQ ID NO: 27298 - protein, 214 aa, Artificial Sequence
  Description of Artificial Sequence: Synthetic polypeptide
  XENP022444 [ICOS]_H0_L0.15 one-arm mAb Light Chain
DIQMTQSPSSVSASVGDRVTITCRASQGISRLLAWYQQKPGKAPKLLIYVASSLQSGVPSRFSGSGSGTDFTLTISSLQPEDFATYYCQQAESFPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 27299 - protein, 107 aa, Artificial Sequence
  Description of Artificial Sequence: Synthetic polypeptide
  VL of XENP022444
DIQMTQSPSSVSASVGDRVTITCRASQGISRLLAWYQQKPGKAPKLLIYVASSLQSGVPSRFSGSGSGTDFTLTISSLQPEDFATYYCQQAESFPWTFGQGTKVEIK

SEQ ID NO: 27300 - protein, 11 aa, Artificial Sequence
  Description of Artificial Sequence: Synthetic peptide
  XENP022444 vlCDR1
RASQGISRLLA

SEQ ID NO: 27301 - protein, 7 aa, Artificial Sequence
  Description of Artificial Sequence: Synthetic peptide
  XENP022444 vlCDR2
VASSLQS

SEQ ID NO: 27302 - protein, 9 aa, Artificial Sequence
  Description of Artificial Sequence: Synthetic peptide
  XENP022444 vlCDR3
QQAESFPWT

SEQ ID NO: 27303 - protein, 454 aa, Artificial Sequence; identical to SEQ ID NO: 26442
  Description of Artificial Sequence: Synthetic polypeptide
  XENP022445 [ICOS]_H0_L0.20 one-arm mAb Fab-Fc Heavy Chain

SEQ ID NO: 27304 - protein, 125 aa, Artificial Sequence; identical to SEQ ID NO: 26293
  Description of Artificial Sequence: Synthetic polypeptide
  VH of XENP022445

SEQ ID NO: 27305 - protein, 5 aa, Artificial Sequence
  Description of Artificial Sequence: Synthetic peptide
  XENP022445 vhCDR1
GYYMH

SEQ ID NO: 27306 - protein, 17 aa, Artificial Sequence
  Description of Artificial Sequence: Synthetic peptide
  XENP022445 vhCDR2
WINPHSGGTNYAQKFQG

SEQ ID NO: 27307 - protein, 16 aa, Artificial Sequence
  Description of Artificial Sequence: Synthetic peptide
  XENP022445 vhCDR3
TYYYDSSGYYHDAFDI

SEQ ID NO: 27308 - protein, 231 aa, Artificial Sequence; identical to SEQ ID NO: 27198
  Description of Artificial Sequence: Synthetic polypeptide
  XENP022445 [ICOS]_H0_L0.20 one-arm mAb Fc-only Heavy Chain

SEQ ID NO: 27309 - protein, 214 aa, Artificial Sequence
  Description of Artificial Sequence: Synthetic polypeptide
  XENP022445 [ICOS]_H0_L0.20 one-arm mAb Light Chain
DIQMTQSPSSVSASVGDRVTITCRASQGISRLLAWYQQKPGKAPKLLIYVASSLQSGVPSRFSGSGSGTDFTLTISSLQPEDFATYYCQQANSYPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 27310 - protein, 107 aa, Artificial Sequence
  Description of Artificial Sequence: Synthetic polypeptide
  VL of XENP022445
DIQMTQSPSSVSASVGDRVTITCRASQGISRLLAWYQQKPGKAPKLLIYVASSLQSGVPSRFSGSGSGTDFTLTISSLQPEDFATYYCQQANSYPWTFGQGTKVEIK

SEQ ID NO: 27311 - protein, 11 aa, Artificial Sequence
  Description of Artificial Sequence: Synthetic peptide
  XENP022445 vlCDR1
RASQGISRLLA

SEQ ID NO: 27312 - protein, 7 aa, Artificial Sequence
  Description of Artificial Sequence: Synthetic peptide
  XENP022445 vlCDR2
VASSLQS

SEQ ID NO: 27313 - protein, 9 aa, Artificial Sequence
  Description of Artificial Sequence: Synthetic peptide
  XENP022445 vlCDR3
QQANSYPWT

SEQ ID NO: 27314 - protein, 454 aa, Artificial Sequence; identical to SEQ ID NO: 26442
  Description of Artificial Sequence: Synthetic polypeptide
  XENP022766 [ICOS]_H0_L0.38 one-arm mAb Fab-Fc Heavy Chain

SEQ ID NO: 27315 - protein, 125 aa, Artificial Sequence; identical to SEQ ID NO: 26293
  Description of Artificial Sequence: Synthetic polypeptide
  VH of XENP022766

SEQ ID NO: 27316 - protein, 5 aa, Artificial Sequence
  Description of Artificial Sequence: Synthetic peptide
  XENP022766 vhCDR1
GYYMH

SEQ ID NO: 27317 - protein, 17 aa, Artificial Sequence
  Description of Artificial Sequence: Synthetic peptide
  XENP022766 vhCDR2
WINPHSGGTNYAQKFQG

SEQ ID NO: 27318 - protein, 16 aa, Artificial Sequence
  Description of Artificial Sequence: Synthetic peptide
  XENP022766 vhCDR3
TYYYDSSGYYHDAFDI

SEQ ID NO: 27319 - protein, 231 aa, Artificial Sequence; identical to SEQ ID NO: 27198
  Description of Artificial Sequence: Synthetic polypeptide
  XENP022766 [ICOS]_H0_L0.38 one-arm mAb Fc-only Heavy Chain

SEQ ID NO: 27320 - protein, 214 aa, Artificial Sequence; identical to SEQ ID NO: 26557
  Description of Artificial Sequence: Synthetic polypeptide
  XENP022766 [ICOS]_H0_L0.38 one-arm mAb Light Chain

SEQ ID NO: 27321 - protein, 107 aa, Artificial Sequence; identical to SEQ ID NO: 26558
  Description of Artificial Sequence: Synthetic polypeptide
  VL of XENP022766

SEQ ID NO: 27322 - protein, 11 aa, Artificial Sequence
  Description of Artificial Sequence: Synthetic peptide
  XENP022766 vlCDR1
QASQDISSLLA

SEQ ID NO: 27323 - protein, 7 aa, Artificial Sequence
  Description of Artificial Sequence: Synthetic peptide
  XENP022766 vlCDR2
AASSLQS

SEQ ID NO: 27324 - protein, 9 aa, Artificial Sequence
  Description of Artificial Sequence: Synthetic peptide
  XENP022766 vlCDR3
QQAESFPWT

SEQ ID NO: 27325 - protein, 454 aa, Artificial Sequence; identical to SEQ ID NO: 26562
  Description of Artificial Sequence: Synthetic polypeptide
  XENP023096 [ICOS]_H0.66_L0 one-arm mAb Fab-Fc Heavy Chain

SEQ ID NO: 27326 - protein, 125 aa, Artificial Sequence; identical to SEQ ID NO: 26563
  Description of Artificial Sequence: Synthetic polypeptide
  VH of XENP023096

SEQ ID NO: 27327 - protein, 5 aa, Artificial Sequence
  Description of Artificial Sequence: Synthetic peptide
  XENP023096 vhCDR1
GYYMH

SEQ ID NO: 27328 - protein, 17 aa, Artificial Sequence
  Description of Artificial Sequence: Synthetic peptide
  XENP023096 vhCDR2
WINPHSGETIYAQKFQG

SEQ ID NO: 27329 - protein, 16 aa, Artificial Sequence
  Description of Artificial Sequence: Synthetic peptide
  XENP023096 vhCDR3
TYYYDTSGYYHDAFDV

SEQ ID NO: 27330 - protein, 231 aa, Artificial Sequence; identical to SEQ ID NO: 27198
  Description of Artificial Sequence: Synthetic polypeptide
  XENP023096 [ICOS]_H0.66_L0 one-arm mAb Fc-only Heavy Chain

SEQ ID NO: 27331 - protein, 214 aa, Artificial Sequence; identical to SEQ ID NO: 26297
  Description of Artificial Sequence: Synthetic polypeptide
  XENP023096 [ICOS]_H0.66_L0 one-arm mAb Light Chain

SEQ ID NO: 27332 - protein, 107 aa, Artificial Sequence; identical to SEQ ID NO: 26298
  Description of Artificial Sequence: Synthetic polypeptide
  VL of XENP023096

SEQ ID NO: 27333 - protein, 11 aa, Artificial Sequence
  Description of Artificial Sequence: Synthetic peptide
  XENP023096 vlCDR1
RASQGISRLLA

SEQ ID NO: 27334 - protein, 7 aa, Artificial Sequence
  Description of Artificial Sequence: Synthetic peptide
  XENP023096 vlCDR2
VASSLQS

SEQ ID NO: 27335 - protein, 9 aa, Artificial Sequence
  Description of Artificial Sequence: Synthetic peptide
  XENP023096 vlCDR3
QQANSFPWT

SEQ ID NO: 27336 - protein, 447 aa, Artificial Sequence; identical to SEQ ID NO: 26382
  Description of Artificial Sequence: Synthetic polypeptide
  XENP023377 11D4[OX40]_H0L0 _Fab-1G6_L1.194_H1.279_scFv Fab-Fc Heavy Chain

SEQ ID NO: 27337 - protein, 118 aa, Artificial Sequence; identical to SEQ ID NO: 26273
  Description of Artificial Sequence: Synthetic polypeptide
  VH of XENP023377

SEQ ID NO: 27338 - protein, 5 aa, Artificial Sequence
  Description of Artificial Sequence: Synthetic peptide
  XENP023377 vhCDR1
SYSMN

SEQ ID NO: 27339 - protein, 11 aa, Artificial Sequence
  Description of Artificial Sequence: Synthetic peptide
  XENP023377 vhCDR2
YISSSSSTIDY

SEQ ID NO: 27340 - protein, 9 aa, Artificial Sequence
  Description of Artificial Sequence: Synthetic peptide
  XENP023377 vhCDR3
ESGWYLFDY

SEQ ID NO: 27341 - protein, 480 aa, Artificial Sequence; identical to SEQ ID NO: 2870
  Description of Artificial Sequence: Synthetic polypeptide
  XENP023377 11D4[OX40]_H0L0 _Fab-1G6_L1.194_H1.279_scFv scFv-Fc Heavy Chain

SEQ ID NO: 27342 - protein, 107 aa, Artificial Sequence; identical to SEQ ID NO: 2871
  Description of Artificial Sequence: Synthetic polypeptide
  VH of XENP023377

SEQ ID NO: 27343 - protein, 122 aa, Artificial Sequence; identical to SEQ ID NO: 2872
  Description of Artificial Sequence: Synthetic polypeptide
  VL of XENP023377

SEQ ID NO: 27344 - protein, 231 aa, Artificial Sequence; identical to SEQ ID NO: 2397
  Description of Artificial Sequence: Synthetic polypeptide
  Fc chain of XENP023377

SEQ ID NO: 27345 - protein, 11 aa, Artificial Sequence
  Description of Artificial Sequence: Synthetic peptide
  XENP023377 vhCDR1
RASQSVGNDVA

SEQ ID NO: 27346 - protein, 7 aa, Artificial Sequence
  Description of Artificial Sequence: Synthetic peptide
  XENP023377 vhCDR2
YASHRYT

SEQ ID NO: 27347 - protein, 9 aa, Artificial Sequence
  Description of Artificial Sequence: Synthetic peptide
  XENP023377 vhCDR3
QQDFSSPRT

SEQ ID NO: 27348 - protein, 5 aa, Artificial Sequence
  Description of Artificial Sequence: Synthetic peptide
  XENP023377 vlCDR1
NYWMN

SEQ ID NO: 27349 - protein, 19 aa, Artificial Sequence
  Description of Artificial Sequence: Synthetic peptide
  XENP023377 vlCDR2
EIRLYSNNYATHYAESVKG

SEQ ID NO: 27350 - protein, 11 aa, Artificial Sequence
  Description of Artificial Sequence: Synthetic peptide
  XENP023377 vlCDR3
YYGNYGGYFDV

SEQ ID NO: 27351 - protein, 214 aa, Artificial Sequence; identical to SEQ ID NO: 26277
  Description of Artificial Sequence: Synthetic polypeptide
  XENP023377 11D4[OX40]_H0L0 _Fab-1G6_L1.194_H1.279_scFv Light Chain

SEQ ID NO: 27352 - protein, 107 aa, Artificial Sequence; identical to SEQ ID NO: 26278
  Description of Artificial Sequence: Synthetic polypeptide
  VL of XENP023377

SEQ ID NO: 27353 - protein, 11 aa, Artificial Sequence
  Description of Artificial Sequence: Synthetic peptide
  XENP023377 vlCDR1
RASQGISSWLA

SEQ ID NO: 27354 - protein, 7 aa, Artificial Sequence
  Description of Artificial Sequence: Synthetic peptide
  XENP023377 vlCDR2
AASSLQS

SEQ ID NO: 27355 - protein, 9 aa, Artificial Sequence
  Description of Artificial Sequence: Synthetic peptide
  XENP023377 vlCDR3
QQYNSYPPT

SEQ ID NO: 27356 - protein, 451 aa, Artificial Sequence; identical to SEQ ID NO: 26402
  Description of Artificial Sequence: Synthetic polypeptide
  XENP023378 1D8[GITR]_H0L0 _Fab-1G6_L1.194_H1.279_scFv Fab-Fc Heavy Chain

SEQ ID NO: 27357 - protein, 122 aa, Artificial Sequence; identical to SEQ ID NO: 26283
  Description of Artificial Sequence: Synthetic polypeptide
  VH of XENP023378

SEQ ID NO: 27358 - protein, 7 aa, Artificial Sequence
  Description of Artificial Sequence: Synthetic peptide
  XENP023378 vhCDR1
TSGMGVG

SEQ ID NO: 27359 - protein, 9 aa, Artificial Sequence
  Description of Artificial Sequence: Synthetic peptide
  XENP023378 vhCDR2
HIWWDDDKY

SEQ ID NO: 27360 - protein, 12 aa, Artificial Sequence
  Description of Artificial Sequence: Synthetic peptide
  XENP023378 vhCDR3
SYYYGSSGAMDY

SEQ ID NO: 27361 - protein, 480 aa, Artificial Sequence; identical to SEQ ID NO: 2870
  Description of Artificial Sequence: Synthetic polypeptide
  XENP023378 1D8[GITR]_H0L0 _Fab-1G6_L1.194_H1.279_scFv scFv-Fc Heavy Chain

SEQ ID NO: 27362 - protein, 107 aa, Artificial Sequence; identical to SEQ ID NO: 2871
  Description of Artificial Sequence: Synthetic polypeptide
  VH of XENP023378

SEQ ID NO: 27363 - protein, 122 aa, Artificial Sequence; identical to SEQ ID NO: 2872
  Description of Artificial Sequence: Synthetic polypeptide
  VL of XENP023378

SEQ ID NO: 27364 - protein, 231 aa, Artificial Sequence; identical to SEQ ID NO: 2397
  Description of Artificial Sequence: Synthetic polypeptide
  Fc chain of XENP023378

SEQ ID NO: 27365 - protein, 11 aa, Artificial Sequence
  Description of Artificial Sequence: Synthetic peptide
  XENP023378 vhCDR1
RASQSVGNDVA

SEQ ID NO: 27366 - protein, 7 aa, Artificial Sequence
  Description of Artificial Sequence: Synthetic peptide
  XENP023378 vhCDR2
YASHRYT

SEQ ID NO: 27367 - protein, 9 aa, Artificial Sequence
  Description of Artificial Sequence: Synthetic peptide
  XENP023378 vhCDR3
QQDFSSPRT

SEQ ID NO: 27368 - protein, 5 aa, Artificial Sequence
  Description of Artificial Sequence: Synthetic peptide
  XENP023378 vlCDR1
NYWMN

SEQ ID NO: 27369 - protein, 19 aa, Artificial Sequence
  Description of Artificial Sequence: Synthetic peptide
  XENP023378 vlCDR2
EIRLYSNNYATHYAESVKG

SEQ ID NO: 27370 - protein, 11 aa, Artificial Sequence
  Description of Artificial Sequence: Synthetic peptide
  XENP023378 vlCDR3
YYGNYGGYFDV

SEQ ID NO: 27371 - protein, 219 aa, Artificial Sequence; identical to SEQ ID NO: 26287
  Description of Artificial Sequence: Synthetic polypeptide
  XENP023378 1D8[GITR]_H0L0 _Fab-1G6_L1.194_H1.279_scFv Light Chain

SEQ ID NO: 27372 - protein, 112 aa, Artificial Sequence; identical to SEQ ID NO: 26288
  Description of Artificial Sequence: Synthetic polypeptide
  VL of XENP023378

SEQ ID NO: 27373 - protein, 16 aa, Artificial Sequence
  Description of Artificial Sequence: Synthetic peptide
  XENP023378 vlCDR1
RSSQSLVHSDGNTYLH

SEQ ID NO: 27374 - protein, 6 aa, Artificial Sequence
  Description of Artificial Sequence: Synthetic peptide
  XENP023378 vlCDR2
KVSKRF

SEQ ID NO: 27375 - protein, 9 aa, Artificial Sequence
  Description of Artificial Sequence: Synthetic peptide
  XENP023378 vlCDR3
SQSTHVPPT

SEQ ID NO: 27376 - protein, 450 aa, Artificial Sequence; identical to SEQ ID NO: 26422
  Description of Artificial Sequence: Synthetic polypeptide
  XENP023379 20H4.9[4-1BB]_H0L0 _Fab-1G6_L1.194_H1.279_scFv Fab-Fc Heavy Chain

SEQ ID NO: 27377 - protein, 121 aa, Artificial Sequence [sequence omitted]

SEQ ID NO: 27378 - protein, 5 aa, Artificial Sequence
  Description of Artificial Sequence: Synthetic peptide
  XENP023379 vhCDR1
GYYWS

SEQ ID NO: 27379 - protein, 11 aa, Artificial Sequence
  Description of Artificial Sequence: Synthetic peptide
  XENP023379 vhCDR2
EINHGGYVTYN

SEQ ID NO: 27380 - protein, 13 aa, Artificial Sequence
  Description of Artificial Sequence: Synthetic peptide
  XENP023379 vhCDR3
DYGPGNYDWYFDL

SEQ ID NO: 27381 - protein, 480 aa, Artificial Sequence; identical to SEQ ID NO: 2870
  Description of Artificial Sequence: Synthetic polypeptide
  XENP023379 20H4.9[4-1BB]_H0L0 _Fab-1G6_L1.194_H1.279_scFv scFv-Fc Heavy Chain

SEQ ID NO: 27382 - protein, 107 aa, Artificial Sequence; identical to SEQ ID NO: 2871
  Description of Artificial Sequence: Synthetic polypeptide
  VH of XENP023379

SEQ ID NO: 27383 - protein, 122 aa, Artificial Sequence; identical to SEQ ID NO: 2872
  Description of Artificial Sequence: Synthetic polypeptide
  VL of XENP023379

SEQ ID NO: 27384 - protein, 231 aa, Artificial Sequence; identical to SEQ ID NO: 2397
  Description of Artificial Sequence: Synthetic polypeptide
  Fc chain of XENP023379

SEQ ID NO: 27385 - protein, 11 aa, Artificial Sequence
  Description of Artificial Sequence: Synthetic peptide
  XENP023379 vhCDR1
RASQSVGNDVA

SEQ ID NO: 27386 - protein, 7 aa, Artificial Sequence
  Description of Artificial Sequence: Synthetic peptide
  XENP023379 vhCDR2
YASHRYT

SEQ ID NO: 27387 - protein, 9 aa, Artificial Sequence
  Description of Artificial Sequence: Synthetic peptide
  XENP023379 vhCDR3
QQDFSSPRT

SEQ ID NO: 27388 - protein, 5 aa, Artificial Sequence
  Description of Artificial Sequence: Synthetic peptide
  XENP023379 vlCDR1
NYWMN

SEQ ID NO: 27389 - protein, 19 aa, Artificial Sequence
  Description of Artificial Sequence: Synthetic peptide
  XENP023379 vlCDR2
EIRLYSNNYATHYAESVKG

SEQ ID NO: 27390 - protein, 11 aa, Artificial Sequence
  Description of Artificial Sequence: Synthetic peptide
  XENP023379 vlCDR3
YYGNYGGYFDV

SEQ ID NO: 27391 - protein, 216 aa, Artificial Sequence; identical to SEQ ID NO: 26267
  Description of Artificial Sequence: Synthetic polypeptide
  XENP023379 20H4.9[4-1BB]_H0L0 _Fab-1G6_L1.194_H1.279_scFv Light Chain

SEQ ID NO: 27392 - protein, 109 aa, Artificial Sequence [sequence omitted]

SEQ ID NO: 27393 - protein, 11 aa, Artificial Sequence
  Description of Artificial Sequence: Synthetic peptide
  XENP023379 vlCDR1
RASQSVSSYLA

SEQ ID NO: 27394 - protein, 7 aa, Artificial Sequence
  Description of Artificial Sequence: Synthetic peptide
  XENP023379 vlCDR2
DASNRAT

SEQ ID NO: 27395 - protein, 11 aa, Artificial Sequence
  Description of Artificial Sequence: Synthetic peptide
  XENP023379 vlCDR3
QQRSNWPPALT

SEQ ID NO: 27396 - protein, 447 aa, Artificial Sequence
  Description of Artificial Sequence: Synthetic polypeptide
  XENP019192 ipilimumab[CTLA-4]_H0L0 _Fab-[anti-ICOS]-H0L0_scFv Fab-Fc Heavy Chain
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 27397 - protein, 118 aa, Artificial Sequence; identical to SEQ ID NO: 3737
  Description of Artificial Sequence: Synthetic polypeptide
  VH of XENP019192

SEQ ID NO: 27398 - protein, 5 aa, Artificial Sequence
  Description of Artificial Sequence: Synthetic peptide
  XENP019192 vhCDR1
SYTMH

SEQ ID NO: 27399 - protein, 17 aa, Artificial Sequence
  Description of Artificial Sequence: Synthetic peptide
  XENP019192 vhCDR2
FISYDGNNKYYADSVKG

SEQ ID NO: 27400 - protein, 9 aa, Artificial Sequence
  Description of Artificial Sequence: Synthetic peptide
  XENP019192 vhCDR3
TGWLGPFDY

SEQ ID NO: 27401 - protein, 483 aa, Artificial Sequence; identical to SEQ ID NO: 26827
  Description of Artificial Sequence: Synthetic polypeptide
  XENP019192 ipilimumab[CTLA-4]_H0L0 _Fab-[anti-ICOS]-H0L0_scFv scFv-Fc Heavy Chain

SEQ ID NO: 27402 - protein, 125 aa, Artificial Sequence; identical to SEQ ID NO: 26293
  Description of Artificial Sequence: Synthetic polypeptide
  VH of XENP019192

SEQ ID NO: 27403 - protein, 107 aa, Artificial Sequence; identical to SEQ ID NO: 26298
  Description of Artificial Sequence: Synthetic polypeptide
  VL of XENP019192

SEQ ID NO: 27404 - protein, 231 aa, Artificial Sequence; identical to SEQ ID NO: 2397
  Description of Artificial Sequence: Synthetic polypeptide
  Fc chain of XENP019192

SEQ ID NO: 27405 - protein, 5 aa, Artificial Sequence
  Description of Artificial Sequence: Synthetic peptide
  XENP019192 vhCDR1
GYYMH

SEQ ID NO: 27406 - protein, 17 aa, Artificial Sequence
  Description of Artificial Sequence: Synthetic peptide
  XENP019192 vhCDR2
WINPHSGGTNYAQKFQG

SEQ ID NO: 27407 - protein, 16 aa, Artificial Sequence
  Description of Artificial Sequence: Synthetic peptide
  XENP019192 vhCDR3
TYYYDSSGYYHDAFDI

SEQ ID NO: 27408 - protein, 11 aa, Artificial Sequence
  Description of Artificial Sequence: Synthetic peptide
  XENP019192 vlCDR1
RASQGISRLLA

SEQ ID NO: 27409 - protein, 7 aa, Artificial Sequence
  Description of Artificial Sequence: Synthetic peptide
  XENP019192 vlCDR2
VASSLQS

SEQ ID NO: 27410 - protein, 9 aa, Artificial Sequence
  Description of Artificial Sequence: Synthetic peptide
  XENP019192 vlCDR3
QQANSFPWT

SEQ ID NO: 27411 - protein, 215 aa, Artificial Sequence; identical to SEQ ID NO: 7600
  Description of Artificial Sequence: Synthetic polypeptide
  XENP019192 ipilimumab[CTLA-4]_H0L0 _Fab-[anti-ICOS]-H0L0_scFv Light Chain

SEQ ID NO: 27412 - protein, 108 aa, Artificial Sequence; identical to SEQ ID NO: 3741
  Description of Artificial Sequence: Synthetic polypeptide
  VL of XENP019192

SEQ ID NO: 27413 - protein, 12 aa, Artificial Sequence
  Description of Artificial Sequence: Synthetic peptide
  XENP019192 vlCDR1
RASQSVGSSYLA

SEQ ID NO: 27414 - protein, 7 aa, Artificial Sequence
  Description of Artificial Sequence: Synthetic peptide
  XENP019192 vlCDR2
GAFSRAT

SEQ ID NO: 27415 - protein, 9 aa, Artificial Sequence
  Description of Artificial Sequence: Synthetic peptide
  XENP019192 vlCDR3
QQYGSSPWT

SEQ ID NO: 27416 - protein, 450 aa, Artificial Sequence; identical to SEQ ID NO: 26262
  Description of Artificial Sequence: Synthetic polypeptide
  XENP014410 20H4.9[4-1BB]_H0L0_IgG1_PVA_/S267K Heavy Chain

SEQ ID NO: 27417 - protein, 121 aa, Artificial Sequence [sequence omitted]

SEQ ID NO: 27418 - protein, 5 aa, Artificial Sequence
  Description of Artificial Sequence: Synthetic peptide
  XENP014410 vhCDR1
GYYWS

SEQ ID NO: 27419 - protein, 16 aa, Artificial Sequence
  Description of Artificial Sequence: Synthetic peptide
  XENP014410 vhCDR2
EINHGGYVTYNPSLES

SEQ ID NO: 27420 - protein, 13 aa, Artificial Sequence
  Description of Artificial Sequence: Synthetic peptide
  XENP014410 vhCDR3
DYGPGNYDWYFDL

SEQ ID NO: 27421 - protein, 216 aa, Artificial Sequence; identical to SEQ ID NO: 26267
  Description of Artificial Sequence: Synthetic polypeptide
  XENP014410 20H4.9[4-1BB]_H0L0_IgG1_PVA_/S267K Light Chain

SEQ ID NO: 27422 - protein, 109 aa, Artificial Sequence [sequence omitted]

SEQ ID NO: 27423 - protein, 11 aa, Artificial Sequence
  Description of Artificial Sequence: Synthetic peptide
  XENP014410 vlCDR1
RASQSVSSYLA

SEQ ID NO: 27424 - protein, 7 aa, Artificial Sequence
  Description of Artificial Sequence: Synthetic peptide
  XENP014410 vlCDR2
DASNRAT

SEQ ID NO: 27425 - protein, 11 aa, Artificial Sequence
  Description of Artificial Sequence: Synthetic peptide
  XENP014410 vlCDR3
QQRSNWPPALT

SEQ ID NO: 27426 - protein, 447 aa, Artificial Sequence; identical to SEQ ID NO: 26272
  Description of Artificial Sequence: Synthetic polypeptide
  XENP016437 11D4[OX40]_H0L0_IgG1_PVA_/S267K Heavy Chain

SEQ ID NO: 27427 - protein, 118 aa, Artificial Sequence; identical to SEQ ID NO: 26273
  Description of Artificial Sequence: Synthetic polypeptide
  VH of XENP016437

SEQ ID NO: 27428 - protein, 5 aa, Artificial Sequence
  Description of Artificial Sequence: Synthetic peptide
  XENP016437 vhCDR1
SYSMN

SEQ ID NO: 27429 - protein, 17 aa, Artificial Sequence
  Description of Artificial Sequence: Synthetic peptide
  XENP016437 vhCDR2
YISSSSSTIDYADSVKG

SEQ ID NO: 27430 - protein, 9 aa, Artificial Sequence
  Description of Artificial Sequence: Synthetic peptide
  XENP016437 vhCDR3
ESGWYLFDY

SEQ ID NO: 27431 - protein, 214 aa, Artificial Sequence; identical to SEQ ID NO: 26277
  Description of Artificial Sequence: Synthetic polypeptide
  XENP016437 11D4[OX40]_H0L0_IgG1_PVA_/S267K Light Chain

SEQ ID NO: 27432 - protein, 107 aa, Artificial Sequence; identical to SEQ ID NO: 26278
  Description of Artificial Sequence: Synthetic polypeptide
  VL of XENP016437

SEQ ID NO: 27433 - protein, 11 aa, Artificial Sequence
  Description of Artificial Sequence: Synthetic peptide
  XENP016437 vlCDR1
RASQGISSWLA

SEQ ID NO: 27434 - protein, 7 aa, Artificial Sequence
  Description of Artificial Sequence: Synthetic peptide
  XENP016437 vlCDR2
AASSLQS

SEQ ID NO: 27435 - protein, 9 aa, Artificial Sequence
  Description of Artificial Sequence: Synthetic peptide
  XENP016437 vlCDR3
QQYNSYPPT

SEQ ID NO: 27436 - protein, 451 aa, Artificial Sequence; identical to SEQ ID NO: 26282
  Description of Artificial Sequence: Synthetic polypeptide
  XENP016438 1D8[GITR]_H0L0_IgG1_PVA_/S267K Heavy Chain

SEQ ID NO: 27437 - protein, 122 aa, Artificial Sequence; identical to SEQ ID NO: 26283
  Description of Artificial Sequence: Synthetic polypeptide
  VH of XENP016438

SEQ ID NO: 27438 - protein, 7 aa, Artificial Sequence
  Description of Artificial Sequence: Synthetic peptide
  XENP016438 vhCDR1
TSGMGVG

SEQ ID NO: 27439 - protein, 16 aa, Artificial Sequence
  Description of Artificial Sequence: Synthetic peptide
  XENP016438 vhCDR2
HIWWDDDKYYSPSLKS

SEQ ID NO: 27440 - protein, 12 aa, Artificial Sequence
  Description of Artificial Sequence: Synthetic peptide
  XENP016438 vhCDR3
SYYYGSSGAMDY

SEQ ID NO: 27441 - protein, 219 aa, Artificial Sequence; identical to SEQ ID NO: 26287
  Description of Artificial Sequence: Synthetic polypeptide
  XENP016438 1D8[GITR]_H0L0_IgG1_PVA_/S267K Light Chain

SEQ ID NO: 27442 - protein, 112 aa, Artificial Sequence; identical to SEQ ID NO: 26288
  Description of Artificial Sequence: Synthetic polypeptide
  VL of XENP016438

SEQ ID NO: 27443 - protein, 16 aa, Artificial Sequence
  Description of Artificial Sequence: Synthetic peptide
  XENP016438 vlCDR1
RSSQSLVHSDGNTYLH

SEQ ID NO: 27444 - protein, 7 aa, Artificial Sequence
  Description of Artificial Sequence: Synthetic peptide
  XENP016438 vlCDR2
KVSKRFS

SEQ ID NO: 27445 - protein, 9 aa, Artificial Sequence
  Description of Artificial Sequence: Synthetic peptide
  XENP016438 vlCDR3
SQSTHVPPT
